United States Patent 11,446,398 (REGULATED BIOCIRCUIT SYSTEMS) - sequence listing, part 20

SEQ ID NO: 88987 - protein, 32767 aa, Homo sapiens
  Payload ID: 17810
  Gene Name: titin
  Uniprot ID: Q8WZ42
  ENSP ID: ENSP00000465570
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGAAASVSASASYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIRQETEITAASMVVVATAKSTKLETVPGAQEETTTQQDQMHLSYEKIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKSEAGVEVKKEVGVSITGTTVREERFEVLHGREAKVTETARVPAPVEIPVTPPTLVSGLKNVTVIEGESVTLECHISGYPSPTVTWYREDYQIESSIDFQITFQSGIARLMIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAPGFVYSEYEKEYEKEQALIRKKMAKDTVVVRTYVEDQEFHISSFEERLIKEIEYRIIKTTLEELLEEDGEEKMAVDISESEAVESGFDSRIKNYRILEGMGVTFHCKMSGYPLPKIAWYKDGKRIKHGERYQMDFLQDGRASLRIPVVLPEDEGIYTAFASNIKGNAICSGKLYVEPAAPLGAPTYIPTLEPVSRIRSLSPRSVSRSPIRMSPARMSPARMSPARMSPARMSPGRRLEETDESQLERLYKPVFVLKPVSFKCLEGQTARFDLKVVGRPMPETFWFHDGQQIVNDYTHKVVIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIRIEGTKGEAALKIDSTVSQDSAWYTATAINKAGRDTTRCKVNVEVEFAEPEPERKLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGIITCRATNKYGTDHTSATLIVKDEKSLVEESQLPEGRKGLQRIEELERMAHEGALTGVTTDQKEKQKPDIVLYPEPVRVLEGETARFRCRVTGYPQPKVNWYLNGQLIRKSKRFRVRYDGIHYLDIVDCKSYDTGEVKVTAENPEGVIEHKVKLEIQQREDFRSVLRRAPEPRPEFHVHEPGKLQFEVQKVDRPVDTTETKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCKLKMKPRPIAILQGLSDQKVCEGDIVQLEVKVSLESVEGVWMKDGQEVQPSDRVHIVIDKQSHMLLIEDMTKEDAGNYSFTIPALGLSTSGRVSVYSVDVITPLKDVNVIEGTKAVLECKVSVPDVTSVKWYLNDEQIKPDDRVQAIVKGTKQRLVINRTHASDEGPYKLIVGRVETNCNLSVEKIKIIRGLRDLTCTETQNVVFEVELSHSGIDVLWNFKDKEIKPSSKYKIEAHGKIYKLTVLNMMKDDEGKYTFYAGENMTSGKLTVAGGAISKPLTDQTVAESQEAVFECEVANPDSKGEWLRDGKHLPLTNNIRSESDGHKRRLIIAATKLDDIGEYTYKVATSKTSAKLKVEAVKIKKTLKNLTVTETQDAVFTVELTHPNVKGVQWIKNGVVLESNEKYAISVKGTIYSLRIKNCAIVDESVYGFRLGRLGASARLHVETVKIIKKPKDVTALENATVAFEVSVSHDTVPVKWFHKSVEIKPSDKHRLVSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAGKYTVVAGGNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEAPESILHERIEQEIEMEMKEFSSSFLSAEEEGLHSAELQLSKINETLELLSESPVYPTKFDSEKEGTGPIFIKEVSNADISMGDVATLSVTVIGIPKPKIQWFFNGVLLTPSADYKFVFDGDDHSLIILFTKLEDEGEYTCMASNDYGKTICSAYLKINSKGEGHKDTETESAVAKSLEKLGGPCPPHFLKELKPIRCAQGLPAIFEYTVVGEPAPTVTWFKENKQLCTSVYYTIIHNPNGSGTFIVNDPQREDSGLYICKAENMLGESTCAAELLVLLEDTDMTDTPCKAKSTPEAPEDFPQTPLKGPAVEALDSEQEIATFVKDTILKAALITEENQQLSYEHIAKANELSSQLPLGAQELQSILEQDKLTPESTREFLCINGSIHFQPLKEPSPNLQLQIVQSQKTFSKEGILMPEEPETQAVLSDTEKIFPSAMSIEQINSLTVEPLKTLLAEPEGNYPQSSIEPPMHSYLTSVAEEVLSPKEKTVSDTNREQRVTLQKQEAQSALILSQSLAEGHVESLQSPDVMISQVNYEPLVPSEHSCTEGGKILIESANPLENAGQDSAVRIEEGKSLRFPLALEEKQVLLKEEHSDNVVMPPDQIIESKREPVAIKKVQEVQGRDLLSKESLLSGIPEEQRLNLKIQICRALQAAVASEQPGLFSEWLRNIEKVEVEAVNITQEPRHIMCMYLVTSAKSVTEEVTIIIEDVDPQMANLKMELRDALCAIIYEEIDILTAEGPRIQQGAKTSLQEEMDSFSGSQKVEPITEPEVESKYLISTEEVSYFNVQSRVKYLDATPVTKGVASAVVSDEKQDESLKPSEEKEESSSESGTEEVATVKIQEAEGGLIKEDGPMIHTPLVDTVSEEGDIVHLTTSITNAKEVNWYFENKLVPSDEKFKCLQDQNTYTLVIDKVNTEDHQGEYVCEALNDSGKTATSAKLTVVKRAAPVIKRKIEPLEVALGHLAKFTCEIQSAPNVRFQWFKAGREIYESDKCSIRSSKYISSLEILRTQVVDCGEYTCKASNEYGSVSCTATLTVTEAYPPTFLSRPKSLTTFVGKAAKFICTVTGTPVIETIWQKDGAALSPSPNWRISDAENKHILELSNLTIQDRGVYSCKASNKFGADICQAELIIIDKPHFIKELEPVQSAINKKVHLECQVDEDRKVTVTWSKDGQKLPPGKDYKICFEDKIATLEIPLAKLKDSGTYVCTASNEAGSSSCSATVTVREPPSFVKKVDPSYLMLPGESARLHCKLKGSPVIQVTWFKNNKELSESNTVRMYFVNSEAILDITDVKVEDSGSYSCEAVNDVGSDSCSTEIVIKEPPSFIKTLEPADIVRGTNALLQCEVSGTGPFEISWFKDKKQIRSSKKYRLFSQKSLVCLEIFSFNSADVGEYECVVANEVGKCGCMATHLLKEPPTFVKKVDDLIALGGQTVTLQAAVRGSEPISVTWMKGQEVIREDGKIKMSFSNGVAVLIIPDVQISFGGKYTCLAENEAGSQTSVGELIVKEPAKIIERAELIQVTAGDPATLEYTVAGTPELKPKWYKDGRPLVASKKYRISFKNNVAQLKFYSAELHDSGQYTFEISNEVGSSSCETTFTVLDRDIAPFFTKPLRNVDSVVNGTCRLDCKIAGSLPMRVSWFKDGKEIAASDRYRIAFVEGTASLEIIRVDMNDAGNFTCRATNSVGSKDSSGALIVQEPPSFVTKPGSKDVLPGSAVCLKSTFQGSTPLTIRWFKGNKELVSGGSCYITKEALESSLELYLVKTSDSGTYTCKVSNVAGGVECSANLFVKEPATFVEKLEPSQLLKKGDATQLACKVTGTPPIKITWFANDREIKESSKHRMSFVESTAVLRLTDVGIEDSGEYMCEAQNEAGSDHCSSIVIVKESPYFTKEFKPIEVLKEYDVMLLAEVAGTPPFEITWFKDNTILRSGRKYKTFIQDHLVSLQILKFVAADAGEYQCRVTNEVGSSICSARVTLREPPSFIKKIESTSSLRGGTAAFQATLKGSLPITVTWLKDSDEITEDDNIRMTFENNVASLYLSGIEVKHDGKYVCQAKNDAGIQRCSALLSVKEPATITEEAVSIDVTQGDPATLQVKFSGTKEITAKWFKDGQELTLGSKYKISVTDTVSILKIISTEKKDSGEYTFEVQNDVGRSSCKARINVLDLIIPPSFTKKLKKMDSIKGSFIDLECIVAGSHPISIQWFKDDQEISASEKYKFSFHDNTAFLEISQLEGTDSGTYTCSATNKAGHNQCSGHLTVKEPPYFVEKPQSQDVNPNTRVQLKALVGGTAPMTIKWFKDNKELHSGAARSVWKDDTSTSLELFAAKATDSGTYICQLSNDVGTATSKATLFVKEPPQFIKKPSPVLVLRNGQSTTFECQITGTPKIRVSWYLDGNEITAIQKHGISFIDGLATFQISGARVENSGTYVCEARNDAGTASCSIELKVKEPPTFIRELKPVEVVKYSDVELECEVTGTPPFEVTWLKNNREIRSSKKYTLTDRVSVFNLHITKCDPSDTGEYQCIVSNEGGSCSCSTRVALKEPPSFIKKIENTTTVLKSSATFQSTVAGSPPISITWLKDDQILDEDDNVYISFVDSVATLQIRSVDNGHSGRYTCQAKNESGVERCYAFLLVQEPAQIVEKAKSVDVTEKDPMTLECVVAGTPELKVKWLKDGKQIVPSRYFSMSFENNVASFRIQSVMKQDSGQYTFKVENDFGSSSCDAYLRVLDQNIPPSFTKKLTKMDKVLGSSIHMECKVSGSLPISAQWFKDGKEISTSAKYRLVCHERSVSLEVNNLELEDTANYTCKVSNVAGDDACSGILTVKEPPSFLVKPGRQQAIPDSTVEFKAILKGTPPFKIKWFKDDVELVSGPKCFIGLEGSTSFLNLYSVDASKTGQYTCHVTNDVGSDSCTTMLLVTEPPKFVKKLEASKIVKAGDSSRLECKIAGSPEIRVVWFRNEHELPASDKYRMTFIDSVAVIQMNNLSTEDSGDFICEAQNPAGSTSCSTKVIVKEPPVFSSFPPIVETLKNAEVSLECELSGTPPFEVVWYKDKRQLRSSKKYKIASKNFHTSIHILNVDTSDIGEYHCKAQNEVGSDTCVCTVKLKEPPRFVSKLNSLTVVAGEPAELQASIEGAQPIFVQWLKEKEEVIRESENIRITFVENVATLQFAKAEPANAGKYICQIKNDGGMRENMATLMVLEPAVIVEKAGPMTVTVGETCTLECKVAGTPELSVEWYKDGKLLTSSQKHKFSFYNKISSLRILSVERQDAGTYTFQVQNNVGKSSCTAVVDVSDRAVPPSFTRRLKNTGGVLGASCILECKVAGSSPISVAWFHEKTKIVSGAKYQTTFSDNVCTLQLNSLDSSDMGNYTCVAANVAGSDECRAVLTVQEPPSFVKEPEPLEVLPGKNVTFTSVIRGTPPFKVNWFRGARELVKGDRCNIYFEDTVAELELFNIDISQSGEYTCVVSNNAGQASCTTRLFVKEPAAFLKRLSDHSVEPGKSIILESTYTGTLPISVTWKKDGFNITTSEKCNIVTTEKTCILEILNSTKRDAGQYSCEIENEAGRDVCGALVSTLEPPYFVTELEPLEAAVGDSVSLQCQVAGTPEITVSWYKGDTKLRPTPEYRTYFTNNVATLVFNKVNINDSGEYTCKAENSIGTASSKTVFRIQERQLPPSFARQLKDIEQTVGLPVTLTCRLNGSAPIQVCWYRDGVLLRDDENLQTSFVDNVATLKILQTDLSHSGQYSCSASNPLGTASSSARLTAREPKKSPFFDIKPVSIDVIAGESADFECHVTGAQPMRITWSKDNKEIRPGGNYTITCVGNTPHLRILKVGKGDSGQYTCQATNDVGKDMCSAQLSVKEPPKFVKKLEASKVAKQGESIQLECKISGSPEIKVSWFRNDSELHESWKYNMSFINSVALLTINEASAEDSGDYICEAHNGVGDASCSTALTVKAPPVFTQKPSPVGALKGSDVILQCEISGTPPFEVVWVKDRKQVRNSKKFKITSKHFDTSLHILNLEASDVGEYHCKATNEVGSDTCSCSVKFKEPPRFVKKLSDTSTLIGDAVELRAIVEGFQPISVVWLKDRGEVIRESENTRISFIDNIATLQLGSPEASNSGKYICQIKNDAGMRECSAVLTVLEPARIIEKPEPMTVTTGNPFALECVVTGTPELSAKWFKDGRELSADSKHHITFINKVASLKIPCAEMSDKGLYSFEVKNSVGKSNCTVSVHVSDRIVPPSFIRKLKDVNAILGASVVLECRVSGSAPISVGWFQDGNEIVSGPKCQSSFSENVCTLNLSLLEPSDTGIYTCVAANVAGSDECSAVLTVQEPPSFEQTPDSVEVLPGMSLTFTSVIRGTPPFKVKWFKGSRELVPGESCNISLEDFVTELELFEVQPLESGDYSCLVTNDAGSASCTTHLFVKEPATFVKRLADFSVETGSPIVLEATYTGTPPISVSWIKDEYLISQSERCSITMTEKSTILEILESTIEDYAQYSCLIENEAGQDICEALVSVLEPPYFIEPLEHVEAVIGEPATLQCKVDGTPEIRISWYKEHTKLRSAPAYKMQFKNNVASLVINKVDHSDVGEYSCKADNSVGAVASSAVLVIKARKLPPFFARKLKDVHETLGFPVAFECRINGSEPLQVSWYKDGVLLKDDANLQTSFVHNVATLQILQTDQSHIGQYNCSASNPLGTASSSAKLILSEHEVPPFFDLKPVSVDLALGESGTFKCHVTGTAPIKITWAKDNREIRPGGNYKMTLVENTATLTVLKVGKGDAGQYTCYASNIAGKDSCSAQLGVQEPPRFIKKLEPSRIVKQDEFTRYECKIGGSPEIKVLWYKDETEIQESSKFRMSFVDSVAVLEMHNLSVEDSGDYTCEAHNAAGSASSSTSLKVKEPPIFRKKPHPIETLKGADVHLECELQGTPPFHVSWYKDKRELRSGKKYKIMSENFLTSIHILNVDAADIGEYQCKATNDVGSDTCVGSIALKAPPRFVKKLSDISTVVGKEVQLQTTIEGAEPISVVWFKDKGEIVRESDNIWISYSENIATLQFSRVEPANAGKYTCQIKNDAGMQECFATLSVLEPATIVEKPESIKVTTGDTCTLECTVAGTPELSTKWFKDGKELTSDNKYKISFFNKVSGLKIINVAPSDSGVYSFEVQNPVGKDSCTASLQVSDRTVPPSFTRKLKETNGLSGSSVVMECKVYGSPPISVSWFHEGNEISSGRKYQTTLTDNTCALTVNMLEESDSGDYTCIATNMAGSDECSAPLTVREPPSFVQKPDPMDVLTGTNVTFTSIVKGTPPFSVSWFKGSSELVPGDRCNVSLEDSVAELELFDVDTSQSGEYTCIVSNEAGKASCTTHLYIKAPAKFVKRLNDYSIEKGKPLILEGTFTGTPPISVTWKKNGINVTPSQRCNITTTEKSAILEIPSSTVEDAGQYNCYIENASGKDSCSAQILILEPPYFVKQLEPVKVSVGDSASLQCQLAGTPEIGVSWYKGDTKLRPTTTYKMHFRNNVATLVFNQVDINDSGEYICKAENSVGEVSASTFLTVQEQKLPPSFSRQLRDVQETVGLPVVFDCAISGSEPISVSWYKDGKPLKDSPNVQTSFLDNTATLNIFKTDRSLAGQYSCTATNPIGSASSSARLILTEGKNPPFFDIRLAPVDAVVGESADFECHVTGTQPIKVSWAKDSREIRSGGKYQISYLENSAHLTVLKVDKGDSGQYTCYAVNEVGKDSCTAQLNIKERLIPPSFTKRLSETVEETEGNSFKLEGRVAGSQPITVAWYKNNIEIQPTSNCEITFKNNTLVLQVRKAGMNDAGLYTCKVSNDAGSALCTSSIVIKEPKKPPVFDQHLTPVTVSEGEYVQLSCHVQGSEPIRIQWLKAGREIKPSDRCSFSFASGTAVLELRDVAKADSGDYVCKASNVAGSDTTKSKVTIKDKPAVAPATKKAAVDGRLFFVSEPQSIRVVEKTTATFIAKVGGDPIPNVKWTKGKWRQLNQGGRVFIHQKGDEAKLEIRDTTKTDSGLYRCVAFNEHGEIESNVNLQVDERKKQEKIEGDLRAMLKKTPILKKGAGEEEEIDIMELLKNVDPKEYEKYARMYGITDFRGLLQAFELLKQSQEEETHRLEIEEIERSERDEKEFEELVSFIQQRLSQTEPVTLIKDIENQTVLKDNDAVFEIDIKINYPEIKLSWYKGTEKLEPSDKFEISIDGDRHTLRVKNCQLKDQGNYRLVCGPHIASAKLTVIEPAWERHLQDVTLKEGQTCTMTCQFSVPNVKSEWFRNGRILKPQGRHKTEVEHKVHKLTIADVRAEDQGQYTCKYEDLETSAELRIEAEPIQFTKRIQNIVVSEHQSATFECEVSFDDAIVTWYKGPTELTESQKYNFRNDGRCHYMTIHNVTPDDEGVYSVIARLEPRGEARSTAELYLTTKEIKLELKPPDIPDSRVPIPTMPIRAVPPEEIPPVVAPPIPLLLPTPEEKKPPPKRIEVTKKAVKKDAKKVVAKPKEMTPREEIVKKPPPPTTLIPAKAPEIIDVSSKAEEVKIMTITRKKEVQKEKEAVYEKKQAVHKEKRVFIESFEEPYDELEVEPYTEPFEQPYYEEPDEDYEEIKVEAKKEVHEEWEEDFEEGQEYYEREEGYDEGEEEWEEAYQEREVIQVQKEVYEESHERKVPAKVPEKKAPPPPKVIKKPVIEKIEKTSRRMEEEKVQVTKVPEVSKKIVPQKPSRTPVQEEVIEVKVPAVHTKKMVISEEKMFFASHTEEEVSVTVPEVQKEIVTEEKIHVAISKRVEPPPKVPELPEKPAPEEVAPVPIPKKVEPPAPKVPEVPKKPVPEEKKPVPVPKKEPAAPPKVPEVPKKPVPEEKIPVPVAKKKEAPPAKVPEVQKGVVTEEKITIVTQREESPPPAVPEIPKKKVPEERKPVPRKEEEVPPPPKVPALPKKPVPEEKVAVPVPVAKKAPPPRAEVSKKTVVEEKRFVAEEKLSFAVPQRVEVTRHEVSAEEEWSYSEEEEGVSISVYREEEREEEEEAEVTEYEVMEEPEEYVVEEKLHIISKRVEAEPAEVTERQEKKIVLKPKIPAKIEEPPPAKVPEAPKKIVPEKKVPAPVPKKEKVPPPKVPEEPKKPVPEKKVPPKVIKMEEPLPAKVTERHMQITQEEKVLVAVTKKEAPPKARVPEEPKRAVPEEKVLKLKPKREEEPPAKVTEFRKRVVKEEKVSIEAPKREPQPIKEVTIMEEKERAYTLEEEAVSVQREEEYEEYEEYDYKEFEEYEPTEEYDQYEEYEEREYERYEEHEEYITEPEKPIPVKPVPEEPVPTKPKAPPAKVLKKAVPEEKVPVPIPKKLKPPPPKVPEEPKKVFEEKIRISITKREKEQVTEPAAKVPMKPKRVVAEEKVPVPRKEVAPPVRVPEVPKELEPEEVAFEEEVVTHVEEYLVEEEEEYIHEEEEFITEEEVVPVIPVKVPEVPRKPVPEEKKPVPVPKKKEAPPAKVPEVPKKPEEKVPVLIPKKEKPPPAKVPEVPKKPVPEEKVPVPVPKKVEAPPAKVPEVPKKPVPEKKVPVPAPKKVEAPPAKVPEVPKKLIPEEKKPTPVPKKVEAPPPKVPKKREPVPVPVALPQEEEVLFEEEIVPEEEVLPEEEEVLPEEEEVLPEEEEVLPEEEEIPPEEEEVPPEEEYVPEEEEFVPEEEVLPEVKPKVPVPAPVPEIKKKVTEKKVVIPKKEEAPPAKVPEVPKKVEEKRIILPKEEEVLPVEVTEEPEEEPISEEEIPEEPPSIEEVEEVAPPRVPEVIKKAVPEAPTPVPKKVEAPPAKVSKKIPEEKVPVPVQKKEAPPAKVPEVPKKVPEKKVLVPKKEAVPPAKGRTVLEEKVSVAFRQEVVVKERLELEVVEAEVEEIPEEEEFHEVEEYFEEGEFHEVEEFIKLEQHRVEEEHRVEKVHRVIEVFEAEEVEVFEKPKAPPKGPEISEKIIPPKKPPTKVVPRKEPPAKVPEVPKKIVVEEKVRVPEEPRVPPTKVPEVLPPKEVVPEKKVPVPPAKKPEAPPPKVPEAPKEVVPEKKVPVPPPKKPEVPPTKVPEVPKAAVPEKKVPEAIPPKPESPPPEVPEAPKEVVPEKKVPAAPPKKPEVTPVKVPEAPKEVVPEKKVPVPPPKKPEVPPTKVPEVPKVAVPEKKVPEAIPPKPESPPPEVFEEPEEVALEEPPAEVVEEPEPAAPPQVTVPPKKPVPEKKAPAVVAKKPELPPVKVPEVPKEVVPEKKVPLVVPKKPEAPPAKVPEVPKEVVPEKKVAVPKKPEVPPAKVPEVPKKPVLEEKPAVPVPERAESPPPEVYEEPEEIAPEEEIAPEEEKPVPVAEEEEPEVPPPAVPEEPKKIIPEKKVPVIKKPEAPPPKEPEPEKVIEKPKLKPRPPPPPPAPPKEDVKEKIFQLKAIPKKKVPEKPQVPEKVELTPLKVPGGEKKVRKLLPERKPEPKEEVVLKSVLRKRPEEEEPKVEPKKLEKVKKPAVPEPPPPKPVEEVEVPTVTKRERKIPEPTKVPEIKPAIPLPAPEPKPKPEAEVKTIKPPPVEPEPTPIAAPVTVPVVGKKAEAKAPKEEAAKPKGPIKGVPKKTPSPIEAERRKLRPGSGGEKPPDEAPFTYQLKAVPLKFVKEIKDIILTESEFVGSSAIFECLVSPSTAITTWMKDGSNIRESPKHRFIADGKDRKLHIIDVQLSDAGEYTCVLRLGNKEKTSTAKLVVEELPVRFVKTLEEEVTVVKGQPLYLSCELNKERDVVWRKDGKIVVEKPGRIVPGVIGLMRALTINDADDTDAGTYTVTVENANNLECSSCVKVVEVIRDWLVKPIRDQHVKPKGTAIFACDIAKDTPNIKWFKGYDEIPAEPNDKTEILRDGNHLYLKIKNAMPEDIAEYAVEIEGKRYPAKLTLGEREVELLKPIEDVTIYEKESASFDAEISEADIPGQWKLKGELLRPSPTCEIKAEGGKRFLTLHKVKLDQAGEVLYQALNAITTAILTVKEIELDFAVPLKDVTVPERRQARFECVLTREANVIWSKGPDIIKSSDKFDIIADGKKHILVINDSQFDDEGVYTAEVEGKKTSARLFVTGIRLKFMSPLEDQTVKEGETATFVCELSHEKMHVVWFKNDAKLHTSRTVLISSEGKTHKLEMKEVTLDDISQIKAQVKELSSTAQLKVLEADPYFTVKLHDKTAVEKDEITLKCEVSKDVPVKWFKDGEEIVPSPKYSIKADGLRRILKIKKADLKDKGEYVCDCGTDKTKANVTVEARLIKVEKPLYGVEVFVGETAHFEIELSEPDVHGQWKLKGQPLTASPDCEIIEDGKKHILILHNCQLGMTGEVSFQAANAKSAANLKVKELPLIFITPLSDVKVFEKDEAKFECEVSREPKTFRWLKGTQEITGDDRFELIKDGTKHSMVIKSAAFEDEAKYMFEAEDKHTSGKLIIEGIRLKFLTPLKDVTAKEKESAVFTVELSHDNIRVKWFKNDQRLHTTRSVSMQDEGKTHSITFKDLSIDDTSQIRVEAMGMSSEAKLTVLEGDPYFTGKLQDYTGVEKDEVILQCEISKADAPVKWFKDGKEIKPSKNAVIKADGKKRMLILKKALKSDIGQYTCDCGTDKTSGKLDIEDREIKLVRPLHSVEVMETETARFETEISEDDIHANWKLKGEALLQTPDCEIKEEGKIHSLVLHNCRLDQTGGVDFQAANVKSSAHLRVKPRVIGLLRPLKDVTVTAGETATFDCELSYEDIPVEWYLKGKKLEPSDKVVPRSEGKVHTLTLRDVKLEDAGEVQLTAKDFKTHANLFVKEPPVEFTKPLEDQTVEEGATAVLECEVSRENAKVKWFKNGTEILKSKKYEIVADGRVRKLVIHDCTPEDIKTYTCDAKDFKTSCNLNVVPPHVEFLRPLTDLQVREKEMARFECELSRENAKVKWFKDGAEIKKGKKYDIISKGAVRILVINKCLLDDEAEYSCEVRTARTSGMLTVLEEEAVFTKNLANIEVSETDTIKLVCEVSKPGAEVIWYKGDEEIIETGRYEILTEGRKRILVIQNAHLEDAGNYNCRLPSSRTDGKVKVHELAAEFISKPQNLEILEGEKAEFVCSISKESFPVQWKRDDKTLESGDKYDVIADGKKRVLVVKDATLQDMGTYVVMVGAARAAAHLTVIEKLRIVVPLKDTRVKEQQEVVFNCEVNTEGAKAKWFRNEEAIFDSSKYIILQKDLVYTLRIRDAHLDDQANYNVSLTNHRGENVKSAANLIVEEEDLRIVEPLKDIETMEKKSVTFWCKVNRLNVTLKWTKNGEEVPFDNRVSYRVDKYKHMLTIKDCGFPDEGEYIVTAGQDKSVAELLIIEAPTEFVEHLEDQTVTEFDDAVFSCQLSREKANVKWYRNGREIKEGKKYKFEKDGSIHRLIIKDCRLDDECEYACGVEDRKSRARLFVEEIPVEIIRPPQDILEAPGADVVFLAELNKDKVEVQWLRNNMVVVQGDKHQMMSEGKIHRLQICDIKPRDQGEYRFIAKDKEARAKLELAAAPKIKTADQDLVVDVGKPLTMVVPYDAYPKAEAEWFKENEPLSTKTIDTTAEQTSFRILEAKKGDKGRYKIVLQNKHGKAEGFINLKVIDVPGPVRNLEVTETFDGEVSLAWEEPLTDGGSKIIGYVVERRDIKRKTWVLATDRAESCEFTVTGLQKGGVEYLFRVSARNRVGTGEPVETDNPVEARSKYDVPGPPLNVTITDVNRFGVSLTWEPPEYDGGAEITNYVIELRDKTSIRWDTAMTVRAEDLSATVTDVVEGQEYSFRVRAQNRIGVGKPSAATPFVKVADPIERPSPPVNLTSSDQTQSSVQLKWEPPLKDGGSPILGYIIERCEEGKDNWIRCNMKLVPELTYKVTGLEKGNKYLYRVSAENKAGVSDPSEILGPLTADDAFVEPTMDLSAFKDGLEVIVPNPITILVPSTGYPRPTATWCFGDKVLETGDRVKMKTLSAYAELVISPSERSDKGIYTLKLENRVKTISGEIDVNVIARPSAPKELKFGDITKDSVHLTWEPPDDDGGSPLTGYVVEKREVSRKTWTKVMDFVTDLEFTVPDLVQGKEYLFKVCARNKCGPGEPAYVDEPVNMSTPATVPDPPENVKWRDRTANSIFLTWDPPKNDGGSRIKGYIVERCPRGSDKWVACGEPVAETKMEVTGLEEGKWYAYRVKALNRQGASKPSRPTEEIQAVDTQEAPEIFLDVKLLAGLTVKAGTKIELPATVTGKPEPKITWTKADMILKQDKRITIENVPKKSTVTIVDSKRSDTGTYIIEAVNVCGRATAVVEVNVLDKPGPPAAFDITDVTNESCLLTWNPPRDDGGSKITNYVVERRATDSEVWHKLSSTVKDTNFKATKLIPNKEYIFRVAAENMYGVGEPVQASPITAKYQFDPPGPPTRLEPSDITKDAVTLTWCEPDDDGGSPITGYWVERLDPDTDKWVRCNKMPVKDTTYRVKGLTNKKKYRFRVLAENLAGPGKPSKSTEPILIKDPIDPPWPPGKPTVKDVGKTSVRLNWTKPEHDGGAKIESYVIEMLKTGTDEWVRVAEGVPTTQHLLPGLMEGQEYSFRVRAVNKAGESEPSEPSDPVLCREKLYPPSPPRWLEVINITKNTADLKWTVPEKDGGSPITNYIVEKRDVRRKGWQTVDTTVKDTKCTVTPLTEGSLYVFRVAAENAIGQSDYTEIEDSVLAKDTFTTPGPPYALAVVDVTKRHVDLKWEPPKNDGGRPIQRYVIEKKERLGTRWVKAGKTAGPDCNFRVTDVIEGTEVQFQVRAENEAGVGHPSEPTEILSIEDPTSPPSPPLDLHVTDAGRKHIAIAWKPPEKNGGSPIIGYHVEMCPVGTEKWMRVNSRPIKDLKFKVEEGVVPDKEYVLRVRAVNAIGVSEPSEISENVVAKDPDCKPTIDLETHDIIVIEGEKLSIPVPFRAVPVPTVSWHKDGKEVKASDRLTMKNDHISAHLEVPKSVRADAGIYTITLENKLGSATASINVKVIGLPGPCKDIKASDITKSSCKLTWEPPEFDGGTPILHYVLERREAGRRTYIPVMSGENKLSWTVKDLIPNGEYFFRVKAVNKVGGGEYIELKNPVIAQDPKQPPDPPVDVEVHNPTAEAMTITWKPPLYDGGSKIMGYIIEKIAKGEERWKRCNEHLVPILTYTAKGLEEGKEYQFRVRAENAAGISEPSRATPPTKAVDPIDAPKVILRTSLEVKRGDEIALDASISGSPYPTITWIKDENVIVPEEIKKRAAPLVRRRKGEVQEEEPFVLPLTQRLSIDNSKKGESQLRVRDSLRPDHGLYMIKVENDHGIAKAPCTVSVLDTPGPPINFVFEDIRKTSVLCKWEPPLDDGGSEIINYTLEKKDKTKPDSEWIVVTSTLRHCKYSVTKLIEGKEYLFRVRAENRFGPGPPCVSKPLVAKDPFGPPDAPDKPIVEDVTSNSMLVKWNEPKDNGSPILGYWLEKREVNSTHWSRVNKSLLNALKANVDGLLEGLTYVFRVCAENAAGPGKFSPPSDPKTAHDPISPPGPPIPRVTDTSSTTIELEWEPPAFNGGGEIVGYFVDKQLVGTNEWSRCTEKMIKVRQYTVKEIREGADYKLRVSAVNAAGEGPPGETQPVTVAEPQEPPAVELDVSVKGGIQIMAGKTLRIPAVVTGRPVPTKVWTKEEGELDKDRVVIDNVGTKSELIIKDALRKDHGRYVITATNSCGSKFAAARVEVFDVPGPVLDLKPVVTNRKMCLLNWSDPEDDGGSEITGFIIERKDAKMHTWRQPIETERSKCDITGLLEGQEYKFRVIAKNKFGCGPPVEIGPILAVDPLGPPTSPERLTYTERTKSTITLDWKEPRSNGGSPIQGYIIEKRRHDKPDFERVNKRLCPTTSFLVENLDEHQMYEFRVKAVNEIGESEPSLPLNVVIQDDEVPPTIKLRLSVRGDTIKVKAGEPVHIPADVTGLPMPKIEWSKNETVIEKPTDALQITKEEVSRSEAKTELSIPKAVREDKGTYTVTASNRLGSVFRNVHVEVYDRPSPPRNLAVTDIKAESCYLTWDAPLDNGGSEITHYVIDKRDASRKKAEWEEVTNTAVEKRYGIWKLIPNGQYEFRVRAVNKYGISDECKSDKVVIQDPYRLPGPPGKPKVLARTKGSMLVSWTPPLDNGGSPITGYWLEKREEGSPYWSRVSRAPITKVGLKGVEFNVPRLLEGVKYQFRAMAINAAGIGPPSEPSDPEVAGDPIFPPGPPSCPEVKDKTKSSISLGWKPPAKDGGSPIKGYIVEMQEEGTTDWKRVNEPDKLITTCECVVPNLKELRKYRFRVKAVNEAGESEPSDTTGEIPATDIQEEPEVFIDIGAQDCLVCKAGSQIRIPAVIKGRPTPKSSWEFDGKAKKAMKDGVHDIPEDAQLETAENSSVIIIPECKRSHTGKYSITAKNKAGQKTANCRVKVMDVPGPPKDLKVSDITRGSCRLSWKMPDDDGGDRIKGYVIEKRTIDGKAWTKVNPDCGSTTFVVPDLLSEQQYFFRVRAENRFGIGPPVETIQRTTARDPIYPPDPPIKLKIGLITKNTVHLSWKPPKNDGGSPVTHYIVECLAWDPTGTKKEAWRQCNKRDVEELQFTVEDLVEGGEYEFRVKAVNAAGVSKPSATVGPVTVKDQTCPPSIDLKEFMEVEEGTNVNIVAKIKGVPFPTLTWFKAPPKKPDNKEPVLYDTHVNKLVVDDTCTLVIPQSRRSDTGLYTITAVNNLGTASKEMRLNVLGRPGPPVGPIKFESVSADQMTLSWFPPKDDGGSKITNYVIEKREANRKTWVHVSSEPKECTYTIPKLLEGHEYVFRIMAQNKYGIGEPLDSEPETARNLFSVPGAPDKPTVSSVTRNSMTVNWEEPEYDGGSPVTGYWLEMKDTTSKRWKRVNRDPIKAMTLGVSYKVTGLIEGSDYQFRVYAINAAGVGPASLPSDPATARDPIAPPGPPFPKVTDWTKSSADLEWSPPLKDGGSKVTGYIVEYKEEGKEEWEKGKDKEVRGTKLVVTGLKEGAFYKFRVRAVNIAGIGEPGEVTDVIEMKDRLVSPDLQLDASVRDRIVVHAGGVIRIIAYVSGKPPPTVTWNMNERTLPQEATIETTAISSSMVIKNCQRSHQGVYSLLAKNEAGERKKTIIVDVLDVPGPVGTPFLAHNLTNESCKLTWFSPEDDGGSPITNYVIEKRESDRRAWTPVTYTVTRQNATVQGLIQGKAYFFRIAAENSIGMGPFVETSEALVIREPITVPERPEDLEVKEVTKNTVTLTWNPPKYDGGSEIINYVLESRLIGTEKFHKVTNDNLLSRKYTVKGLKEGDTYEYRVSAVNIVGQGKPSFCTKPITCKDELAPPTLHLDFRDKLTIRVGEAFALTGRYSGKPKPKVSWFKDEADVLEDDRTHIKTTPATLALEKIKAKRSDSGKYCVVVENSTGSRKGFCQVNVVDRPGPPVGPVSFDEVTKDYMVISWKPPLDDGGSKITNYIIEKKEVGKDVWMPVTSASAKTTCKVSKLLEGKDYIFRIHAENLYGISDPLVSDSMKAKDRFRVPDAPDQPIVTEVTKDSALVTWNKPHDGGKPITNYILEKRETMSKRWARVTKDPIHPYTKFRVPDLLEGCQYEFRVSAENEIGIGDPSPPSKPVFAKDPIAKPSPPVNPEAIDTTCNSVDLTWQPPRHDGGSKILGYIVEYQKVGDEEWRRANHTPESCPETKYKVTGLRDGQTYKFRVLAVNAAGESDPAHVPEPVLVKDRLEPPELILDANMAREQHIKVGDTLRLSAIIKGVPFPKVTWKKEDRDAPTKARIDVTPVGSKLEIRNAAHEDGGIYSLTVENPAGSKTVSVKVLVLDKPGPPRDLEVSEIRKDSCYLTWKEPLDDGGSVITNYVVERRDVASAQWSPLSATSKKKSHFAKHLNEGNQYLFRVAAENQYGRGPFVETPKPIKALDPLHPPGPPKDLHHVDVDKTEVSLVWNKPDRDGGSPITGYLVEYQEEGTQDWIKFKTVTNLECVVTGLQQGKTYRFRVKAENIVGLGLPDTTIPIECQEKLVPPSVELDVKLIEGLVVKAGTTVRFPAIIRGVPVPTAKWTTDGSEIKTDEHYTVETDNFSSVLTIKNCLRRDTGEYQITVSNAAGSKTVAVHLTVLDVPGPPTGPINILDVTPEHMTISWQPPKDDGGSPVINYIVEKQDTRKDTWGVVSSGSSKTKLKIPHLQKGCEYVFRVRAENKIGVGPPLDSTPTVAKHKFSPPSPPGKPVVTDITENAATVSWTLPKSDGGSPITGYYMERREVTGKWVRVNKTPIADLKFRVTGLYEGNTYEFRVFAENLAGLSKPSPSSDPIKACRPIKPPGPPINPKLKDKSRETADLVWTKPLSDGGSPILGYVVECQKPGTAQWNRINKDELIRQCAFRVPGLIEGNEYRFRIKAANIVGEGEPRELAESVIAKDILHPPEVELDVTCRDVITVRVGQTIRILARVKGRPEPDITWTKEGKVLVREKRVDLIQDLPRVELQIKEAVRADHGKYIISAKNSSGHAQGSAIVNVLDRPGPCQNLKVTNVTKENCTISWENPLDNGGSEITNFIVEYRKPNQKGWSIVASDVTKRLIKANLLANNEYYFRVCAENKVGVGPTIETKTPILAINPIDRPGEPENLHIADKGKTFVYLKWRRPDYDGGSPNLSYHVERRLKGSDDWERVHKGSIKETHYMVDRCVENQIYEFRVQTKNEGGESDWVKTEEVVVKEDLQKPVLDLKLSGVLTVKAGDTIRLEAGVRGKPFPEVAWTKDKDATDLTRSPRVKIDTRADSSKFSLTKAKRSDGGKYVVTATNTAGSFVAYATVNVLDKPGPVRNLKIVDVSSDRCTVCWDPPEDDGGCEIQNYILEKCETKRMVWSTYSATVLTPGTTVTRLIEGNEYIFRVRAENKIGTGPPTESKPVIAKTKYDKPGRPDPPEVTKVSKEEMTVVWNPPEYDGGKSITGYFLEKKEKHSTRWVPVNKSAIPERRMKVQNLLPDHEYQFRVKAENEIGIGEPSLPSRPVVAKDPIEPPGPPTNFRVVDTTKHSITLGWGKPVYDGGAPIIGYVVEMRPKIADASPDEGWKRCNAAAQLVRKEFTVTSLDENQEYEFRVCAQNQVGIGRPAELKEAIKPKEILEPPEIDLDASMRKLVIVRAGCPIRLFAIVRGRPAPKVTWRKVGIDNVVRKGQVDLVDTMAFLVIPNSTRDDSGKYSLTLVNPAGEKAVFVNVRVLDTPGPVSDLKVSDVTKTSCHVSWAPPENDGGSQVTHYIVEKREADRKTWSTVTPEVKKTSFHVTNLVPGNEYYFRVTAVNEYGPGVPTDVPKPVLASDPLSEPDPPRKLEVTEMTKNSATLAWLPPLRDGGAKIDGYITSYREEEQPADRWTEYSVVKDLSLVVTGLKEGKKYKFRVAARNAVGVSLPREAEGVYEAKEQLLPPKILMPEQITIKAGKKLRIEAHVYGKPHPTCKWKKGEDEVVTSSHLAVHKADSSSILIIKDVTRKDSGYYSLTAENSSGTDTQKIKVVVMDAPGPPQPPFDISDIDADACSLSWHIPLEDGGSNITNYIVEKCDVSRGDWVTALASVTKTSCRVGKLIPGQEYIFRVRAENRFGISEPLTSPKMVAQFPFGVPSEPKNARVTKVNKDCIFVAWDRPDSDGGSPIIGYLIERKERNSLLWVKANDTLVRSTEYPCAGLVEGLEYSFRIYALNKAGSSPPSKPTEYVTARMPVDPPGKPEVIDVTKSTVSLIWARPKHDGGSKIIGYFVEACKLPGDKWVRCNTAPHQIPQEEYTATGLEEKAQYQFRAIARTAVNISPPSEPSDPVTILAENVPPRIDLSVAMKSLLTVKAGTNVCLDATVFGKPMPTVSWKKDGTLLKPAEGIKMAMQRNLCTLELFSVNRKDSGDYTITAENSSGSKSATIKLKVLDKPGPPASVKINKMYSDRAMLSWEPPLEDGGSEITNYIVDKRETSRPNWAQVSATVPITSCSVEKLIEGHEYQFRICAENKYGVGDPVFTEPAIAKNPYDPPGRCDPPVISNITKDHMTVSWKPPADDGGSPITGYLLEKRETQAVNWTKVNRKPIIERTLKATGLQEGTEYEFRVTAINKAGPGKPSDASKAAYARDPQYPPGPPAFPKVYDTTRSSVSLSWGKPAYDGGSPIIGYLVEVKRADSDNWVRCNLPQNLQKTRFEVTGLMEDTQYQFRVYAVNKIGYSDPSDVPDKHYPKDILIPPEGELDADLRKTLILRAGVTMRLYVPVKGRPPPKITWSKPNVNLRDRIGLDIKSTDFDTFLRCENVNKYDAGKYILTLENSCGKKEYTIVVKVLDTPGPPVNVTVKEISKDSAYVTWEPPIIDGGSPIINYVVQKRDAERKSWSTVTTECSKTSFRVANLEEGKSYFFRVFAENEYGIGDPGETRDAVKASQTPGPVVDLKVRSVSKSSCSIGWKKPHSDGGSRIIGYVVDFLTEENKWQRVMKSLSLQYSAKDLTEGKEYTFRVSAENENGEGTPSEITVVARDDVVAPDLDLKGLPDLCYLAKENSNFRLKIPIKGKPAPSVSWKKGEDPLATDTRVSVESSAVNTTLIVYDCQKSDAGKYTITLKNVAGTKEGTISIKVVGKPGIPTGPIKFDEVTAEAMTLKWAPPKDDGGSEITNYILEKRDSVNNKWVTCASAVQKTTFRVTRLHEGMEYTFRVSAENKYGVGEGLKSEPIVARHPFDVPDAPPPPNIVDVRHDSVSLTWTDPKKTGGSPITGYHLEFKERNSLLWKRANKTPIRMRDFKVTGLTEGLEYEFRVMAINLAGVGKPSLPSEPVVALDPIDPPGKPEVINITRNSVTLIWTEPKYDGGHKLTGYIVEKRDLPSKSWMKANHVNVPECAFTVTDLVEGGKYEFRIRAKNTAGAISAPSESTETIICKDEYEAPTIVLDPTIKDGLTIKAGDTIVLNAISILGKPLPKSSWSKAGKDIRPSDITQITSTPTSSMLTIKYATRKDAGEYTITATNPFGTKVEHVKVTVLDVPGPPGPVEISNVSAEKATLTWTPPLEDGGSPIKSYILEKRETSRLLWTVVSEDIQSCRHVATKLIQGNEYIFRVSAVNHYGKGEPVQSEPVKMVDRFGPPGPPEKPEVSNVTKNTATVSWKRPVDDGGSEITGYHVERREKKSLRWVRAIKTPVSDLRCKVTGLQEGSTYEFRVSAENRAGIGPPSEASDSVLMKDAAYPPGPPSNPHVTDTTKKSASLAWGKPHYDGGLEITGYVVEHQKVGDEAWIKDTTGTALRITQFVVPDLQTKEKYNFRISAINDAGVGEPAVIPDVEIVEREMAPDFELDAELRRTLVVRAGLSIRIFVPIKGRPAPEVTWTKDNINLKNRANIENTESFTLLIIPECNRYDTGKFVMTIENPAGKKSGFVNVRVLDTPGPVLNLRPTDITKDSVTLHWDLPLIDGGSRITNYIVEKREATRKSYSTATTKCHKCTYKVTGLSEGCEYFFRVMAENEYGIGEPTETTEPVKASEAPSPPDSLNIMDITKSTVSLAWPKPKHDGGSKITGYVIEAQRKGSDQWTHITTVKGLECVVRNLTEGEEYTFQVMAVNSAGRSAPRESRPVIVKEQTMLPELDLRGIYQKLVIAKAGDNIKVEIPVLGRPKPTVTWKKGDQILKQTQRVNFETTATSTILNINECVRSDSGPYPLTARNIVGEVGDVITIQVHDIPGPPTGPIKFDEVSSDFVTFSWDPPENDGGVPISNYVVEMRQTDSTTWVELATTVIRTTYKATRLTTGLEYQFRVKAQNRYGVGPGITSACIVANYPFKVPGPPGTPQVTAVTKDSMTISWHEPLSDGGSPILGYHVERKERNGILWQTVSKALVPGNIFKSSGLTDGIAYEFRVIAENMAGKSKPSKPSEPMLALDPIDPPGKPVPLNITRHTVTLKWAKPEYTGGFKITSYIVEKRDLPNGRWLKANFSNILENEFTVSGLTEDAAYEFRVIAKNAAGAISPPSEPSDAITCRDDVEAPKIKVDVKFKDTVILKAGEAFRLEADVSGRPPPTMEWSKDGKELEGTAKLEIKIADFSTNLVNKDSTRRDSGAYTLTATNPGGFAKHIFNVKVLDRPGPPEGPLAVTEVTSEKCVLSWFPPLDDGGAKIDHYIVQKRETSRLAWTNVASEVQVTKLKVTKLLKGNEYIFRVMAVNKYGVGEPLESEPVLAVNPYGPPDPPKNPEVTTITKDSMVVCWGHPDSDGGSEIINYIVERRDKAGQRWIKCNKKTLTDLRYKVSGLTEGHEYEFRIMAENAAGISAPSPTSPFYKACDTVFKPGPPGNPRVLDTSRSSISIAWNKPIYDGGSEITGYMVEIALPEEDEWQIVTPPAGLKATSYTITGLTENQEYKIRIYAMNSEGLGEPALVPGTPKAEDRMLPPEIELDADLRKVVTIRACCTLRLFVPIKGRPAPEVKWARDHGESLDKASIESTSSYTLLIVGNVNRFDSGKYILTVENSSGSKSAFVNVRVLDTPGPPQDLKVKEVTKTSVTLTWDPPLLDGGSKIKNYIVEKRESTRKAYSTVATNCHKTSWKVDQLQEGCSYYFRVLAENEYGIGLPAETAESVKASERPLPPGKITLMDVTRNSVSLSWEKPEHDGGSRILGYIVEMQTKGSDKWATCATVKVTEATITGLIQGEEYSFRVSAQNEKGISDPRQLSVPVIAKDLVIPPAFKLLFNTFTVLAGEDLKVDVPFIGRPTPAVTWHKDNVPLKQTTRVNAESTENNSLLTIKDACREDVGHYVVKLTNSAGEAIETLNVIVLDKPGPPTGPVKMDEVTADSITLSWGPPKYDGGSSINNYIVEKRDTSTTTWQIVSATVARTTIKACRLKTGCEYQFRIAAENRYGKSTYLNSEPTVAQYPFKVPGPPGTPVVTLSSRDSMEVQWNEPISDGGSRVIGYHLERKERNSILWVKLNKTPIPQTKFKTTGLEEGVEYEFRVSAENIVGIGKPSKVSECYVARDPCDPPGRPEAIIVTRNSVTLQWKKPTYDGGSKITGYIVEKKELPEGRWMKASFTNIIDTHFEVTGLVEDHRYEFRVIARNAAGVFSEPSESTGAITARDEVDPPRISMDPKYKDTIVVHAGESFKVDADIYGKPIPTIQWIKGDQELSNTARLEIKSTDFATSLSVKDAVRVDSGNYILKAKNVAGERSVTVNVKVLDRPGPPEGPVVISGVTAEKCTLAWKPPLQDGGSDIINYIVERRETSRLVWTVVDANVQTLSCKVTKLLEGNEYTFRIMAVNKYGVGEPLESEPVVAKNPFVVPDAPKAPEVTTVTKDSMIVVWERPASDGGSEILGYVLEKRDKEGIRWTRCHKRLIGELRLRVTGLIENHDYEFRVSAENAAGLSEPSPPSAYQKACDPIYKPGPPNNPKVIDITRSSVFLSWSKPIYDGGCEIQGYIVEKCDVSVGEWTMCTPPTGINKTNIEVEKLLEKHEYNFRICAINKAGVGEHADVPGPIIVEEKLEAPDIDLDLELRKIINIRAGGSLRLFVPIKGRPTPEVKWGKVDGEIRDAAIIDVTSSFTSLVLDNVNRYDSGKYTLTLENSSGTKSAFVTVRVLDTPSPPVNLKVTEITKDSVSITWEPPLLDGGSKIKNYIVEKREATRKSYAAVVTNCHKNSWKIDQLQEGCSYYFRVTAENEYGIGLPAQTADPIKVAEVPQPPGKITVDDVTRNSVSLSWTKPEHDGGSKIIQYIVEMQAKHSEKWSECARVKSLQAVITNLTQGEEYLFRVVAVNEKGRSDPRSLAVPIVAKDLVIEPDVKPAFSSYSVQVGQDLKIEVPISGRPKPTITWTKDGLPLKQTTRINVTDSLDLTTLSIKETHKDDGGQYGITVANVVGQKTASIEIVTLDKPDPPKGPVKFDDVSAESITLSWNPPLYTGGCQITNYIVQKRDTTTTVWDVVSATVARTTLKVTKLKTGTEYQFRIFAENRYGQSFALESDPIVAQYPYKEPGPPGTPFATAISKDSMVIQWHEPVNNGGSPVIGYHLERKERNSILWTKVNKTIIHDTQFKAQNLEEGIEYEFRVYAENIVGVGKASKNSECYVARDPCDPPGTPEPIMVKRNEITLQWTKPVYDGGSMITGYIVEKRDLPDGRWMKASFTNVIETQFTVSGLTEDQRYEFRVIAKNAAGAISKPSDSTGPITAKDEVELPRISMDPKFRDTIVVNAGETFRLEADVHGKPLPTIEWLRGDKEIEESARCEIKNTDFKALLIVKDAIRIDGGQYILRASNVAGSKSFPVNVKVLDRPGPPEGPVQVTGVTSEKCSLTWSPPLQDGGSDISHYVVEKRETSRLAWTVVASEVVTNSLKVTKLLEGNEYVFRIMAVNKYGVGEPLESAPVLMKNPFVLPGPPKSLEVTNIAKDSMTVCWNRPDSDGGSEIIGYIVEKRDRSGIRWIKCNKRRITDLRLRVTGLTEDHEYEFRVSAENAAGVGEPSPATVYYKACDPVFKPGPPTNAHIVDTTKNSITLAWGKPIYDGGSEILGYVVEICKADEEEWQIVTPQTGLRVTRFEISKLTEHQEYKIRVCALNKVGLGEATSVPGTVKPEDKLEAPELDLDSELRKGIVVRAGGSARIHIPFKGRPTPEITWSREEGEFTDKVQIEKGVNYTQLSIDNCDRNDAGKYILKLENSSGSKSAFVTVKVLDTPGPPQNLAVKEVRKDSAFLVWEPPIIDGGAKVKNYVIDKRESTRKAYANVSSKCSKTSFKVENLTEGAIYYFRVMAENEFGVGVPVETVDAVKAAEPPSPPGKVTLTDVSQTSASLMWEKPEHDGGSRVLGYVVEMQPKGTEKWSIVAESKVCNAVVTGLSSGQEYQFRVKAYNEKGKSDPRVLGVPVIAKDLTIQPSLKLPFNTYSIQAGEDLKIEIPVIGRPRPNISWVKDGEPLKQTTRVNVEETATSTVLHIKEGNKDDFGKYTVTATNSAGTATENLSVIVLEKPGPPVGPVRFDEVSADFVVISWEPPAYTGGCQISNYIVEKRDTTTTTWHMVSATVARTTIKITKLKTGTEYQFRIFAENRYGKSAPLDSKAVIVQYPFKEPGPPGTPFVTSISKDQMLVQWHEPVNDGGTKIIGYHLEQKEKNSILWVKLNKTPIQDTKFKTTGLDEGLEYEFKVSAENIVGIGKPSKVSECFVARDPCDPPGRPEAIVITRNNVTLKWKKPAYDGGSKITGYIVEKKDLPDGRWMKASFTNVLETEFTVSGLVEDQRYEFRVIARNAAGNFSEPSDSSGAITARDEIDAPNASLDPKYKDVIVVHAGETFVLEADIRGKPIPDVVWSKDGKELEETAARMEIKSTIQKTTLVVKDCIRTDGGQYILKLSNVGGTKSIPITVKVLDRPGPPEGPLKVTGVTAEKCYLAWNPPLQDGGANISHYIIEKRETSRLSWTQVSTEVQALNYKVTKLLPGNEYIFRVMAVNKYGIGEPLESGPVTACNPYKPPGPPSTPEVSAITKDSMVVTWARPVDDGGTEIEGYILEKRDKEGVRWTKCNKKTLTDLRLRVTGLTEGHSYEFRVAAENAAGVGEPSEPSVFYRACDALYPPGPPSNPKVTDTSRSSVSLAWSKPIYDGGAPVKGYVVEVKEAAADEWTTCTPPTGLQGKQFTVTKLKENTEYNFRICAINSEGVGEPATLPGSVVAQERIEPPEIELDADLRKVVVLRASATLRLFVTIKGRPEPEVKWEKAEGILTDRAQIEVTSSFTMLVIDNVTRFDSGRYNLTLENNSGSKTAFVNVRVLDSPSAPVNLTIREVKKDSVTLSWEPPLIDGGAKITNYIVEKRETTRKAYATITNNCTKTTFRIENLQEGCSYYFRVLASNEYGIGLPAETTEPVKVSEPPLPPGRVTLVDVTRNTATIKWEKPESDGGSKITGYVVEMQTKGSEKWSTCTQVKTLEATISGLTAGEEYVFRVAAVNEKGRSDPRQLGVPVIARDIEIKPSVELPFHTFNVKAREQLKIDVPFKGRPQATVNWRKDGQTLKETTRVNVSSSKTVTSLSIKEASKEDVGTYELCVSNSAGSITVPITIIVLDRPGPPGPIRIDEVSCDSITISWNPPEYDGGCQISNYIVEKKETTSTTWHIVSQAVARTSIKIVRLTTGSEYQFRVCAENRYGKSSYSESSAVVAEYPFSPPGPPGTPKVVHATKSTMLVTWQVPVNDGGSRVIGYHLEYKERSSILWSKANKILIADTQMKVSGLDEGLMYEYRVYAENIAGIGKCSKSCEPVPARDPCDPPGQPEVTNITRKSVSLKWSKPHYDGGAKITGYIVERRELPDGRWLKCNYTNIQETYFEVTELTEDQRYEFRVFARNAADSVSEPSESTGPIIVKDDVEPPRVMMDVKFRDVIVVKAGEVLKINADIAGRPLPVISWAKDGIEIEERARTEIISTDNHTLLTVKDCIRRDTGQYVLTLKNVAGTRSVAVNCKVLDKPGPPAGPLEINGLTAEKCSLSWGRPQEDGGADIDYYIVEKRETSHLAWTICEGELQMTSCKVTKLLKGNEYIFRVTGVNKYGVGEPLESVAIKALDPFTVPSPPTSLEITSVTKESMTLCWSRPESDGGSEISGYIIERREKNSLRWVRVNKKPVYDLRVKSTGLREGCEYEYRVYAENAAGLSLPSETSPLIRAEDPVFLPSPPSKPKIVDSGKTTITIAWVKPLFDGGAPITGYTVEYKKSDDTDWKTSIQSLRGTEYTISGLTTGAEYVFRVKSVNKVGASDPSDSSDPQIAKEREEEPLFDIDSEMRKTLIVKAGASFTMTVPFRGRPVPNVLWSKPDTDLRTRAYVDTTDSRTSLTIENANRNDSGKYTLTIQNVLSAASLTLVVKVLDTPGPPTNITVQDVTKESAVLSWDVPENDGGAPVKNYHIEKREASKKAWVSVTNNCNRLSYKVTNLQEGAIYYFRVSGENEFGVGIPAETKEGVKITEKPSPPEKLGVTSISKDSVSLTWLKPEHDGGSRIVHYVVEALEKGQKNWVKCAVAKSTHHVVSGLRENSEYFFRVFAENQAGLSDPRELLLPVLIKEQLEPPEIDMKNFPSHTVYVRAGSNLKVDIPISGKPLPKVTLSRDGVPLKATMRFNTEITAENLTINLKESVTADAGRYEITAANSSGTTKAFINIVVLDRPGPPTGPVVISDITEESVTLKWEPPKYDGGSQVTNYILLKRETSTAVWTEVSATVARTMMKVMKLTTGEEYQFRIKAENRFGISDHIDSACVTVKLPYTTPGPPSTPWVTNVTRESITVGWHEPVSNGGSAVVGYHLEMKDRNSILWQKANKLVIRTTHFKVTTISAGLIYEFRVYAENAAGVGKPSHPSEPVLAIDACEPPRNVRITDISKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDARYSIENTDSSSLLTIPQVTRNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWKMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYILERREKKSTRWVKVISKRPISETRFKVTGLTEGNEYEFHVMAENAAGVGPASGISRLIKCREPVNPPGPPTVVKVTDTSKTTVSLEWSKPVFDGGMEIIGYIIEMCKADLGDWHKVNAEACVKTRYTVTDLQAGEEYKFRVSAINGAGKGDSCEVTGTIKAVDRLTAPELDIDANFKQTHVVRAGASIRLFIAYQGRPTPTAVWSKPDSNLSLRADIHTTDSFSTLTVENCNRNDAGKYTLTVENNSGSKSITFTVKVLDTPGPPGPITFKDVTRGSATLMWDAPLLDGGARIHHYVVEKREASRRSWQVISEKCTRQIFKVNDLAEGVPYYFRVSAVNEYGVGEPYEMPEPIVATEQPAPPRRLDVVDTSKSSAVLAWLKPDHDGGSRITGYLLEMRQKGSDFWVEAGHTKQLTFTVERLVEKTEYEFRVKAKNDAGYSEPREAFSSVIIKEPQIEPTADLTGITNQLITCKAGSPFTIDVPISGRPAPKVTWKLEEMRLKETDRVSITTTKDRTTLTVKDSMRGDSGRYFLTLENTAGVKTFSVTVVVIGRPGPVTGPIEVSSVSAESCVLSWGEPKDGGGTEITNYIVEKRESGTTAWQLVNSSVKRTQIKVTHLTKYMEYSFRVSSENRFGVSKPLESAPIIAEHPFVPPSAPTRPEVYHVSANAMSIRWEEPYHDGGSKIIGYWVEKKERNTILWVKENKVPCLECNYKVTGLVEGLEYQFRTYALNAAGVSKASEASRPIMAQNPVDAPGRPEVTDVTRSTVSLIWSAPAYDGGSKVVGYIIERKPVSEVGDGRWLKCNYTIVSDNFFTVTALSEGDTYEFRVLAKNAAGVISKGSESTGPVTCRDEYAPPKAELDARLHGDLVTIRAGSDLVLDAAVGGKPEPKIIWTKGDKELDLCEKVSLQYTGKRATAVIKFCDRSDSGKYTLTVKNASGTKAVSVMVKVLDSPGPCGKLTVSRVTQEKCTLAWSLPQEDGGAEITHYIVERRETSRLNWVIVEGECPTLSYVVTRLIKNNEYIFRVRAVNKYGPGVPVESEPIVARNSFTIPSPPGIPEEVGTGKEHIIIQWTKPESDGGNEISNYLVDKREKKSLRWTRVNKDYVVYDTRLKVTSLMEGCDYQFRVTAVNAAGNSEPSEASNFISCREPSYTPGPPSAPRVVDTTKHSISLAWTKPMYDGGTDIVGYVLEMQEKDTDQWYRVHTNATIRNTEFTVPDLKMGQKYSFRVAAVNVKGMSEYSESIAEIEPVERIEIPDLELADDLKKTVTIRAGASLRLMVSVSGRPPPVITWSKQGIDLASRAIIDTTESYSLLIVDKVNRYDAGKYTIEAENQSGKKSATVLVKVYDTPGPCPSVKVKEVSRDSVTITWEIPTIDGGAPVNNYIVEKREAAMRAFKTVTTKCSKTLYRISGLVEGTMYYFRVLPENIYGIGEPCETSDAVLVSEVPLVPAKLEVVDVTKSTVTLAWEKPLYDGGSRLTGYVLEACKAGTERWMKVVTLKPTVLEHTVTSLNEGEQYLFRIRAQNEKGVSEPRETVTAVTVQDLRVLPTIDLSTMPQKTIHVPAGRPVELVIPIAGRPPPAASWFFAGSKLRESERVTVETHTKVAKLTIRETTIRDTGEYTLELKNVTGTTSETIKVIILDKPGPPTGPIKIDEIDATSITISWEPPELDGGAPLSGYVVEQRDAHRPGWLPVSESVTRSTFKFTRLTEGNEYVFRVAATNRFGIGSYLQSEVIECRSSIRIPGPPETLQIFDVSRDGMTLTWYPPEDDGGSQVTGYIVERKEVRADRWVRVNKVPVTMTRYRSTGLTEGLEYEHRVTAINARGSGKPSRPSKPIVAMDPIAPPGKPQNPRVTDTTRTSVSLAWSVPEDEGGSKVTGYLIEMQKVDQHEWTKCNTTPTKIREYTLTHLPQGAEYRFRVLACNAGGPGEPAEVPGTVKVTEMLEYPDYELDERYQEGIFVRQGGVIRLTIPIKGKPFPICKWTKEGQDISKRAMIATSETHTELVIKEADRGDSGTYDLVLENKCGKKAVYIKVRVIGSPNSPEGPLEYDDIQVRSVRVSWRPPADDGGADILGYILERREVPKAAWYTIDSRVRGTSLVVKGLKENVEYHFRVSAENQFGISKPLKSEEPVTPKTPLNPPEPPSNPPEVLDVTKSSVSLSWSRPKDDGGSRVTGYYIERKETSTDKWVRHNKTQITTTMYTVTGLVPDAEYQFRIIAQNDVGLSETSPASEPVVCKDPFDKPSQPGELEILSISKDSVTLQWEKPECDGGKEILGYWVEYRQSGDSAWKKSNKERIKDKQFTIGGLLEATEYEFRVFAENETGLSRPRRTAMSIKTKLTSGEAPGIRKEMKDVTTKLGEAAQLSCQIVGRPLPDIKWYRFGKELIQSRKYKMSSDGRTHTLTVMTEEQEDEGVYTCIATNEVGEVETSSKLLLQATPQFHPGYPLKEKYYGAVGSTLRLHVMYIGRPVPAMTWFHGQKLLQNSENITIENTEHYTHLVMKNVQRKTHAGKYKVQLSNVFGTVDAILDVEIQDKPDKPTGPIVIEALLKNSAVISWKPPADDGGSWITNYVVEKCEAKEGAEWQLVSSAISVTTCRIVNLTENAGYYFRVSAQNTFGISDPLEVSSVVIIKSPFEKPGAPGKPTITAVTKDSCVVAWKPPASDGGAKIRNYYLEKREKKQNKWISVTTEEIRETVFSVKNLIEGLEYEFRVKCENLGGESEWSEISEPITPKSDVPIQAPHFKEELRNLNVRYQSNATLVCKVTGHPKPIVKWYRQGKEIIADGLKYRIQEFKGGYHQLIIASVTDDDATVYQVRATNQGGSVSGTASLEVEVPAKIHLPKTLEGMGAVHALRGEVVSIKIPFSGKPDPVITWQKGQDLIDNNGHYQVIVTRSFTSLVFPNGVERKDAGFYVVCAKNRFGIDQKTVELDVADVPDPPRGVKVSDVSRDSVNLTWTEPASDGGSKITNYIVEKCATTAERWLRVGQARETRYTVINLFGKTSYQFRVIAENKFGLSKPSEPSEPTITKEDKTRAMNYDEEVDETREVSMTKASHSSTKELYEKYMIAEDLGRGEFGIVHRCVETSSKKTYMAKFVKVKGTDQVLVKKEISILNIARHRNILHLHESFESMEELVMIFEFISGLDIFERINTSAFELNEREIVSYVHQVCEALQFLHSHNIGHFDIRPENIIYQTRRSSTIKIIEFGQARQLKPGDNFRLLFTAPEYYAPEVHQHDVVSTATDMWSLGTLVYVLLSGINPFLAETNQQIIENIMNAEYTFDEEAFKEISIEAMDFVDRLLVKERKSRMTASEALQHPWLKQKIERVSTKVIRTLKHRRYYHTLIKKDLNMVVSAARISCGGAIRSQKGVSVAKVKVASIEIGPVSGQIMHAVGEEGGHVKYVCKIENYDQSTQVTWYFGVRQLENSEKYEITYEDGVAILYVKDITKLDDGTYRCKVVNDYGEDSSYAELFVKGVREVYDYYCRRTMKKIKRRTDTMRLLERPPEFTLPLYNKTAYVGENVRFGVTITVHPEPHVTWYKSGQKIKPGDNDKKYTFESDKGLYQLTINSVTTDDDAEYTVVARNKYGEDSCKAKLTVTLHPPPTDSTLRPMFKRLLANAECQEGQSVCFEIRVSGIPPPTLKWEKDGQPLSLGPN

SEQ ID NO: 88988 - protein, 32767 aa, Homo sapiens
  Payload ID: 17810
  Gene Name: titin
  ENSP ID: ENSP00000467141
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGAAASVSASASYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIRQETEITAASMVVVATAKSTKLETVPGAQEETTTQQDQMHLSYEKIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKSEAGVEVKKEVGVSITGTTVREERFEVLHGREAKVTETARVPAPVEIPVTPPTLVSGLKNVTVIEGESVTLECHISGYPSPTVTWYREDYQIESSIDFQITFQSGIARLMIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAPGFVYSEYEKEYEKEQALIRKKMAKDTVVVRTYVEDQEFHISSFEERLIKEIEYRIIKTTLEELLEEDGEEKMAVDISESEAVESGFDSRIKNYRILEGMGVTFHCKMSGYPLPKIAWYKDGKRIKHGERYQMDFLQDGRASLRIPVVLPEDEGIYTAFASNIKGNAICSGKLYVEPAAPLGAPTYIPTLEPVSRIRSLSPRSVSRSPIRMSPARMSPARMSPARMSPARMSPGRRLEETDESQLERLYKPVFVLKPVSFKCLEGQTARFDLKVVGRPMPETFWFHDGQQIVNDYTHKVVIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIRIEGTKGEAALKIDSTVSQDSAWYTATAINKAGRDTTRCKVNVEVEFAEPEPERKLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGIITCRATNKYGTDHTSATLIVKDEKSLVEESQLPEGRKGLQRIEELERMAHEGALTGVTTDQKEKQKPDIVLYPEPVRVLEGETARFRCRVTGYPQPKVNWYLNGQLIRKSKRFRVRYDGIHYLDIVDCKSYDTGEVKVTAENPEGVIEHKVKLEIQQREDFRSVLRRAPEPRPEFHVHEPGKLQFEVQKVDRPVDTTETKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCKLKMKPRPIAILQGLSDQKVCEGDIVQLEVKVSLESVEGVWMKDGQEVQPSDRVHIVIDKQSHMLLIEDMTKEDAGNYSFTIPALGLSTSGRVSVYSVDVITPLKDVNVIEGTKAVLECKVSVPDVTSVKWYLNDEQIKPDDRVQAIVKGTKQRLVINRTHASDEGPYKLIVGRVETNCNLSVEKIKIIRGLRDLTCTETQNVVFEVELSHSGIDVLWNFKDKEIKPSSKYKIEAHGKIYKLTVLNMMKDDEGKYTFYAGENMTSGKLTVAGGAISKPLTDQTVAESQEAVFECEVANPDSKGEWLRDGKHLPLTNNIRSESDGHKRRLIIAATKLDDIGEYTYKVATSKTSAKLKVEAVKIKKTLKNLTVTETQDAVFTVELTHPNVKGVQWIKNGVVLESNEKYAISVKGTIYSLRIKNCAIVDESVYGFRLGRLGASARLHVETVKIIKKPKDVTALENATVAFEVSVSHDTVPVKWFHKSVEIKPSDKHRLVSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAGKYTVVAGGNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEGFSKFEENTSNSQWHVSLSVSFKKEPLGQKPSFIQPLSSLRVHNGETVRFHARVSGIPKPEIQWFHNQQLILPTKDVVFHFEESTGMALMLIVDAYSEHAGQYSCKAANSAGEATCAATLTVTPKVQALDRQSSGKDVRESTKSQAVADSSFTKEESKISQKEIKSFQGSSYEYEVQVFESVSQSSIHTAASVQDTQLCHTASLSQIAESTELSKECAKESTGEAPKIFLHLQDVTVKCGDTAQFLCVLKDDSFIDVTWTHEGAKIEESERLKQSQNGNIQFLTICNVQLVDQGLYSCIVHNDCGERTTSAVLSVEGAPESILHERIEQEIEMEMKEFSSSFLSAEEEGLHSAELQLSKINETLELLSESPVYPTKFDSEKEGTGPIFIKEVSNADISMGDVATLSVTVIGIPKPKIQWFFNGVLLTPSADYKFVFDGDDHSLIILFTKLEDEGEYTCMASNDYGKTICSAYLKINSKGEGHKDTETESAVAKSLEKLGGPCPPHFLKELKPIRCAQGLPAIFEYTVVGEPAPTVTWFKENKQLCTSVYYTIIHNPNGSGTFIVNDPQREDSGLYICKAENMLGESTCAAELLVLLEDTDMTDTPCKAKSTPEAPEDFPQTPLKGPAVEALDSEQEIATFVKDTILKAALITEENQQLSYEHIAKANELSSQLPLGAQELQSILEQDKLTPESTREFLCINGSIHFQPLKEPSPNLQLQIVQSQKTFSKEGILMPEEPETQAVLSDTEKIFPSAMSIEQINSLTVEPLKTLLAEPEGNYPQSSIEPPMHSYLTSVAEEVLSPKEKTVSDTNREQRVTLQKQEAQSALILSQSLAEGHVESLQSPDVMISQVNYEPLVPSEHSCTEGGKILIESANPLENAGQDSAVRIEEGKSLRFPLALEEKQVLLKEEHSDNVVMPPDQIIESKREPVAIKKVQEVQGRDLLSKESLLSGIPEEQRLNLKIQICRALQAAVASEQPGLFSEWLRNIEKVEVEAVNITQEPRHIMCMYLVTSAKSVTEEVTIIIEDVDPQMANLKMELRDALCAIIYEEIDILTAEGPRIQQGAKTSLQEEMDSFSGSQKVEPITEPEVESKYLISTEEVSYFNVQSRVKYLDATPVTKGVASAVVSDEKQDESLKPSEEKEESSSESGTEEVATVKIQEAEGGLIKEDGPMIHTPLVDTVSEEGDIVHLTTSITNAKEVNWYFENKLVPSDEKFKCLQDQNTYTLVIDKVNTEDHQGEYVCEALNDSGKTATSAKLTVVKRAAPVIKRKIEPLEVALGHLAKFTCEIQSAPNVRFQWFKAGREIYESDKCSIRSSKYISSLEILRTQVVDCGEYTCKASNEYGSVSCTATLTVTEAYPPTFLSRPKSLTTFVGKAAKFICTVTGTPVIETIWQKDGAALSPSPNWRISDAENKHILELSNLTIQDRGVYSCKASNKFGADICQAELIIIDKPHFIKELEPVQSAINKKVHLECQVDEDRKVTVTWSKDGQKLPPGKDYKICFEDKIATLEIPLAKLKDSGTYVCTASNEAGSSSCSATVTVREPPSFVKKVDPSYLMLPGESARLHCKLKGSPVIQVTWFKNNKELSESNTVRMYFVNSEAILDITDVKVEDSGSYSCEAVNDVGSDSCSTEIVIKEPPSFIKTLEPADIVRGTNALLQCEVSGTGPFEISWFKDKKQIRSSKKYRLFSQKSLVCLEIFSFNSADVGEYECVVANEVGKCGCMATHLLKEPPTFVKKVDDLIALGGQTVTLQAAVRGSEPISVTWMKGQEVIREDGKIKMSFSNGVAVLIIPDVQISFGGKYTCLAENEAGSQTSVGELIVKEPAKIIERAELIQVTAGDPATLEYTVAGTPELKPKWYKDGRPLVASKKYRISFKNNVAQLKFYSAELHDSGQYTFEISNEVGSSSCETTFTVLDRDIAPFFTKPLRNVDSVVNGTCRLDCKIAGSLPMRVSWFKDGKEIAASDRYRIAFVEGTASLEIIRVDMNDAGNFTCRATNSVGSKDSSGALIVQEPPSFVTKPGSKDVLPGSAVCLKSTFQGSTPLTIRWFKGNKELVSGGSCYITKEALESSLELYLVKTSDSGTYTCKVSNVAGGVECSANLFVKEPATFVEKLEPSQLLKKGDATQLACKVTGTPPIKITWFANDREIKESSKHRMSFVESTAVLRLTDVGIEDSGEYMCEAQNEAGSDHCSSIVIVKESPYFTKEFKPIEVLKEYDVMLLAEVAGTPPFEITWFKDNTILRSGRKYKTFIQDHLVSLQILKFVAADAGEYQCRVTNEVGSSICSARVTLREPPSFIKKIESTSSLRGGTAAFQATLKGSLPITVTWLKDSDEITEDDNIRMTFENNVASLYLSGIEVKHDGKYVCQAKNDAGIQRCSALLSVKEPATITEEAVSIDVTQGDPATLQVKFSGTKEITAKWFKDGQELTLGSKYKISVTDTVSILKIISTEKKDSGEYTFEVQNDVGRSSCKARINVLDLIIPPSFTKKLKKMDSIKGSFIDLECIVAGSHPISIQWFKDDQEISASEKYKFSFHDNTAFLEISQLEGTDSGTYTCSATNKAGHNQCSGHLTVKEPPYFVEKPQSQDVNPNTRVQLKALVGGTAPMTIKWFKDNKELHSGAARSVWKDDTSTSLELFAAKATDSGTYICQLSNDVGTATSKATLFVKEPPQFIKKPSPVLVLRNGQSTTFECQITGTPKIRVSWYLDGNEITAIQKHGISFIDGLATFQISGARVENSGTYVCEARNDAGTASCSIELKVKEPPTFIRELKPVEVVKYSDVELECEVTGTPPFEVTWLKNNREIRSSKKYTLTDRVSVFNLHITKCDPSDTGEYQCIVSNEGGSCSCSTRVALKEPPSFIKKIENTTTVLKSSATFQSTVAGSPPISITWLKDDQILDEDDNVYISFVDSVATLQIRSVDNGHSGRYTCQAKNESGVERCYAFLLVQEPAQIVEKAKSVDVTEKDPMTLECVVAGTPELKVKWLKDGKQIVPSRYFSMSFENNVASFRIQSVMKQDSGQYTFKVENDFGSSSCDAYLRVLDQNIPPSFTKKLTKMDKVLGSSIHMECKVSGSLPISAQWFKDGKEISTSAKYRLVCHERSVSLEVNNLELEDTANYTCKVSNVAGDDACSGILTVKEPPSFLVKPGRQQAIPDSTVEFKAILKGTPPFKIKWFKDDVELVSGPKCFIGLEGSTSFLNLYSVDASKTGQYTCHVTNDVGSDSCTTMLLVTEPPKFVKKLEASKIVKAGDSSRLECKIAGSPEIRVVWFRNEHELPASDKYRMTFIDSVAVIQMNNLSTEDSGDFICEAQNPAGSTSCSTKVIVKEPPVFSSFPPIVETLKNAEVSLECELSGTPPFEVVWYKDKRQLRSSKKYKIASKNFHTSIHILNVDTSDIGEYHCKAQNEVGSDTCVCTVKLKEPPRFVSKLNSLTVVAGEPAELQASIEGAQPIFVQWLKEKEEVIRESENIRITFVENVATLQFAKAEPANAGKYICQIKNDGGMRENMATLMVLEPAVIVEKAGPMTVTVGETCTLECKVAGTPELSVEWYKDGKLLTSSQKHKFSFYNKISSLRILSVERQDAGTYTFQVQNNVGKSSCTAVVDVSDRAVPPSFTRRLKNTGGVLGASCILECKVAGSSPISVAWFHEKTKIVSGAKYQTTFSDNVCTLQLNSLDSSDMGNYTCVAANVAGSDECRAVLTVQEPPSFVKEPEPLEVLPGKNVTFTSVIRGTPPFKVNWFRGARELVKGDRCNIYFEDTVAELELFNIDISQSGEYTCVVSNNAGQASCTTRLFVKEPAAFLKRLSDHSVEPGKSIILESTYTGTLPISVTWKKDGFNITTSEKCNIVTTEKTCILEILNSTKRDAGQYSCEIENEAGRDVCGALVSTLEPPYFVTELEPLEAAVGDSVSLQCQVAGTPEITVSWYKGDTKLRPTPEYRTYFTNNVATLVFNKVNINDSGEYTCKAENSIGTASSKTVFRIQERQLPPSFARQLKDIEQTVGLPVTLTCRLNGSAPIQVCWYRDGVLLRDDENLQTSFVDNVATLKILQTDLSHSGQYSCSASNPLGTASSSARLTAREPKKSPFFDIKPVSIDVIAGESADFECHVTGAQPMRITWSKDNKEIRPGGNYTITCVGNTPHLRILKVGKGDSGQYTCQATNDVGKDMCSAQLSVKEPPKFVKKLEASKVAKQGESIQLECKISGSPEIKVSWFRNDSELHESWKYNMSFINSVALLTINEASAEDSGDYICEAHNGVGDASCSTALTVKAPPVFTQKPSPVGALKGSDVILQCEISGTPPFEVVWVKDRKQVRNSKKFKITSKHFDTSLHILNLEASDVGEYHCKATNEVGSDTCSCSVKFKEPPRFVKKLSDTSTLIGDAVELRAIVEGFQPISVVWLKDRGEVIRESENTRISFIDNIATLQLGSPEASNSGKYICQIKNDAGMRECSAVLTVLEPARIIEKPEPMTVTTGNPFALECVVTGTPELSAKWFKDGRELSADSKHHITFINKVASLKIPCAEMSDKGLYSFEVKNSVGKSNCTVSVHVSDRIVPPSFIRKLKDVNAILGASVVLECRVSGSAPISVGWFQDGNEIVSGPKCQSSFSENVCTLNLSLLEPSDTGIYTCVAANVAGSDECSAVLTVQEPPSFEQTPDSVEVLPGMSLTFTSVIRGTPPFKVKWFKGSRELVPGESCNISLEDFVTELELFEVQPLESGDYSCLVTNDAGSASCTTHLFVKEPATFVKRLADFSVETGSPIVLEATYTGTPPISVSWIKDEYLISQSERCSITMTEKSTILEILESTIEDYAQYSCLIENEAGQDICEALVSVLEPPYFIEPLEHVEAVIGEPATLQCKVDGTPEIRISWYKEHTKLRSAPAYKMQFKNNVASLVINKVDHSDVGEYSCKADNSVGAVASSAVLVIKARKLPPFFARKLKDVHETLGFPVAFECRINGSEPLQVSWYKDGVLLKDDANLQTSFVHNVATLQILQTDQSHIGQYNCSASNPLGTASSSAKLILSEHEVPPFFDLKPVSVDLALGESGTFKCHVTGTAPIKITWAKDNREIRPGGNYKMTLVENTATLTVLKVGKGDAGQYTCYASNIAGKDSCSAQLGVQEPPRFIKKLEPSRIVKQDEFTRYECKIGGSPEIKVLWYKDETEIQESSKFRMSFVDSVAVLEMHNLSVEDSGDYTCEAHNAAGSASSSTSLKVKEPPIFRKKPHPIETLKGADVHLECELQGTPPFHVSWYKDKRELRSGKKYKIMSENFLTSIHILNVDAADIGEYQCKATNDVGSDTCVGSIALKAPPRFVKKLSDISTVVGKEVQLQTTIEGAEPISVVWFKDKGEIVRESDNIWISYSENIATLQFSRVEPANAGKYTCQIKNDAGMQECFATLSVLEPATIVEKPESIKVTTGDTCTLECTVAGTPELSTKWFKDGKELTSDNKYKISFFNKVSGLKIINVAPSDSGVYSFEVQNPVGKDSCTASLQVSDRTVPPSFTRKLKETNGLSGSSVVMECKVYGSPPISVSWFHEGNEISSGRKYQTTLTDNTCALTVNMLEESDSGDYTCIATNMAGSDECSAPLTVREPPSFVQKPDPMDVLTGTNVTFTSIVKGTPPFSVSWFKGSSELVPGDRCNVSLEDSVAELELFDVDTSQSGEYTCIVSNEAGKASCTTHLYIKAPAKFVKRLNDYSIEKGKPLILEGTFTGTPPISVTWKKNGINVTPSQRCNITTTEKSAILEIPSSTVEDAGQYNCYIENASGKDSCSAQILILEPPYFVKQLEPVKVSVGDSASLQCQLAGTPEIGVSWYKGDTKLRPTTTYKMHFRNNVATLVFNQVDINDSGEYICKAENSVGEVSASTFLTVQEQKLPPSFSRQLRDVQETVGLPVVFDCAISGSEPISVSWYKDGKPLKDSPNVQTSFLDNTATLNIFKTDRSLAGQYSCTATNPIGSASSSARLILTEGKNPPFFDIRLAPVDAVVGESADFECHVTGTQPIKVSWAKDSREIRSGGKYQISYLENSAHLTVLKVDKGDSGQYTCYAVNEVGKDSCTAQLNIKERLIPPSFTKRLSETVEETEGNSFKLEGRVAGSQPITVAWYKNNIEIQPTSNCEITFKNNTLVLQVRKAGMNDAGLYTCKVSNDAGSALCTSSIVIKEPKKPPVFDQHLTPVTVSEGEYVQLSCHVQGSEPIRIQWLKAGREIKPSDRCSFSFASGTAVLELRDVAKADSGDYVCKASNVAGSDTTKSKVTIKDKPAVAPATKKAAVDGRLFFVSEPQSIRVVEKTTATFIAKVGGDPIPNVKWTKGKWRQLNQGGRVFIHQKGDEAKLEIRDTTKTDSGLYRCVAFNEHGEIESNVNLQVDERKKQEKIEGDLRAMLKKTPILKKGAGEEEEIDIMELLKNVDPKEYEKYARMYGITDFRGLLQAFELLKQSQEEETHRLEIEEIERSERDEKEFEELVSFIQQRLSQTEPVTLIKDIENQTVLKDNDAVFEIDIKINYPEIKLSWYKGTEKLEPSDKFEISIDGDRHTLRVKNCQLKDQGNYRLVCGPHIASAKLTVIEPAWERHLQDVTLKEGQTCTMTCQFSVPNVKSEWFRNGRILKPQGRHKTEVEHKVHKLTIADVRAEDQGQYTCKYEDLETSAELRIEAEPIQFTKRIQNIVVSEHQSATFECEVSFDDAIVTWYKGPTELTESQKYNFRNDGRCHYMTIHNVTPDDEGVYSVIARLEPRGEARSTAELYLTTKEIKLELKPPDIPDSRVPIPTMPIRAVPPEEIPPVVAPPIPLLLPTPEEKKPPPKRIEVTKKAVKKDAKKVVAKPKEMTPREEIVKKPPPPTTLIPAKAPEIIDVSSKAEEVKIMTITRKKEVQKEKEAVYEKKQAVHKEKRVFIESFEEPYDELEVEPYTEPFEQPYYEEPDEDYEEIKVEAKKEVHEEWEEDFEEGQEYYEREEGYDEGEEEWEEAYQEREVIQVQKEVYEESHERKVPAKVPEKKAPPPPKVIKKPVIEKIEKTSRRMEEEKVQVTKVPEVSKKIVPQKPSRTPVQEEVIEVKVPAVHTKKMVISEEKMFFASHTEEEVSVTVPEVQKEIVTEEKIHVAISKRVEPPPKVPELPEKPAPEEVAPVPIPKKVEPPAPKVPEVPKKPVPEEKKPVPVPKKEPAAPPKVPEVPKKPVPEEKIPVPVAKKKEAPPAKVPEVQKGVVTEEKITIVTQREESPPPAVPEIPKKKVPEERKPVPRKEEEVPPPPKVPALPKKPVPEEKVAVPVPVAKKAPPPRAEVSKKTVVEEKRFVAEEKLSFAVPQRVEVTRHEVSAEEEWSYSEEEEGVSISVYREEEREEEEEAEVTEYEVMEEPEEYVVEEKLHIISKRVEAEPAEVTERQEKKIVLKPKIPAKIEEPPPAKVPEAPKKIVPEKKVPAPVPKKEKVPPPKVPEEPKKPVPEKKVPPKVIKMEEPLPAKVTERHMQITQEEKVLVAVTKKEAPPKARVPEEPKRAVPEEKVLKLKPKREEEPPAKVTEFRKRVVKEEKVSIEAPKREPQPIKEVTIMEEKERAYTLEEEAVSVQREEEYEEYEEYDYKEFEEYEPTEEYDQYEEYEEREYERYEEHEEYITEPEKPIPVKPVPEEPVPTKPKAPPAKVLKKAVPEEKVPVPIPKKLKPPPPKVPEEPKKVFEEKIRISITKREKEQVTEPAAKVPMKPKRVVAEEKVPVPRKEVAPPVRVPEVPKELEPEEVAFEEEVVTHVEEYLVEEEEEYIHEEEEFITEEEVVPVIPVKVPEVPRKPVPEEKKPVPVPKKKEAPPAKVPEVPKKPEEKVPVLIPKKEKPPPAKVPEVPKKPVPEEKVPVPVPKKVEAPPAKVPEVPKKPVPEKKVPVPAPKKVEAPPAKVPEVPKKLIPEEKKPTPVPKKVEAPPPKVPKKREPVPVPVALPQEEEVLFEEEIVPEEEVLPEEEEVLPEEEEVLPEEEEVLPEEEEIPPEEEEVPPEEEYVPEEEEFVPEEEVLPEVKPKVPVPAPVPEVPKKPVPEKKVPVPAPKKVEPPPPPKVPEIKKKVTEKKVVIPKKEEAPPAKVSVVPKKPEPEKKVPPPGLKKAVAPPAKVPEVPKKVEEKRIILPKEEEVLPVEVTEEPEEEPISEEEIPEEPPSIEEVEEVAPPRVPEVIKKAVPEAPTPVPKKVEAPPAKVSKKIPEEKVPVPVQKKEAPPAKVPEVPKKVPEKKVLVPKKEAVPPAKGRTVLEEKVSVAFRQEVVVKERLELEVVEAEVEEIPEEEEFHEVEEYFEEGEFHEVEEFIKLEQHRVEEEHRVEKVHRVIEVFEAEEVEVFEKPKAPPKGPEISEKIIPPKKPPTKVVPRKEPPAKVPEVPKKIVVEEKVRVPEEPRVPPTKAPEVPKKIVPEEKVREAVLKKPEVPPAKVPGMPKKSVQEEKSPIVISEDTEMYIYEASEEAVLEEKVLVTQPQKTKPKLAKVPEPPKKVVPEDKIYVTIPKKRETPATKEPDTTRGIFPEVEPPEAIPEIPEHPPTEEFEVFKEVIPEGETPIVKRRKTPSPTVPESPREIVPVKETPMAAPLEIEIPPTKAPEAMKEVVPEMKIFEDVPEEPETPRMKTPEAPQEIIPAKTVPSKKREPPSVKVPEALQEIVPEKKTLVVPLRKPEVLPDEVPEALREVVPEKKVHPPQRAEVVPVKVHEAPKEIIPEKKVSVVPPKKPEVPPVKVPEASKEVIREEKVPLAPPKEPEVPPVKVPEPPKEVVPEKKAPVAPPKEPEVPPVKVPEAPKEVVPEKKVPVPPPKKPEVPPTKVPEVPKAAVPEKKLPEAIPPKPESPPPEVPEVLPPKEVVPEKKVPVPPAKKPEAPPPKVPEAPKEVVLEKKASVAVPKKPEAPRAKVPEAAQEVVPEKKIPKAPIKKPEAPAVTVPEVPQEATEKEIPVAPPKKPEAPIVPVPEAQEVVPEKKVPKAPPTKPEAPPATVPEVPQEIVPEKKTLVLPKKPEVPPVTVPEAPKEVVLEKKVPSAPPKKPEVPPVKVPEAPKEVVPEKKVPVPPPKKPEVPPTKVPEVPKAAVPEKKVPEAIPPKPESPPPEVPEVLPPKEVVPEKKVPVPPAKKPEAPPPKVPEAPKEVVLEKKASVAVPKKPEAPRAKVPEAAQEVVPEKKIPKAPIKKPEAPAVTVPEVPQEAAEKEIPVAPPKKPEAPIVPVPEAQEVVPEKKVPKAPPTKPEAPPATVPEVPQEIVPEKKTLVLPKKPEVPPVTVPEAPKEVVLEKKVPSTPPKKPEVPPVKVPEAPKEVVPEKKVPVPPPKKPEVPPTKVPEVPKAAVPEKKVPEAIPPKPESPPPEVPEVLPPKEVVPEKKVPVPPAKKPEAPPPKVPEAPKEVVLEKKVSVAVPKKPEAPRAKVPEAAQEVVPEKKIPKAPIKKPEAPAVTVPEVPQEAAEKEIPVAPPKKPEAPIVPVPEAQEVVPEKKVPKAPPTKPEAPPATVPEVPQEIVPEKKTLVLPKKPEVPPVTVPEAPKEVVLEKKVPLAPPKKPEVPPVKVPEAPKEVVPEKKVPVTPPKKPEVPPVKVPEAPIEVVPEKKMPLAPPKKPEVPPVKVPEAPKEVVPEKKVPSAPPKKPEVPPVKVPEAPKEVVPEKKVPAAPPKKPEVTPVKVPEAPKEVVPEKKVPVPPPKKPEVPPTKVPEVPKVAVPEKKVPEAIPPKPESPPPEVFEEPEEVALEEPPAEVVEEPEPAAPPQVTVPPKKPVPEKKAPAVVAKKPELPPVKVPEVPKEVVPEKKVPLVVPKKPEAPPAKVPEVPKEVVPEKKVAVPKKPEVPPAKVPEVPKKPVLEEKPAVPVPERAESPPPEVYEEPEEIAPEEEIAPEEEKPVPVAEEEEPEVPPPAVPEEPKKIIPEKKVPVIKKPEAPPPKEPEMPKKVVPVKKVPTVKKPETPAAKVPEVPKKLVPVKKEPVPVTKKPEVLPEKVPKVPEKIIPEKEVSVPIPAEPEVPPAEVEETPEEIIYEEKASITIGRKETPPVEEREIEKYIKPEEPEPEPQPEEIPVKEPEPEKVIEKPKLKPRPPPPPPAPPKEDVKEKIFQLKAIPKKKVPEKPQVPEKVELTPLKVPGGEKKVRKLLPERKPEPKEEVVLKSVLRKRPEEEEPKVEPKKLEKVKKPAVPEPPPPKPVEEVEVPTVTKRERKIPEPTKVPEIKPAIPLPAPEPKPKPEAEVKTIKPPPVEPEPTPIAAPVTVPVVGKKAEAKAPKEEAAKPKGPIKGVPKKTPSPIEAERRKLRPGSGGEKPPDEAPFTYQLKAVPLKFVKEIKDIILTESEFVGSSAIFECLVSPSTAITTWMKDGSNIRESPKHRFIADGKDRKLHIIDVQLSDAGEYTCVLRLGNKEKTSTAKLVVEELPVRFVKTLEEEVTVVKGQPLYLSCELNKERDVVWRKDGKIVVEKPGRIVPGVIGLMRALTINDADDTDAGTYTVTVENANNLECSSCVKVVEVIRDWLVKPIRDQHVKPKGTAIFACDIAKDTPNIKWFKGYDEIPAEPNDKTEILRDGNHLYLKIKNAMPEDIAEYAVEIEGKRYPAKLTLGEREVELLKPIEDVTIYEKESASFDAEISEADIPGQWKLKGELLRPSPTCEIKAEGGKRFLTLHKVKLDQAGEVLYQALNAITTAILTVKEIELDFAVPLKDVTVPERRQARFECVLTREANVIWSKGPDIIKSSDKFDIIADGKKHILVINDSQFDDEGVYTAEVEGKKTSARLFVTGIRLKFMSPLEDQTVKEGETATFVCELSHEKMHVVWFKNDAKLHTSRTVLISSEGKTHKLEMKEVTLDDISQIKAQVKELSSTAQLKVLEADPYFTVKLHDKTAVEKDEITLKCEVSKDVPVKWFKDGEEIVPSPKYSIKADGLRRILKIKKADLKDKGEYVCDCGTDKTKANVTVEARLIKVEKPLYGVEVFVGETAHFEIELSEPDVHGQWKLKGQPLTASPDCEIIEDGKKHILILHNCQLGMTGEVSFQAANAKSAANLKVKELPLIFITPLSDVKVFEKDEAKFECEVSREPKTFRWLKGTQEITGDDRFELIKDGTKHSMVIKSAAFEDEAKYMFEAEDKHTSGKLIIEGIRLKFLTPLKDVTAKEKESAVFTVELSHDNIRVKWFKNDQRLHTTRSVSMQDEGKTHSITFKDLSIDDTSQIRVEAMGMSSEAKLTVLEGDPYFTGKLQDYTGVEKDEVILQCEISKADAPVKWFKDGKEIKPSKNAVIKADGKKRMLILKKALKSDIGQYTCDCGTDKTSGKLDIEDREIKLVRPLHSVEVMETETARFETEISEDDIHANWKLKGEALLQTPDCEIKEEGKIHSLVLHNCRLDQTGGVDFQAANVKSSAHLRVKPRVIGLLRPLKDVTVTAGETATFDCELSYEDIPVEWYLKGKKLEPSDKVVPRSEGKVHTLTLRDVKLEDAGEVQLTAKDFKTHANLFVKEPPVEFTKPLEDQTVEEGATAVLECEVSRENAKVKWFKNGTEILKSKKYEIVADGRVRKLVIHDCTPEDIKTYTCDAKDFKTSCNLNVVPPHVEFLRPLTDLQVREKEMARFECELSRENAKVKWFKDGAEIKKGKKYDIISKGAVRILVINKCLLDDEAEYSCEVRTARTSGMLTVLEEEAVFTKNLANIEVSETDTIKLVCEVSKPGAEVIWYKGDEEIIETGRYEILTEGRKRILVIQNAHLEDAGNYNCRLPSSRTDGKVKVHELAAEFISKPQNLEILEGEKAEFVCSISKESFPVQWKRDDKTLESGDKYDVIADGKKRVLVVKDATLQDMGTYVVMVGAARAAAHLTVIEKLRIVVPLKDTRVKEQQEVVFNCEVNTEGAKAKWFRNEEAIFDSSKYIILQKDLVYTLRIRDAHLDDQANYNVSLTNHRGENVKSAANLIVEEEDLRIVEPLKDIETMEKKSVTFWCKVNRLNVTLKWTKNGEEVPFDNRVSYRVDKYKHMLTIKDCGFPDEGEYIVTAGQDKSVAELLIIEAPTEFVEHLEDQTVTEFDDAVFSCQLSREKANVKWYRNGREIKEGKKYKFEKDGSIHRLIIKDCRLDDECEYACGVEDRKSRARLFVEEIPVEIIRPPQDILEAPGADVVFLAELNKDKVEVQWLRNNMVVVQGDKHQMMSEGKIHRLQICDIKPRDQGEYRFIAKDKEARAKLELAAAPKIKTADQDLVVDVGKPLTMVVPYDAYPKAEAEWFKENEPLSTKTIDTTAEQTSFRILEAKKGDKGRYKIVLQNKHGKAEGFINLKVIDVPGPVRNLEVTETFDGEVSLAWEEPLTDGGSKIIGYVVERRDIKRKTWVLATDRAESCEFTVTGLQKGGVEYLFRVSARNRVGTGEPVETDNPVEARSKYDVPGPPLNVTITDVNRFGVSLTWEPPEYDGGAEITNYVIELRDKTSIRWDTAMTVRAEDLSATVTDVVEGQEYSFRVRAQNRIGVGKPSAATPFVKVADPIERPSPPVNLTSSDQTQSSVQLKWEPPLKDGGSPILGYIIERCEEGKDNWIRCNMKLVPELTYKVTGLEKGNKYLYRVSAENKAGVSDPSEILGPLTADDAFVEPTMDLSAFKDGLEVIVPNPITILVPSTGYPRPTATWCFGDKVLETGDRVKMKTLSAYAELVISPSERSDKGIYTLKLENRVKTISGEIDVNVIARPSAPKELKFGDITKDSVHLTWEPPDDDGGSPLTGYVVEKREVSRKTWTKVMDFVTDLEFTVPDLVQGKEYLFKVCARNKCGPGEPAYVDEPVNMSTPATVPDPPENVKWRDRTANSIFLTWDPPKNDGGSRIKGYIVERCPRGSDKWVACGEPVAETKMEVTGLEEGKWYAYRVKALNRQGASKPSRPTEEIQAVDTQEAPEIFLDVKLLAGLTVKAGTKIELPATVTGKPEPKITWTKADMILKQDKRITIENVPKKSTVTIVDSKRSDTGTYIIEAVNVCGRATAVVEVNVLDKPGPPAAFDITDVTNESCLLTWNPPRDDGGSKITNYVVERRATDSEVWHKLSSTVKDTNFKATKLIPNKEYIFRVAAENMYGVGEPVQASPITAKYQFDPPGPPTRLEPSDITKDAVTLTWCEPDDDGGSPITGYWVERLDPDTDKWVRCNKMPVKDTTYRVKGLTNKKKYRFRVLAENLAGPGKPSKSTEPILIKDPIDPPWPPGKPTVKDVGKTSVRLNWTKPEHDGGAKIESYVIEMLKTGTDEWVRVAEGVPTTQHLLPGLMEGQEYSFRVRAVNKAGESEPSEPSDPVLCREKLYPPSPPRWLEVINITKNTADLKWTVPEKDGGSPITNYIVEKRDVRRKGWQTVDTTVKDTKCTVTPLTEGSLYVFRVAAENAIGQSDYTEIEDSVLAKDTFTTPGPPYALAVVDVTKRHVDLKWEPPKNDGGRPIQRYVIEKKERLGTRWVKAGKTAGPDCNFRVTDVIEGTEVQFQVRAENEAGVGHPSEPTEILSIEDPTSPPSPPLDLHVTDAGRKHIAIAWKPPEKNGGSPIIGYHVEMCPVGTEKWMRVNSRPIKDLKFKVEEGVVPDKEYVLRVRAVNAIGVSEPSEISENVVAKDPDCKPTIDLETHDIIVIEGEKLSIPVPFRAVPVPTVSWHKDGKEVKASDRLTMKNDHISAHLEVPKSVRADAGIYTITLENKLGSATASINVKVIGLPGPCKDIKASDITKSSCKLTWEPPEFDGGTPILHYVLERREAGRRTYIPVMSGENKLSWTVKDLIPNGEYFFRVKAVNKVGGGEYIELKNPVIAQDPKQPPDPPVDVEVHNPTAEAMTITWKPPLYDGGSKIMGYIIEKIAKGEERWKRCNEHLVPILTYTAKGLEEGKEYQFRVRAENAAGISEPSRATPPTKAVDPIDAPKVILRTSLEVKRGDEIALDASISGSPYPTITWIKDENVIVPEEIKKRAAPLVRRRKGEVQEEEPFVLPLTQRLSIDNSKKGESQLRVRDSLRPDHGLYMIKVENDHGIAKAPCTVSVLDTPGPPINFVFEDIRKTSVLCKWEPPLDDGGSEIINYTLEKKDKTKPDSEWIVVTSTLRHCKYSVTKLIEGKEYLFRVRAENRFGPGPPCVSKPLVAKDPFGPPDAPDKPIVEDVTSNSMLVKWNEPKDNGSPILGYWLEKREVNSTHWSRVNKSLLNALKANVDGLLEGLTYVFRVCAENAAGPGKFSPPSDPKTAHDPISPPGPPIPRVTDTSSTTIELEWEPPAFNGGGEIVGYFVDKQLVGTNEWSRCTEKMIKVRQYTVKEIREGADYKLRVSAVNAAGEGPPGETQPVTVAEPQEPPAVELDVSVKGGIQIMAGKTLRIPAVVTGRPVPTKVWTKEEGELDKDRVVIDNVGTKSELIIKDALRKDHGRYVITATNSCGSKFAAARVEVFDVPGPVLDLKPVVTNRKMCLLNWSDPEDDGGSEITGFIIERKDAKMHTWRQPIETERSKCDITGLLEGQEYKFRVIAKNKFGCGPPVEIGPILAVDPLGPPTSPERLTYTERTKSTITLDWKEPRSNGGSPIQGYIIEKRRHDKPDFERVNKRLCPTTSFLVENLDEHQMYEFRVKAVNEIGESEPSLPLNVVIQDDEVPPTIKLRLSVRGDTIKVKAGEPVHIPADVTGLPMPKIEWSKNETVIEKPTDALQITKEEVSRSEAKTELSIPKAVREDKGTYTVTASNRLGSVFRNVHVEVYDRPSPPRNLAVTDIKAESCYLTWDAPLDNGGSEITHYVIDKRDASRKKAEWEEVTNTAVEKRYGIWKLIPNGQYEFRVRAVNKYGISDECKSDKVVIQDPYRLPGPPGKPKVLARTKGSMLVSWTPPLDNGGSPITGYWLEKREEGSPYWSRVSRAPITKVGLKGVEFNVPRLLEGVKYQFRAMAINAAGIGPPSEPSDPEVAGDPIFPPGPPSCPEVKDKTKSSISLGWKPPAKDGGSPIKGYIVEMQEEGTTDWKRVNEPDKLITTCECVVPNLKELRKYRFRVKAVNEAGESEPSDTTGEIPATDIQEEPEVFIDIGAQDCLVCKAGSQIRIPAVIKGRPTPKSSWEFDGKAKKAMKDGVHDIPEDAQLETAENSSVIIIPECKRSHTGKYSITAKNKAGQKTANCRVKVMDVPGPPKDLKVSDITRGSCRLSWKMPDDDGGDRIKGYVIEKRTIDGKAWTKVNPDCGSTTFVVPDLLSEQQYFFRVRAENRFGIGPPVETIQRTTARDPIYPPDPPIKLKIGLITKNTVHLSWKPPKNDGGSPVTHYIVECLAWDPTGTKKEAWRQCNKRDVEELQFTVEDLVEGGEYEFRVKAVNAAGVSKPSATVGPVTVKDQTCPPSIDLKEFMEVEEGTNVNIVAKIKGVPFPTLTWFKAPPKKPDNKEPVLYDTHVNKLVVDDTCTLVIPQSRRSDTGLYTITAVNNLGTASKEMRLNVLGRPGPPVGPIKFESVSADQMTLSWFPPKDDGGSKITNYVIEKREANRKTWVHVSSEPKECTYTIPKLLEGHEYVFRIMAQNKYGIGEPLDSEPETARNLFSVPGAPDKPTVSSVTRNSMTVNWEEPEYDGGSPVTGYWLEMKDTTSKRWKRVNRDPIKAMTLGVSYKVTGLIEGSDYQFRVYAINAAGVGPASLPSDPATARDPIAPPGPPFPKVTDWTKSSADLEWSPPLKDGGSKVTGYIVEYKEEGKEEWEKGKDKEVRGTKLVVTGLKEGAFYKFRVRAVNIAGIGEPGEVTDVIEMKDRLVSPDLQLDASVRDRIVVHAGGVIRIIAYVSGKPPPTVTWNMNERTLPQEATIETTAISSSMVIKNCQRSHQGVYSLLAKNEAGERKKTIIVDVLDVPGPVGTPFLAHNLTNESCKLTWFSPEDDGGSPITNYVIEKRESDRRAWTPVTYTVTRQNATVQGLIQGKAYFFRIAAENSIGMGPFVETSEALVIREPITVPERPEDLEVKEVTKNTVTLTWNPPKYDGGSEIINYVLESRLIGTEKFHKVTNDNLLSRKYTVKGLKEGDTYEYRVSAVNIVGQGKPSFCTKPITCKDELAPPTLHLDFRDKLTIRVGEAFALTGRYSGKPKPKVSWFKDEADVLEDDRTHIKTTPATLALEKIKAKRSDSGKYCVVVENSTGSRKGFCQVNVVDRPGPPVGPVSFDEVTKDYMVISWKPPLDDGGSKITNYIIEKKEVGKDVWMPVTSASAKTTCKVSKLLEGKDYIFRIHAENLYGISDPLVSDSMKAKDRFRVPDAPDQPIVTEVTKDSALVTWNKPHDGGKPITNYILEKRETMSKRWARVTKDPIHPYTKFRVPDLLEGCQYEFRVSAENEIGIGDPSPPSKPVFAKDPIAKPSPPVNPEAIDTTCNSVDLTWQPPRHDGGSKILGYIVEYQKVGDEEWRRANHTPESCPETKYKVTGLRDGQTYKFRVLAVNAAGESDPAHVPEPVLVKDRLEPPELILDANMAREQHIKVGDTLRLSAIIKGVPFPKVTWKKEDRDAPTKARIDVTPVGSKLEIRNAAHEDGGIYSLTVENPAGSKTVSVKVLVLDKPGPPRDLEVSEIRKDSCYLTWKEPLDDGGSVITNYVVERRDVASAQWSPLSATSKKKSHFAKHLNEGNQYLFRVAAENQYGRGPFVETPKPIKALDPLHPPGPPKDLHHVDVDKTEVSLVWNKPDRDGGSPITGYLVEYQEEGTQDWIKFKTVTNLECVVTGLQQGKTYRFRVKAENIVGLGLPDTTIPIECQEKLVPPSVELDVKLIEGLVVKAGTTVRFPAIIRGVPVPTAKWTTDGSEIKTDEHYTVETDNFSSVLTIKNCLRRDTGEYQITVSNAAGSKTVAVHLTVLDVPGPPTGPINILDVTPEHMTISWQPPKDDGGSPVINYIVEKQDTRKDTWGVVSSGSSKTKLKIPHLQKGCEYVFRVRAENKIGVGPPLDSTPTVAKHKFSPPSPPGKPVVTDITENAATVSWTLPKSDGGSPITGYYMERREVTGKWVRVNKTPIADLKFRVTGLYEGNTYEFRVFAENLAGLSKPSPSSDPIKACRPIKPPGPPINPKLKDKSRETADLVWTKPLSDGGSPILGYVVECQKPGTAQWNRINKDELIRQCAFRVPGLIEGNEYRFRIKAANIVGEGEPRELAESVIAKDILHPPEVELDVTCRDVITVRVGQTIRILARVKGRPEPDITWTKEGKVLVREKRVDLIQDLPRVELQIKEAVRADHGKYIISAKNSSGHAQGSAIVNVLDRPGPCQNLKVTNVTKENCTISWENPLDNGGSEITNFIVEYRKPNQKGWSIVASDVTKRLIKANLLANNEYYFRVCAENKVGVGPTIETKTPILAINPIDRPGEPENLHIADKGKTFVYLKWRRPDYDGGSPNLSYHVERRLKGSDDWERVHKGSIKETHYMVDRCVENQIYEFRVQTKNEGGESDWVKTEEVVVKEDLQKPVLDLKLSGVLTVKAGDTIRLEAGVRGKPFPEVAWTKDKDATDLTRSPRVKIDTRADSSKFSLTKAKRSDGGKYVVTATNTAGSFVAYATVNVLDKPGPVRNLKIVDVSSDRCTVCWDPPEDDGGCEIQNYILEKCETKRMVWSTYSATVLTPGTTVTRLIEGNEYIFRVRAENKIGTGPPTESKPVIAKTKYDKPGRPDPPEVTKVSKEEMTVVWNPPEYDGGKSITGYFLEKKEKHSTRWVPVNKSAIPERRMKVQNLLPDHEYQFRVKAENEIGIGEPSLPSRPVVAKDPIEPPGPPTNFRVVDTTKHSITLGWGKPVYDGGAPIIGYVVEMRPKIADASPDEGWKRCNAAAQLVRKEFTVTSLDENQEYEFRVCAQNQVGIGRPAELKEAIKPKEILEPPEIDLDASMRKLVIVRAGCPIRLFAIVRGRPAPKVTWRKVGIDNVVRKGQVDLVDTMAFLVIPNSTRDDSGKYSLTLVNPAGEKAVFVNVRVLDTPGPVSDLKVSDVTKTSCHVSWAPPENDGGSQVTHYIVEKREADRKTWSTVTPEVKKTSFHVTNLVPGNEYYFRVTAVNEYGPGVPTDVPKPVLASDPLSEPDPPRKLEVTEMTKNSATLAWLPPLRDGGAKIDGYITSYREEEQPADRWTEYSVVKDLSLVVTGLKEGKKYKFRVAARNAVGVSLPREAEGVYEAKEQLLPPKILMPEQITIKAGKKLRIEAHVYGKPHPTCKWKKGEDEVVTSSHLAVHKADSSSILIIKDVTRKDSGYYSLTAENSSGTDTQKIKVVVMDAPGPPQPPFDISDIDADACSLSWHIPLEDGGSNITNYIVEKCDVSRGDWVTALASVTKTSCRVGKLIPGQEYIFRVRAENRFGISEPLTSPKMVAQFPFGVPSEPKNARVTKVNKDCIFVAWDRPDSDGGSPIIGYLIERKERNSLLWVKANDTLVRSTEYPCAGLVEGLEYSFRIYALNKAGSSPPSKPTEYVTARMPVDPPGKPEVIDVTKSTVSLIWARPKHDGGSKIIGYFVEACKLPGDKWVRCNTAPHQIPQEEYTATGLEEKAQYQFRAIARTAVNISPPSEPSDPVTILAENVPPRIDLSVAMKSLLTVKAGTNVCLDATVFGKPMPTVSWKKDGTLLKPAEGIKMAMQRNLCTLELFSVNRKDSGDYTITAENSSGSKSATIKLKVLDKPGPPASVKINKMYSDRAMLSWEPPLEDGGSEITNYIVDKRETSRPNWAQVSATVPITSCSVEKLIEGHEYQFRICAENKYGVGDPVFTEPAIAKNPYDPPGRCDPPVISNITKDHMTVSWKPPADDGGSPITGYLLEKRETQAVNWTKVNRKPIIERTLKATGLQEGTEYEFRVTAINKAGPGKPSDASKAAYARDPQYPPGPPAFPKVYDTTRSSVSLSWGKPAYDGGSPIIGYLVEVKRADSDNWVRCNLPQNLQKTRFEVTGLMEDTQYQFRVYAVNKIGYSDPSDVPDKHYPKDILIPPEGELDADLRKTLILRAGVTMRLYVPVKGRPPPKITWSKPNVNLRDRIGLDIKSTDFDTFLRCENVNKYDAGKYILTLENSCGKKEYTIVVKVLDTPGPPVNVTVKEISKDSAYVTWEPPIIDGGSPIINYVVQKRDAERKSWSTVTTECSKTSFRVANLEEGKSYFFRVFAENEYGIGDPGETRDAVKASQTPGPVVDLKVRSVSKSSCSIGWKKPHSDGGSRIIGYVVDFLTEENKWQRVMKSLSLQYSAKDLTEGKEYTFRVSAENENGEGTPSEITVVARDDVVAPDLDLKGLPDLCYLAKENSNFRLKIPIKGKPAPSVSWKKGEDPLATDTRVSVESSAVNTTLIVYDCQKSDAGKYTITLKNVAGTKEGTISIKVVGKPGIPTGPIKFDEVTAEAMTLKWAPPKDDGGSEITNYILEKRDSVNNKWVTCASAVQKTTFRVTRLHEGMEYTFRVSAENKYGVGEGLKSEPIVARHPFDVPDAPPPPNIVDVRHDSVSLTWTDPKKTGGSPITGYHLEFKERNSLLWKRANKTPIRMRDFKVTGLTEGLEYEFRVMAINLAGVGKPSLPSEPVVALDPIDPPGKPEVINITRNSVTLIWTEPKYDGGHKLTGYIVEKRDLPSKSWMKANHVNVPECAFTVTDLVEGGKYEFRIRAKNTAGAISAPSESTETIICKDEYEAPTIVLDPTIKDGLTIKAGDTIVLNAISILGKPLPKSSWSKAGKDIRPSDITQITSTPTSSMLTIKYATRKDAGEYTITATNPFGTKVEHVKVTVLDVPGPPGPVEISNVSAEKATLTWTPPLEDGGSPIKSYILEKRETSRLLWTVVSEDIQSCRHVATKLIQGNEYIFRVSAVNHYGKGEPVQSEPVKMVDRFGPPGPPEKPEVSNVTKNTATVSWKRPVDDGGSEITGYHVERREKKSLRWVRAIKTPVSDLRCKVTGLQEGSTYEFRVSAENRAGIGPPSEASDSVLMKDAAYPPGPPSNPHVTDTTKKSASLAWGKPHYDGGLEITGYVVEHQKVGDEAWIKDTTGTALRITQFVVPDLQTKEKYNFRISAINDAGVGEPAVIPDVEIVEREMAPDFELDAELRRTLVVRAGLSIRIFVPIKGRPAPEVTWTKDNINLKNRANIENTESFTLLIIPECNRYDTGKFVMTIENPAGKKSGFVNVRVLDTPGPVLNLRPTDITKDSVTLHWDLPLIDGGSRITNYIVEKREATRKSYSTATTKCHKCTYKVTGLSEGCEYFFRVMAENEYGIGEPTETTEPVKASEAPSPPDSLNIMDITKSTVSLAWPKPKHDGGSKITGYVIEAQRKGSDQWTHITTVKGLECVVRNLTEGEEYTFQVMAVNSAGRSAPRESRPVIVKEQTMLPELDLRGIYQKLVIAKAGDNIKVEIPVLGRPKPTVTWKKGDQILKQTQRVNFETTATSTILNINECVRSDSGPYPLTARNIVGEVGDVITIQVHDIPGPPTGPIKFDEVSSDFVTFSWDPPENDGGVPISNYVVEMRQTDSTTWVELATTVIRTTYKATRLTTGLEYQFRVKAQNRYGVGPGITSACIVANYPFKVPGPPGTPQVTAVTKDSMTISWHEPLSDGGSPILGYHVERKERNGILWQTVSKALVPGNIFKSSGLTDGIAYEFRVIAENMAGKSKPSKPSEPMLALDPIDPPGKPVPLNITRHTVTLKWAKPEYTGGFKITSYIVEKRDLPNGRWLKANFSNILENEFTVSGLTEDAAYEFRVIAKNAAGAISPPSEPSDAITCRDDVEAPKIKVDVKFKDTVILKAGEAFRLEADVSGRPPPTMEWSKDGKELEGTAKLEIKIADFSTNLVNKDSTRRDSGAYTLTATNPGGFAKHIFNVKVLDRPGPPEGPLAVTEVTSEKCVLSWFPPLDDGGAKIDHYIVQKRETSRLAWTNVASEVQVTKLKVTKLLKGNEYIFRVMAVNKYGVGEPLESEPVLAVNPYGPPDPPKNPEVTTITKDSMVVCWGHPDSDGGSEIINYIVERRDKAGQRWIKCNKKTLTDLRYKVSGLTEGHEYEFRIMAENAAGISAPSPTSPFYKACDTVFKPGPPGNPRVLDTSRSSISIAWNKPIYDGGSEITGYMVEIALPEEDEWQIVTPPAGLKATSYTITGLTENQEYKIRIYAMNSEGLGEPALVPGTPKAEDRMLPPEIELDADLRKVVTIRACCTLRLFVPIKGRPAPEVKWARDHGESLDKASIESTSSYTLLIVGNVNRFDSGKYILTVENSSGSKSAFVNVRVLDTPGPPQDLKVKEVTKTSVTLTWDPPLLDGGSKIKNYIVEKRESTRKAYSTVATNCHKTSWKVDQLQEGCSYYFRVLAENEYGIGLPAETAESVKASERPLPPGKITLMDVTRNSVSLSWEKPEHDGGSRILGYIVEMQTKGSDKWATCATVKVTEATITGLIQGEEYSFRVSAQNEKGISDPRQLSVPVIAKDLVIPPAFKLLFNTFTVLAGEDLKVDVPFIGRPTPAVTWHKDNVPLKQTTRVNAESTENNSLLTIKDACREDVGHYVVKLTNSAGEAIETLNVIVLDKPGPPTGPVKMDEVTADSITLSWGPPKYDGGSSINNYIVEKRDTSTTTWQIVSATVARTTIKACRLKTGCEYQFRIAAENRYGKSTYLNSEPTVAQYPFKVPGPPGTPVVTLSSRDSMEVQWNEPISDGGSRVIGYHLERKERNSILWVKLNKTPIPQTKFKTTGLEEGVEYEFRVSAENIVGIGKPSKVSECYVARDPCDPPGRPEAIIVTRNSVTLQWKKPTYDGGSKITGYIVEKKELPEGRWMKASFTNIIDTHFEVTGLVEDHRYEFRVIARNAAGVFSEPSESTGAITARDEVDPPRISMDPKYKDTIVVHAGESFKVDADIYGKPIPTIQWIKGDQELSNTARLEIKSTDFATSLSVKDAVRVDSGNYILKAKNVAGERSVTVNVKVLDRPGPPEGPVVISGVTAEKCTLAWKPPLQDGGSDIINYIVERRETSRLVWTVVDANVQTLSCKVTKLLEGNEYTFRIMAVNKYGVGEPLESEPVVAKNPFVVPDAPKAPEVTTVTKDSMIVVWERPASDGGSEILGYVLEKRDKEGIRWTRCHKRLIGELRLRVTGLIENHDYEFRVSAENAAGLSEPSPPSAYQKACDPIYKPGPPNNPKVIDITRSSVFLSWSKPIYDGGCEIQGYIVEKCDVSVGEWTMCTPPTGINKTNIEVEKLLEKHEYNFRICAINKAGVGEHADVPGPIIVEEKLEAPDIDLDLELRKIINIRAGGSLRLFVPIKGRPTPEVKWGKVDGEIRDAAIIDVTSSFTSLVLDNVNRYDSGKYTLTLENSSGTKSAFVTVRVLDTPSPPVNLKVTEITKDSVSITWEPPLLDGGSKIKNYIVEKREATRKSYAAVVTNCHKNSWKIDQLQEGCSYYFRVTAENEYGIGLPAQTADPIKVAEVPQPPGKITVDDVTRNSVSLSWTKPEHDGGSKIIQYIVEMQAKHSEKWSECARVKSLQAVITNLTQGEEYLFRVVAVNEKGRSDPRSLAVPIVAKDLVIEPDVKPAFSSYSVQVGQDLKIEVPISGRPKPTITWTKDGLPLKQTTRINVTDSLDLTTLSIKETHKDDGGQYGITVANVVGQKTASIEIVTLDKPDPPKGPVKFDDVSAESITLSWNPPLYTGGCQITNYIVQKRDTTTTVWDVVSATVARTTLKVTKLKTGTEYQFRIFAENRYGQSFALESDPIVAQYPYKEPGPPGTPFATAISKDSMVIQWHEPVNNGGSPVIGYHLERKERNSILWTKVNKTIIHDTQFKAQNLEEGIEYEFRVYAENIVGVGKASKNSECYVARDPCDPPGTPEPIMVKRNEITLQWTKPVYDGGSMITGYIVEKRDLPDGRWMKASFTNVIETQFTVSGLTEDQRYEFRVIAKNAAGAISKPSDSTGPITAKDEVELPRISMDPKFRDTIVVNAGETFRLEADVHGKPLPTIEWLRGDKEIEESARCEIKNTDFKALLIVKDAIRIDGGQYILRASNVAGSKSFPVNVKVLDRPGPPEGPVQVTGVTSEKCSLTWSPPLQDGGSDISHYVVEKRETSRLAWTVVASEVVTNSLKVTKLLEGNEYVFRIMAVNKYGVGEPLESAPVLMKNPFVLPGPPKSLEVTNIAKDSMTVCWNRPDSDGGSEIIGYIVEKRDRSGIRWIKCNKRRITDLRLRVTGLTEDHEYEFRVSAENAAGVGEPSPATVYYKACDPVFKPGPPTNAHIVDTTKNSITLAWGKPIYDGGSEILGYVVEICKADEEEWQIVTPQTGLRVTRFEISKLTEHQEYKIRVCALNKVGLGEATSVPGTVKPEDKLEAPELDLDSELRKGIVVRAGGSARIHIPFKGRPTPEITWSREEGEFTDKVQIEKGVNYTQLSIDNCDRNDAGKYILKLENSSGSKSAFVTVKVLDTPGPPQNLAVKEVRKDSAFLVWEPPIIDGGAKVKNYVIDKRESTRKAYANVSSKCSKTSFKVENLTEGAIYYFRVMAENEFGVGVPVETVDAVKAAEPPSPPGKVTLTDVSQTSASLMWEKPEHDGGSRVLGYVVEMQPKGTEKWSIVAESKVCNAVVTGLSSGQEYQFRVKAYNEKGKSDPRVLGVPVIAKDLTIQPSLKLPFNTYSIQAGEDLKIEIPVIGRPRPNISWVKDGEPLKQTTRVNVEETATSTVLHIKEGNKDDFGKYTVTATNSAGTATENLSVIVLEKPGPPVGPVRFDEVSADFVVISWEPPAYTGGCQISNYIVEKRDTTTTTWHMVSATVARTTIKITKLKTGTEYQFRIFAENRYGKSAPLDSKAVIVQYPFKEPGPPGTPFVTSISKDQMLVQWHEPVNDGGTKIIGYHLEQKEKNSILWVKLNKTPIQDTKFKTTGLDEGLEYEFKVSAENIVGIGKPSKVSECFVARDPCDPPGRPEAIVITRNNVTLKWKKPAYDGGSKITGYIVEKKDLPDGRWMKASFTNVLETEFTVSGLVEDQRYEFRVIARNAAGNFSEPSDSSGAITARDEIDAPNASLDPKYKDVIVVHAGETFVLEADIRGKPIPDVVWSKDGKELEETAARMEIKSTIQKTTLVVKDCIRTDGGQYILKLSNVGGTKSIPITVKVLDRPGPPEGPLKVTGVTAEKCYLAWNPPLQDGGANISHYIIEKRETSRLSWTQVSTEVQALNYKVTKLLPGNEYIFRVMAVNKYGIGEPLESGPVTACNPYKPPGPPSTPEVSAITKDSMVVTWARPVDDGGTEIEGYILEKRDKEGVRWTKCNKKTLTDLRLRVTGLTEGHSYEFRVAAENAAGVGEPSEPSVFYRACDALYPPGPPSNPKVTDTSRSSVSLAWSKPIYDGGAPVKGYVVEVKEAAADEWTTCTPPTGLQGKQFTVTKLKENTEYNFRICAINSEGVGEPATLPGSVVAQERIEPPEIELDADLRKVVVLRASATLRLFVTIKGRPEPEVKWEKAEGILTDRAQIEVTSSFTMLVIDNVTRFDSGRYNLTLENNSGSKTAFVNVRVLDSPSAPVNLTIREVKKDSVTLSWEPPLIDGGAKITNYIVEKRETTRKAYATITNNCTKTTFRIENLQEGCSYYFRVLASNEYGIGLPAETTEPVKVSEPPLPPGRVTLVDVTRNTATIKWEKPESDGGSKITGYVVEMQTKGSEKWSTCTQVKTLEATISGLTAGEEYVFRVAAVNEKGRSDPRQLGVPVIARDIEIKPSVELPFHTFNVKAREQLKIDVPFKGRPQATVNWRKDGQTLKETTRVNVSSSKTVTSLSIKEASKEDVGTYELCVSNSAGSITVPITIIVLDRPGPPGPIRIDEVSCDSITISWNPPEYDGGCQISNYIVEKKETTSTTWHIVSQAVARTSIKIVRLTTGSEYQFRVCAENRYGKSSYSESSAVVAEYPFSPPGPPGTPKVVHATKSTMLVTWQVPVNDGGSRVIGYHLEYKERSSILWSKANKILIADTQMKVSGLDEGLMYEYRVYAENIAGIGKCSKSCEPVPARDPCDPPGQPEVTNITRKSVSLKWSKPHYDGGAKITGYIVERRELPDGRWLKCNYTNIQETYFEVTELTEDQRYEFRVFARNAADSVSEPSESTGPIIVKDDVEPPRVMMDVKFRDVIVVKAGEVLKINADIAGRPLPVISWAKDGIEIEERARTEIISTDNHTLLTVKDCIRRDTGQYVLTLKNVAGTRSVAVNCKVLDKPGPPAGPLEINGLTAEKCSLSWGRPQEDGGADIDYYIVEKRETSHLAWTICEGELQMTSCKVTKLLKGNEYIFRVTGVNKYGVGEPLESVAIKALDPFTVPSPPTSLEITSVTKESMTLCWSRPESDGGSEISGYIIERREKNSLRWVRVNKKPVYDLRVKSTGLREGCEYEYRVYAENAAGLSLPSETSPLIRAEDPVFLPSPPSKPKIVDSGKTTITIAWVKPLFDGGAPITGYTVEYKKSDDTDWKTSIQSLRGTEYTISGLTTGAEYVFRVKSVNKVGASDPSDSSDPQIAKEREEEPLFDIDSEMRKTLIVKAGASFTMTVPFRGRPVPNVLWSKPDTDLRTRAYVDTTDSRTSLTIENANRNDSGKYTLTIQNVLSAASLTLVVKVLDTPGPPTNITVQDVTKESAVLSWDVPENDGGAPVKNYHIEKREASKKAWVSVTNNCNRLSYKVTNLQEGAIYYFRVSGENEFGVGIPAETKEGVKITEKPSPPEKLGVTSISKDSVSLTWLKPEHDGGSRIVHYVVEALEKGQKNWVKCAVAKSTHHVVSGLRENSEYFFRVFAENQAGLSDPRELLLPVLIKEQLEPPEIDMKNFPSHTVYVRAGSNLKVDIPISGKPLPKVTLSRDGVPLKATMRFNTEITAENLTINLKESVTADAGRYEITAANSSGTTKAFINIVVLDRPGPPTGPVVISDITEESVTLKWEPPKYDGGSQVTNYILLKRETSTAVWTEVSATVARTMMKVMKLTTGEEYQFRIKAENRFGISDHIDSACVTVKLPYTTPGPPSTPWVTNVTRESITVGWHEPVSNGGSAVVGYHLEMKDRNSILWQKANKLVIRTTHFKVTTISAGLIYEFRVYAENAAGVGKPSHPSEPVLAIDACEPPRNVRITDISKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDARYSIENTDSSSLLTIPQVTRNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWKMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYILERREKKSTRWVKVISKRPISETRFKVTGLTEGNEYEFHVMAENAAGVGPASGISRLIKCREPVNPPGPPTVVKVTDTSKTTVSLEWSKPVFDGGMEIIGYIIEMCKADLGDWHKVNAEACVKTRYTVTDLQAGEEYKFRVSAINGAGKGDSCEVTGTIKAVDRLTAPELDIDANFKQTHVVRAGASIRLFIAYQGRPTPTAVWSKPDSNLSLRADIHTTDSFSTLTVENCNRNDAGKYTLTVENNSGSKSITFTVKVLDTPGPPGPITFKDVTRGSATLMWDAPLLDGGARIHHYVVEKREASRRSWQVISEKCTRQIFKVNDLAEGVPYYFRVSAVNEYGVGEPYEMPEPIVATEQPAPPRRLDVVDTSKSSAVLAWLKPDHDGGSRITGYLLEMRQKGSDFWVEAGHTKQLTFTVERLVEKTEYEFRVKAKNDAGYSEPREAFSSVIIKEPQIEPTADLTGITNQLITCKAGSPFTIDVPISGRPAPKVTWKLEEMRLKETDRVSITTTKDRTTLTVKDSMRGDSGRYFLTLENTAGVKTFSVTVVVIGRPGPVTGPIEVSSVSAESCVLSWGEPKDGGGTEITNYIVEKRESGTTAWQLVNSSVKRTQIKVTHLTKYMEYSFRVSSENRFGVSKPLESAPIIAEHPFVPPSAPTRPEVYHVSANAMSIRWEEPYHDGGSKIIGYWVEKKERNTILWVKENKVPCLECNYKVTGLVEGLEYQFRTYALNAAGVSKASEASRPIMAQNPVDAPGRPEVTDVTRSTVSLIWSAPAYDGGSKVVGYIIERKPVSEVGDGRWLKCNYTIVSDNFFTVTALSEGDTYEFRVLAKNAAGVISKGSESTGPVTCRDEYAPPKAELDARLHGDLVTIRAGSDLVLDAAVGGKPEPKIIWTKGDKELDLCEKVSLQYTGKRATAVIKFCDRSDSGKYTLTVKNASGTKAVSVMVKVLDSPGPCGKLTVSRVTQEKCTLAWSLPQEDGGAEITHYIVERRETSRLNWVIVEGECPTLSYVVTRLIKNNEYIFRVRAVNKYGPGVPVESEPIVARNSFTIPSPPGIPEEVGTGKEHIIIQWTKPESDGGNEISNYLVDKREKKSLRWTRVNKDYVVYDTRLKVTSLMEGCDYQFRVTAVNAAGNSEPSEASNFISCREPSYTPGPPSAPRVVDTTKHSISLAWTKPMYDGGTDIVGYVLEMQEKDTDQWYRVHTNATIRNTEFTVPDLKMGQKYSFRVAAVNVKGMSEYSESIAEIEPVERIEIPDLELADDLKKTVTIRAGASLRLMVSVSGRPPPVITWSKQGIDLASRAIIDTTESYSLLIVDKVNRYDAGKYTIEAENQSGKKSATVLVKVYDTPGPCPSVKVKEVSRDSVTITWEIPTIDGGAPVNNYIVEKREAAMRAFKTVTTKCSKTLYRISGLVEGTMYYFRVLPENIYGIGEPCETSDAVLVSEVPLVPAKLEVVDVTKSTVTLAWEKPLYDGGSRLTGYVLEACKAGTERWMKVVTLKPTVLEHTVTSLNEGEQYLFRIRAQNEKGVSEPRETVTAVTVQDLRVLPTIDLSTMPQKTIHVPAGRPVELVIPIAGRPPPAASWFFAGSKLRESERVTVETHTKVAKLTIRETTIRDTGEYTLELKNVTGTTSETIKVIILDKPGPPTGPIKIDEIDATSITISWEPPELDGGAPLSGYVVEQRDAHRPGWLPVSESVTRSTFKFTRLTEGNEYVFRVAATNRFGIGSYLQSEVIECRSSIRIPGPPETLQIFDVSRDGMTLTWYPPEDDGGSQVTGYIVERKEVRADRWVRVNKVPVTMTRYRSTGLTEGLEYEHRVTAINARGSGKPSRPSKPIVAMDPIAPPGKPQNPRVTDTTRTSVSLAWSVPEDEGGSKVTGYLIEMQKVDQHEWTKCNTTPTKIREYTLTHLPQGAEYRFRVLACNAGGPGEPAEVPGTVKVTEMLEYPDYELDERYQEGIFVRQGGVIRLTIPIKGKPFPICKWTKEGQDISKRAMIATSETHTELVIKEADR

SEQ ID NO: 88989 - protein, 32767 aa, Homo sapiens; identical to SEQ ID NO: 88987
  Payload ID: 17810
  Gene Name: titin
  Uniprot ID: Q8WZ42
  ENSP ID: ENSP00000483597

SEQ ID NO: 88990 - protein, 354 aa, Homo sapiens
  Payload ID: 17810
  Gene Name: titin
  ENSP ID: ENSP00000489532
  MOD_RES (1)..(1): Any amino acid
XSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEAKESQARALTKITLGSDTKSIKTLRESQIKTTREVKRESSKKTSSLSLTSCQKP

SEQ ID NO: 88991 - protein, 167 aa, Homo sapiens
  Payload ID: 17811
  Gene Name: titin-cap
  Uniprot ID: O15273
  ENSP ID: ENSP00000312624
MATSELSCEVSEENCERREAFWAEWKDLTLSTRPEEGCSLHEEDTQRHETYHQQGQCQVLVQRSPWLMMRMGILGRGLQEYQLPYQRVLPLPIFTPAKMGATKEEREDTPIQLQELLALETALGGQCVDRQEVAEITKQLPPVVPVSKPGALRRSLSRSMSQEAQRG

SEQ ID NO: 88992 - protein, 143 aa, Homo sapiens
  Payload ID: 17811
  Gene Name: titin-cap
  ENSP ID: ENSP00000462787
MATSELSCEVSEENCERREAFWAEWKDLTLSTRPEEGCSLHEEDTQRHETYHQQGQCQLPYQRVLPLPIFTPAKMGATKEEREDTPIQLQELLALETALGGQCVDRQEVAEITKQLPPVVPVSKPGALRRSLSRSMSQEAQRG

SEQ ID NO: 88993 - protein, 247 aa, Homo sapiens
  Payload ID: 17812
  Gene Name: TLC domain containing 1
  Uniprot ID: Q96CP7
  ENSP ID: ENSP00000292090
MPRLLHPALPLLLGATLTFRALRRALCRLPLPVHVRADPLRTWRWHNLLVSFAHSIVSGIWALLCVWQTPDMLVEIETAWSLSGYLLVCFSAGYFIHDTVDIVASGQTRASWEYLVHHVMAMGAFFSGIFWSSFVGGGVLTLLVEVSNIFLTIRMMMKISNAQDHLLYRVNKYVNLVMYFLFRLAPQAYLTHFFLRYVNQRTLGTFLLGILLMLDVMIIIYFSRLLRSDFCPEHVPKKQHKDKFLTE

SEQ ID NO: 88994 - protein, 200 aa, Homo sapiens
  Payload ID: 17812
  Gene Name: TLC domain containing 1
  Uniprot ID: Q96CP7
  ENSP ID: ENSP00000378391
MGYSAVPKCPPRGRGRDSVWQTPDMLVEIETAWSLSGYLLVCFSAGYFIHDTVDIVASGQTRASWEYLVHHVMAMGAFFSGIFWSSFVGGGVLTLLVEVSNIFLTIRMMMKISNAQDHLLYRVNKYVNLVMYFLFRLAPQAYLTHFFLRYVNQRTLGTFLLGILLMLDVMIIIYFSRLLRSDFCPEHVPKKQHKDKFLTE

SEQ ID NO: 88995 - protein, 147 aa, Homo sapiens
  Payload ID: 17812
  Gene Name: TLC domain containing 1
  ENSP ID: ENSP00000466264
MLVEIETAWSLSGYLLVCFSAGYFIHDTVDIVASGQTRASWEYLVHHVMAMGAFFSGIFWSSFVGGGVLTLLVEVSNIFLTIRMMMKISNAQDHLLYRVNKYVNLVMYFLFRLAPQAYLTHFFLRYVNQRTLGTFLLGILLMLDVMI

SEQ ID NO: 88996 - protein, 53 aa, Homo sapiens
  Payload ID: 17812
  Gene Name: TLC domain containing 1
  ENSP ID: ENSP00000468670
  MOD_RES (1)..(1): Any amino acid
XGGGVLTLLVEVSNIFLTIRMMMKISNAQDHLLYRVNKGPWAPSCWVSCSCWT

SEQ ID NO: 88997 - protein, 264 aa, Homo sapiens
  Payload ID: 17813
  Gene Name: TLC domain containing 2
  Uniprot ID: A6NGC4
  ENSP ID: ENSP00000331965
MAPTGLLVAGASFLAFRGLHWGLRRLPTPESAARDRWQWWNLCVSLAHSLLSGTGALLGLSLYPQMAADPIHGHPRWALVLVAVSVGYFLADGADLLWNQTLGKTWDLLCHHLVVVSCLSTAVLSGHYVGFSMVSLLLELNSACLHLRKLLLLSRQAPSLAFSVTSWASLATLALFRLVPLGWMSLWLFRQHHQVPLALVTLGGIGLVTVGIMSIILGIRILVNDVLQSRPHPPSPGHEKTRGTRTRRDNGPVTSNSSTLSLKD

SEQ ID NO: 88998 - protein, 264 aa, Homo sapiens; identical to SEQ ID NO: 88997
  Payload ID: 17813
  Gene Name: TLC domain containing 2
  Uniprot ID: A6NGC4
  ENSP ID: ENSP00000479301

SEQ ID NO: 88999 - protein, 811 aa, Homo sapiens
  Payload ID: 17814
  Gene Name: TLR4 interactor with leucine-rich repeats
  Uniprot ID: Q7L0X0
  ENSP ID: ENSP00000479256
MEAARALRLLLVVCGCLALPPLAEPVCPERCDCQHPQHLLCTNRGLRVVPKTSSLPSPHDVLTYSLGGNFITNITAFDFHRLGQLRRLDLQYNQIRSLHPKTFEKLSRLEELYLGNNLLQALAPGTLAPLRKLRILYANGNEISRLSRGSFEGLESLVKLRLDGNALGALPDAVFAPLGNLLYLHLESNRIRFLGKNAFAQLGKLRFLNLSANELQPSLRHAATFAPLRSLSSLILSANNLQHLGPRIFQHLPRLGLLSLRGNQLTHLAPEAFWGLEALRELRLEGNRLSQLPTALLEPLHSLEALDLSGNELSALHPATFGHLGRLRELSLRNNALSALSGDIFAASPALYRLDLDGNGWTCDCRLRGLKRWMGDWHSQGRLLTVFVQCRHPPALRGKYLDYLDDQQLQNGSCADPSPSASLTADRRRQPLPTAAGEEMTPPAGLAEELPPQPQLQQQGRFLAGVAWDGAARELVGNRSALRLSRRGPGLQQPSPSVAAAAGPAPQSLDLHKKPQRGRPTRADPALAEPTPTASPGSAPSPAGDPWQRATKHRLGTEHQERAAQSDGGAGLPPLVSDPCDFNKFILCNLTVEAVGADSASVRWAVREHRSPRPLGGARFRLLFDRFGQQPKFHRFVYLPESSDSATLRELRGDTPYLVCVEGVLGGRVCPVAPRDHCAGLVTLPEAGSRGGVDYQLLTLALLTVNALLVLLALAAWASRWLRRKLRARRKGGAPVHVRHMYSTRRPLRSMGTGVSADFSGFQSHRPRTTVCALSEADLIEFPCDRFMDSAGGGAGGSLRREDRLLQRFAD

SEQ ID NO: 89000 - protein, 207 aa, Homo sapiens
  Payload ID: 17815
  Gene Name: TM2 domain containing 1
  Uniprot ID: Q9BX74
  ENSP ID: ENSP00000294613
MAAAWPSGPSAPEAVTARLVGVLWFVSVTTGPWGAVATSAGGEESLKCEDLKVGQYICKDPKINDATQEPVNCTNYTAHVSCFPAPNITCKDSSGNETHFTGNEVGFFKPISCRNVNGYSYKVAVALSLFLGWLGADRFYLGYPALGLLKFCTVGFCGIGSLIDFILISMQIVGPSDGSSYIIDYYGTRLTRLSITNETFRKTQLYP

SEQ ID NO: 89001 - protein, 269 aa, Homo sapiens
  Payload ID: 17815
  Gene Name: TM2 domain containing 1
  ENSP ID: ENSP00000360222
MHILKGSPNVIPRAHGQKNTRRDGTGLYPMRGPFKNLALLPFSLPLLGGGGSGSGEKVSVSKMAAAWPSGPSAPEAVTARLVGVLWFVSVTTGPWGAVATSAGGEESLKCEDLKVGQYICKDPKINDATQEPVNCTNYTAHVSCFPAPNITCKDSSGNETHFTGNEVGFFKPISCRNVNGYSYKVAVALSLFLGWLGADRFYLGYPALGLLKFCTVGFCGIGSLIDFILISMQIVGPSDGSSYIIDYYGTRLTRLSITNETFRKTQLYP

SEQ ID NO: 89002 - protein, 53 aa, Homo sapiens
  Payload ID: 17815
  Gene Name: TM2 domain containing 1
  ENSP ID: ENSP00000475186
  MOD_RES (1)..(1): Any amino acid
XLVGVLWFVSVTTGPWGAVATSAGGEESLKCEDLKVGQYPLWRTPPHGGEIQK

SEQ ID NO: 89003 - protein, 186 aa, Homo sapiens
  Payload ID: 17815
  Gene Name: TM2 domain containing 1
  ENSP ID: ENSP00000475297
MAAAWPSGPSAPEAVTARLVGVLWFVSVTTGPWGAVATSAGGEESLKCEDLKVGQYICKDPKINDATQEPVNCTNYTAHVSCFPAPNITCKDSSGNETHFTGNEVGFFKPISCRNVNGYSYKVAVALSLFLGWLGADRFYLGYPALGKETVTREVKGFTESRGFPLFCDIFVVIIFVLWIGKLSRD

SEQ ID NO: 89004 - protein, 76 aa, Homo sapiens
  Payload ID: 17815
  Gene Name: TM2 domain containing 1
  ENSP ID: ENSP00000475529
MAAAWPSGPSAPEAVTARLVGVLWFVSVTTGPWGAVATSAGGEESLKCEDLKVGQYPLWRTPPHGGEVELGSQIQK

SEQ ID NO: 89005 - protein, 207 aa, Homo sapiens; identical to SEQ ID NO: 89000
  Payload ID: 17815
  Gene Name: TM2 domain containing 1
  Uniprot ID: Q9BX74
  ENSP ID: ENSP00000475700

SEQ ID NO: 89006 - protein, 77 aa, Homo sapiens
  Payload ID: 17815
  Gene Name: TM2 domain containing 1
  ENSP ID: ENSP00000475844
  MOD_RES (1)..(1): Any amino acid
XFVSVTTGPWGAVATSAGGEESLKCEDLKVGQYPLWRTPPHGGEGLTLSPWLEYSGTISAHCSLRLPGSVNSPASAS

SEQ ID NO: 89007 - protein, 104 aa, Homo sapiens
  Payload ID: 17815
  Gene Name: TM2 domain containing 1
  ENSP ID: ENSP00000476178
  MOD_RES (1)..(1): Any amino acid
XAWPSGPSAPEAVTARLVGVLWFVSVTTGPWGAVATSAGGEESLKCEDLKVGQYPLWRTPPHGGEVELGSQGLTLSPWLEYSGTISAHCSLRLPGSVNSPASAS

SEQ ID NO: 89008 - protein, 171 aa, Homo sapiens
  Payload ID: 17816
  Gene Name: TM2 domain containing 2
  Uniprot ID: Q9BX73
  ENSP ID: ENSP00000380260
MKKCLLPVLITCMQTAICKDRMMMIMILLVNYRPDEFIECEDPVDHVGNATASQELGYGCLKFGGQAYSDVEHTSVQCHALDGIECASPRTFLRENKPCIKYTGHYFITTLLYSFFLGCFGVDRFCLGHTGTAVGKLLTLGGLGIWWFVDLILLITGGLMPSDGSNWCTVY

SEQ ID NO: 89009 - protein, 171 aa, Homo sapiens; identical to SEQ ID NO: 89008
  Payload ID: 17816
  Gene Name: TM2 domain containing 2
  Uniprot ID: Q9BX73
  ENSP ID: ENSP00000391674

SEQ ID NO: 89010 - protein, 214 aa, Homo sapiens
  Payload ID: 17816
  Gene Name: TM2 domain containing 2
  Uniprot ID: Q9BX73
  ENSP ID: ENSP00000416050
MVLGGCPVSYLLLCGQAALLLGNLLLLHCVSRSHSQNATAEPELTSAGAAQPEGPGGAASWEYGDPHSPVILCSYLPDEFIECEDPVDHVGNATASQELGYGCLKFGGQAYSDVEHTSVQCHALDGIECASPRTFLRENKPCIKYTGHYFITTLLYSFFLGCFGVDRFCLGHTGTAVGKLLTLGGLGIWWFVDLILLITGGLMPSDGSNWCTVY

SEQ ID NO: 89011 - protein, 45 aa, Homo sapiens
  Payload ID: 17816
  Gene Name: TM2 domain containing 2
  ENSP ID: ENSP00000428203
MKKCLLPVLITCMQTAICKDRMMMIMILLVNYRPDEFIECEDPVD

SEQ ID NO: 89012 - protein, 120 aa, Homo sapiens
  Payload ID: 17816
  Gene Name: TM2 domain containing 2
  ENSP ID: ENSP00000428394
MKKCLLPVLITCMQTAICKDRMMMIMILLVNYRPDEFIECEDPVDHVGNATASQELGYGCLKFGGQAYSDVEHTSVQCHALDGIECASPRTFLRENKPCIKYTGHYFITTLLYSFFLGCF

SEQ ID NO: 89013 - protein, 62 aa, Homo sapiens
  Payload ID: 17816
  Gene Name: TM2 domain containing 2
  ENSP ID: ENSP00000430685
MKKCLLPVLITCMQTAICKDRMMMIMILLVNYRPDEFIECEDPVDHVGNATASQELGYGCLK

SEQ ID NO: 89014 - protein, 221 aa, Homo sapiens
  Payload ID: 17817
  Gene Name: TM2 domain containing 3
  Uniprot ID: Q9BRN9
  ENSP ID: ENSP00000327584
MAGGVLPLRGLRALCRVLLFLSQFCILSGGESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWREGLGKLFSFGGLGIWTLIDVLLIGVGYVGPADGSLYI

SEQ ID NO: 89015 - protein, 247 aa, Homo sapiens
  Payload ID: 17817
  Gene Name: TM2 domain containing 3
  Uniprot ID: Q9BRN9
  ENSP ID: ENSP00000330433
MAGGVLPLRGLRALCRVLLFLSQFCILSGGEQSQALAQSIKDPGPTRTFTVVPRAAESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWREGLGKLFSFGGLGIWTLIDVLLIGVGYVGPADGSLYI

SEQ ID NO: 89016 - protein, 183 aa, Homo sapiens
  Payload ID: 17817
  Gene Name: TM2 domain containing 3
  ENSP ID: ENSP00000402179
MAGGVLPLRGLRALCRVLLFLSQFCILSGGESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSLQAQVGLHVQLTVGLH

SEQ ID NO: 89017 - protein, 182 aa, Homo sapiens
  Payload ID: 17817
  Gene Name: TM2 domain containing 3
  ENSP ID: ENSP00000452823
MKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWREGLGKLFSFGGLGIWTLIDVLLIGVGYVGPADGSLYI

SEQ ID NO: 89018 - protein, 42 aa, Homo sapiens
  Payload ID: 17817
  Gene Name: TM2 domain containing 3
  ENSP ID: ENSP00000453503
MAGGVLPLRGLRALCRVLLFLSQFCILSGGGESKAGFSAGWG

SEQ ID NO: 89019 - protein, 161 aa, Homo sapiens
  Payload ID: 17817
  Gene Name: TM2 domain containing 3
  ENSP ID: ENSP00000453990
  MOD_RES (1)..(1): Any amino acid
XSTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALRVGLFIDTVTTPLHSSLSHRARHCL

SEQ ID NO: 89020 - protein, 209 aa, Homo sapiens
  Payload ID: 17817
  Gene Name: TM2 domain containing 3
  ENSP ID: ENSP00000454131
MAGGVLPLRGLRALCRVLLFLSQFCILSGGEQSQALAQSIKDPGPTRTFTVVPRAAESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSLQAQVGLHVQLTVGLH

SEQ ID NO: 89021 - protein, 21 aa, Homo sapiens
  Payload ID: 17817
  Gene Name: TM2 domain containing 3
  ENSP ID: ENSP00000456921
  MOD_RES (1)..(1): Any amino acid
XQFCILSGGGESKAGFSAGWG

SEQ ID NO: 89022 - protein, 209 aa, Homo sapiens
  Payload ID: 17818
  Gene Name: TM4SF19-TCTEX1D2 readthrough (NMD candidate)
  ENSP ID: ENSP00000405973
MVSSPCTQASSRTCSRILGLSLGTAALFAAGANVALLLPNWDVTYLLRGLLGRHAMLGTGLWGGGLMVLTAAILISLMGWRYGCFSKSGLCRSVLTALLSGGLALLGALICFVTSGVALKDGPFCMFDVSSFNQTQAWKYGYPFKDLHSRNYLYDRSLWNSVCLEPSAAVVWHVSLFSALLCISLLQLLLVVVHVINSLLGLFCSLCEK

SEQ ID NO: 89023 - protein, 404 aa, Homo sapiens
  Payload ID: 17819
  Gene Name: TMED7-TICAM2 readthrough
  ENSP ID: ENSP00000282382
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVAYWHSVDTSPGYHESDSKKSEDLSLCNVAEHSNTTEGPTGKQEGAQSVEEMFEEEAEEEVFLKFVILHAEDDTDEALRVQNLLQDDFGIKPGIIFAEMPCGRQHLQNLDDAVNGSAWTILLLTENFLRDTWCNFQFYTSLMNSVNRQHKYNSVIPMRPLNNPLPRERTPFALQTINALEEESRGFPTQVERIFQESVYKTQQTIWKETRNMVQRQFIA

SEQ ID NO: 89024 - protein, 188 aa, Homo sapiens
  Payload ID: 17819
  Gene Name: TMED7-TICAM2 readthrough
  ENSP ID: ENSP00000333650
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVAY

SEQ ID NO: 89025 - protein, 148 aa, Homo sapiens
  Payload ID: 17820
  Gene Name: TMEM110-MUSTN1 readthrough
  ENSP ID: ENSP00000422189
  MOD_RES (1)..(1): Any amino acid
XVVDNFLMRKGKTKAKLEERGANQDSRNGSKVRYRRAASHEESESEILISADDEMEESDVEEDLRRLTPLKPVKKKKHRFGLPLLPAREAPSETQRLHNTHHVPGWCSGSPYQEEAPPCEGRGPEGGPRKPDQEPGNQVQDLPGHARV

SEQ ID NO: 89026 - protein, 372 aa, Homo sapiens
  Payload ID: 17820
  Gene Name: TMEM110-MUSTN1 readthrough
  ENSP ID: ENSP00000422941
MQGPAGNASRGLPGGPPSTVASGAGRCESGALMHSFGIFLQGLLGVVAFSTLMLKRFREPKHERRPWRIWFLDTSKQAIGMLFIHFANVYLADLTEEDPCSLYLINFLLDATVGMLLIYVGVRAVSVLVEWQQWESLRFGEYGDPLQCGAWVGQCALYIVIMIFEKSVVFIVLLILQWKKVALLNPIENPDLKLAIVMLIVPFFVNALMFWVVDNFLMRKGKTKAKLEERGANQDSRNGSKVRYRRAASHEESESEILISADDEMEESDVEEDLRRLTPLKPVKKKKHRFGLPAGAQEAPIKKKRPPVKDEDLKGARGNLTKNQEIKSKTYQVMRECEQAGSAAPSVFSRTRTGTETVFEKPKAGPTKSVFG

SEQ ID NO: 89027 - protein, 370 aa, Homo sapiens
  Payload ID: 17821
  Gene Name: TMEM189-UBE2V1 readthrough
  ENSP ID: ENSP00000344166
MAGAENWPGQQLELDEDEASCCRWGAQHAGARELAALYSPGKRLQEWCSVILCFSLIAHNLVHLLLLARWEDTPLVILGVVAGALIADFLSGLVHWGADTWGSVELPIVGKAFIRPFREHHIDPTAITRHDFIETNGDNCLVTLLPLLNMAYKFRTHSPEALEQLYPWECFVFCLIIFGTFTNQIHKWSHTYFGLPRWVTLLQDWHVILPRKHHRIHHVSPHETYFCITTGVKVPRNFRLLEELEEGQKGVGDGTVSWGLEDDEDMTLTRWTGMIIGPPRTIYENRIYSLKIECGPKYPEAPPFVRFVTKINMNGVNSSNGVVDPRAISVLAKWQNSYSIKVVLQELRRLMMSKENMKLPQPPEGQCYSN

SEQ ID NO: 89028 - protein, 68 aa, Homo sapiens
  Payload ID: 17822
  Gene Name: TMEM256-PLSCR3
  ENSP ID: ENSP00000466104
MAGPAAAFRRLGALSGAAALGFASYGAHGAQFPDAYGKELFDKANKHHFLHSLALLGVPHCRKPLWAA

SEQ ID NO: 89029 - protein, 41 aa, Homo sapiens
  Payload ID: 17822
  Gene Name: TMEM256-PLSCR3
  ENSP ID: ENSP00000466960
MAGPAAAFRRLGALSGAAALGFASYGAHGAQFPDAYGKEAA

SEQ ID NO: 89030 - protein, 68 aa, Homo sapiens; identical to SEQ ID NO: 89028
  Payload ID: 17822
  Gene Name: TMEM256-PLSCR3
  ENSP ID: ENSP00000468219

SEQ ID NO: 89031 - protein, 28 aa, Homo sapiens
  Payload ID: 17822
  Gene Name: TMEM256-PLSCR3
  ENSP ID: ENSP00000468730
FDKANKHHFLHSLALLGVPHCRKPLWAA

SEQ ID NO: 89032 - protein, 295 aa, Homo sapiens
  Payload ID: 17823
  Gene Name: TMEM256-PLSCR3 readthrough (NMD candidate)
  Uniprot ID: Q9NRY6
  ENSP ID: ENSP00000316021
MAGYLPPKGYAPSPPPPYPVTPGYPEPALHPGPGQAPVPAQVPAPAPGFALFPSPGPVALGSAAPFLPLPGVPSGLEFLVQIDQILIHQKAERVETFLGWETCNRYELRSGAGQPLGQAAEESNCCARLCCGARRPLRVRLADPGDREVLRLLRPLHCGCSCCPCGLQEMEVQAPPGTTIGHVLQTWHPFLPKFSIQDADRQTVLRVVGPCWTCGCGTDTNFEVKTRDESRSVGRISKQWGGLVREALTDADDFGLQFPLDLDVRVKAVLLGATFLIDYMFFEKRGGAGPSAVTS

SEQ ID NO: 89033 - protein, 295 aa, Homo sapiens; identical to SEQ ID NO: 89032
  Payload ID: 17823
  Gene Name: TMEM256-PLSCR3 readthrough (NMD candidate)
  Uniprot ID: Q9NRY6
  ENSP ID: ENSP00000438547

SEQ ID NO: 89034 - protein, 170 aa, Homo sapiens
  Payload ID: 17823
  Gene Name: TMEM256-PLSCR3 readthrough (NMD candidate)
  ENSP ID: ENSP00000458596
MEVQAPPGTTIGHVLQTWHPFLPKFSIQDADRQTVLRVVGPCWTCGCGTDTNFEVKTRDESRSVGRISKQWGGLVREALTDADDFGLQFPLDLDVRVKAVLLGATFLIVSWLPLPPPPACPLLSFEALCISWPLARGKSGIGVVGVEVLELACDSQAGLAQPDLPLTVAS

SEQ ID NO: 89035 - protein, 118 aa, Homo sapiens
  Payload ID: 17823
  Gene Name: TMEM256-PLSCR3 readthrough (NMD candidate)
  ENSP ID: ENSP00000458988
MAGYLPPKGYAPSPPPPYPVTPGYPEPALHPGPGQAPVPAQVPAPAPGFALFPSPGPVALGSAAPFLPLPGVPSGLEFLVQIDQILIHQKAERVENGSTGSTRHHHWPRATDLASLPP

SEQ ID NO: 89036 - protein, 295 aa, Homo sapiens; identical to SEQ ID NO: 89032
  Payload ID: 17823
  Gene Name: TMEM256-PLSCR3 readthrough (NMD candidate)
  Uniprot ID: Q9NRY6
  ENSP ID: ENSP00000459019

SEQ ID NO: 89037 - protein, 148 aa, Homo sapiens
  Payload ID: 17823
  Gene Name: TMEM256-PLSCR3 readthrough (NMD candidate)
  ENSP ID: ENSP00000459122
MAGYLPPKGYAPSPPPPYPVTPGYPEPALHPGPGQAPVPAQVPAPAPGFALFPSPGPVALGSAAPFLPLPGVPSGLEFLVQIDQILIHQKAERVENGSTGSTRHHHWPRATDLASLPPQVLHPGCRSPDSLASGGALLDLWLWHRHQL

SEQ ID NO: 89038 - protein, 295 aa, Homo sapiens; identical to SEQ ID NO: 89032
  Payload ID: 17823
  Gene Name: TMEM256-PLSCR3 readthrough (NMD candidate)
  Uniprot ID: Q9NRY6
  ENSP ID: ENSP00000459419

SEQ ID NO: 89039 - protein, 271 aa, Homo sapiens
  Payload ID: 17823
  Gene Name: TMEM256-PLSCR3 readthrough (NMD candidate)
  ENSP ID: ENSP00000460800
MAGYLPPKGYAPSPPPPYPVTPGYPEPALHPGPGQAPVPAQVPAPAPGFALFPSPGPVALGSAAPFLPLPGVPSGLEFLVQIDQILIHQKAERVETFLGWETCNRYELRSGAGQPLGQAAEESNCCARLCCGARRPLRVRLADPGDREVLRLLRPLHCGCSCCPCGLQEFSIQDADRQTVLRVVGPCWTCGCGTDTNFEVKTRDESRSVGRISKQWGGLVREALTDADDFGLQFPLDLDVRVKAVLLGATFLIDYMFFEKRGGAGPSAVTS

SEQ ID NO: 89040 - protein, 35 aa, Homo sapiens
  Payload ID: 17823
  Gene Name: TMEM256-PLSCR3 readthrough (NMD candidate)
  ENSP ID: ENSP00000461205
MEVQAPPGTTIGHVLQTWHPFLPKFSIQDADRQTV

SEQ ID NO: 89041 - protein, 171 aa, Homo sapiens
  Payload ID: 17823
  Gene Name: TMEM256-PLSCR3 readthrough (NMD candidate)
  ENSP ID: ENSP00000461843
AERVETFLGWETCNRYELRSGAGQPLGQAAEESNCCARLCCGARRPLRVRLADPGDREVLRLLRPLHCGCSCCPCGLQEMEVQAPPGTTIGHVLQTWHPFLPKFSIQDADRQTVLRVVGPCWTCGCGTDTNFEFPLDLDVRVKAVLLGATFLIDYMFFEKRGGAGPSAVTS

SEQ ID NO: 89042 - protein, 223 aa, Homo sapiens
  Payload ID: 17823
  Gene Name: TMEM256-PLSCR3 readthrough (NMD candidate)
  ENSP ID: ENSP00000483743
MAGYLPPKGYAPSPPPPYPVTPGYPEPALHPGPGQAPVPAQVPAPAPGFALFPSPGPVALGSAAPFLPLPGVPSGLEFLVQIDQILIHQKAERVETFLGWRPVIGMNCALGPGSPWVRRPRRATAAPVCAVAPAGRCVSAWPTPGTVRCCVCSARCTVAAAAAPVASRRWKYRLHQAPPLATCYRPGIPSSPSSPSRMPIARQSCEWWGPAGPVAVAQTPTLR

SEQ ID NO: 89043 - protein, 108 aa, Homo sapiens
  Payload ID: 17824
  Gene Name: TMEM56-RWDD3 readthrough
  ENSP ID: ENSP00000474793
  MOD_RES (1)..(1): Any amino acid
XMHHCASLYAYYLVLKNGVLAYIGNFRLLAELSSPFVNQRPKAVVTGNMDLFSSLTLHLSTLSLQSPANNQFLAFEVKEYSALDELQKEFETAGLKKLFSEFVLALVK

SEQ ID NO: 89044 - protein, 201 aa, Homo sapiens
  Payload ID: 17824
  Gene Name: TMEM56-RWDD3 readthrough
  ENSP ID: ENSP00000475025
MEINTKLLISVTCISFFTFQLLFYFVSYWFSAKVSPGFNSLSFKKKIEWNSRVVSTCHSLVVGIFGLYIFLFDEATKADPLWGGPSLANVNIAIASGYLISDLSIIILYWKVIGDKFFIMHHCASLYAYYLVLKNGVLAYIGNFRLLAELSSPFVNQRPKAVVTGNMDLFSSLTLHLSTLSLQSPANNQDRWDRVQNSHKS

SEQ ID NO: 89045 - protein, 124 aa, Homo sapiens
  Payload ID: 17825
  Gene Name: TMEM9 domain family, member B
  Uniprot ID: Q9NQ34
  ENSP ID: ENSP00000311842
MPVRGPDVEAYCLRCECKYEERSSVTIKVTIIIYLSILGLLLLYMVYLTLVEPILKRRLFGHAQLIQSDDDIGDHQPFANAHDVLARSRSRANVLNKVEYAQQRWKLQVQEQRKSVFDRHVVLS

SEQ ID NO: 89046 - protein, 124 aa, Homo sapiens; identical to SEQ ID NO: 89045
  Payload ID: 17825
  Gene Name: TMEM9 domain family, member B
  Uniprot ID: Q9NQ34
  ENSP ID: ENSP00000431487

SEQ ID NO: 89047 - protein, 95 aa, Homo sapiens
  Payload ID: 17825
  Gene Name: TMEM9 domain family, member B
  ENSP ID: ENSP00000432373
MPVRGPDVEAYCLRCECKYEERSSVTIKVTIIIYLSILGLLLLYMVYLTLVEPILKRRLFGHAQLIQSDDDIGVSSQPALAAHGQSLSSFDVKCK

SEQ ID NO: 89048 - protein, 198 aa, Homo sapiens
  Payload ID: 17825
  Gene Name: TMEM9 domain family, member B
  Uniprot ID: Q9NQ34
  ENSP ID: ENSP00000433361
MATLWGGLLRLGSLLSLSCLALSVLLLAQLSDAAKNFEDVRCKCICPPYKENSGHIYNKNISQKDCDCLHVVEPMPVRGPDVEAYCLRCECKYEERSSVTIKVTIIIYLSILGLLLLYMVYLTLVEPILKRRLFGHAQLIQSDDDIGDHQPFANAHDVLARSRSRANVLNKVEYAQQRWKLQVQEQRKSVFDRHVVLS

SEQ ID NO: 89049 - protein, 53 aa, Homo sapiens
  Payload ID: 17825
  Gene Name: TMEM9 domain family, member B
  ENSP ID: ENSP00000434961
MPVRGPDVEAYCLRCECKYEERSSVTIKVTIIIYLSILGLLLLYMVYLTLVEP

SEQ ID NO: 89050 - protein, 227 aa, Homo sapiens
  Payload ID: 17826
  Gene Name: TMF1-regulated nuclear protein 1
  Uniprot ID: Q6NT89
  ENSP ID: ENSP00000429216
MPGCRISACGPGAQEGTAEQRSPPPPWDPMPSSQPPPPTPTLTPTPTPGQSPPLPDAAGASAGAAEDQELQRWRQGASGIAGLAGPGGGSGAAAGAGGRALELAEARRRLLEVEGRRRLVSELESRVLQLHRVFLAAELRLAHRAESLSRLSGGVAQAELYLAAHGSRLKKGPRRGRRGRPPALLASALGLGGCVPWGAGRLRRGHGPEPDSPFRRSPPRGPASPQR

SEQ ID NO: 89051 - protein, 50 aa, Homo sapiens
  Payload ID: 17826
  Gene Name: TMF1-regulated nuclear protein 1
  ENSP ID: ENSP00000436467
  MOD_RES (1)..(1): Any amino acid
XGRPPALLASALGLGGCVPWGAGRLRRGHGPEPDSPFRRSPPRGPASPQR

SEQ ID NO: 89052 - protein, 103 aa, Homo sapiens
  Payload ID: 17827
  Gene Name: TMX2-CTNND1 readthrough (NMD candidate)
  ENSP ID: ENSP00000456881
MAVLAPLIALVYSVPRLSRWLAQPYYLLSALLSAAFLLVRKLPPLCHGLPTQREDGNPCDFDWREVEILMFLSAIVMMKNRRSTLSFLLPPCCGGWDASSMIF

SEQ ID NO: 89053 - protein, 416 aa, Homo sapiens
  Payload ID: 17828
  Gene Name: TNF receptor-associated factor 1
  Uniprot ID: Q13077
  ENSP ID: ENSP00000362994
MASSSGSSPRPAPDENEFPFGCPPTVCQDPKEPRALCCAGCLSENPRNGEDQICPKCRGEDLQSISPGSRLRTQEKAHPEVAEAGIGCPFAGVGCSFKGSPQSVQEHEVTSQTSHLNLLLGFMKQWKARLGCGLESGPMALEQNLSDLQLQAAVEVAGDLEVDCYRAPCSESQEELALQHFMKEKLLAELEGKLRVFENIVAVLNKEVEASHLALATSIHQSQLDRERILSLEQRVVELQQTLAQKDQALGKLEQSLRLMEEASFDGTFLWKITNVTRRCHESACGRTVSLFSPAFYTAKYGYKLCLRLYLNGDGTGKRTHLSLFIVIMRGEYDALLPWPFRNKVTFMLLDQNNREHAIDAFRPDLSSASFQRPQSETNVASGCPLFFPLSKLQSPKHAYVKDDTMFLKCIVETST

SEQ ID NO: 89054 - protein, 294 aa, Homo sapiens
  Payload ID: 17828
  Gene Name: TNF receptor-associated factor 1
  Uniprot ID: Q13077
  ENSP ID: ENSP00000438583
MKQWKARLGCGLESGPMALEQNLSDLQLQAAVEVAGDLEVDCYRAPCSESQEELALQHFMKEKLLAELEGKLRVFENIVAVLNKEVEASHLALATSIHQSQLDRERILSLEQRVVELQQTLAQKDQALGKLEQSLRLMEEASFDGTFLWKITNVTRRCHESACGRTVSLFSPAFYTAKYGYKLCLRLYLNGDGTGKRTHLSLFIVIMRGEYDALLPWPFRNKVTFMLLDQNNREHAIDAFRPDLSSASFQRPQSETNVASGCPLFFPLSKLQSPKHAYVKDDTMFLKCIVETST

SEQ ID NO: 89055 - protein, 416 aa, Homo sapiens; identical to SEQ ID NO: 89053
  Payload ID: 17828
  Gene Name: TNF receptor-associated factor 1
  Uniprot ID: Q13077
  ENSP ID: ENSP00000443183

SEQ ID NO: 89056 - protein, 501 aa, Homo sapiens
  Payload ID: 17829
  Gene Name: TNF receptor-associated factor 2
  Uniprot ID: Q12933
  ENSP ID: ENSP00000247668
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKAHHEVCPKFPLTCDGCGKKKIPREKFQDHVKTCGKCRVPCRFHAIGCLETVEGEKQQEHEVQWLREHLAMLLSSVLEAKPLLGDQSHAGSELLQRCESLEKKTATFENIVCVLNREVERVAMTAEACSRQHRLDQDKIEALSSKVQQLERSIGLKDLAMADLEQKVLEMEASTYDGVFIWKISDFARKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 89057 - protein, 121 aa, Homo sapiens
  Payload ID: 17829
  Gene Name: TNF receptor-associated factor 2
  ENSP ID: ENSP00000397653
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEY

SEQ ID NO: 89058 - protein, 171 aa, Homo sapiens
  Payload ID: 17829
  Gene Name: TNF receptor-associated factor 2
  ENSP ID: ENSP00000405860
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCC

SEQ ID NO: 89059 - protein, 193 aa, Homo sapiens
  Payload ID: 17829
  Gene Name: TNF receptor-associated factor 2
  ENSP ID: ENSP00000406524
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKAHHEVCPKFPLTCDGCG

SEQ ID NO: 89060 - protein, 543 aa, Homo sapiens
  Payload ID: 17830
  Gene Name: TNF receptor-associated factor 3
  ENSP ID: ENSP00000328003
MESSKKMDSPGALQTNPPLKLHTDRSAGTPVFVPEQGGYKEKFVKTVEDKYKCEKCHLVLCSPKQTECGHRFCESCMAALLSSSSPKCTACQESIVKDKVFKDNCCKREILALQIYCRNESRGCAEQLMLGHLLVHLKNDCHFEELPCVRPDCKEKVLRKDLRDHVEKACKYREATCSHCKSQVPMIALQKHEDTDCPCVVVSCPHKCSVQTLLRSEGTNQQIKAHEASSAVQHVNLLKEWSNSLEKKVSLLQNESVEKNKSIQSLHNQICSFEIEIERQKEMLRNNESKILHLQRVIDSQAEKLKELDKEIRPFRQNWEEADSMKSSVESLQNRVTELESVDKSAGQVARNTGLLESQLSRHDQMLSVHDIRLADMDLRFQVLETASYNGVLIWKIRDYKRRKQEAVMGKTLSLYSQPFYTGYFGYKMCARVYLNGDGMGKGTHLSLFFVIMRGEYDALLPWPFKQKVTLMLMDQGSSRRHLGDAFKPDPNSSSFKKPTGEMNIASGCPVFVAQTVLENGTYIKDDTIFIKVIVDTSDLPDP

SEQ ID NO: 89061 - protein, 543 aa, Homo sapiens; identical to SEQ ID NO: 89060
  Payload ID: 17830
  Gene Name: TNF receptor-associated factor 3
  ENSP ID: ENSP00000332468

SEQ ID NO: 89062 - protein, 568 aa, Homo sapiens
  Payload ID: 17830
  Gene Name: TNF receptor-associated factor 3
  Uniprot ID: Q13114
  ENSP ID: ENSP00000376500
MESSKKMDSPGALQTNPPLKLHTDRSAGTPVFVPEQGGYKEKFVKTVEDKYKCEKCHLVLCSPKQTECGHRFCESCMAALLSSSSPKCTACQESIVKDKVFKDNCCKREILALQIYCRNESRGCAEQLMLGHLLVHLKNDCHFEELPCVRPDCKEKVLRKDLRDHVEKACKYREATCSHCKSQVPMIALQKHEDTDCPCVVVSCPHKCSVQTLLRSELSAHLSECVNAPSTCSFKRYGCVFQGTNQQIKAHEASSAVQHVNLLKEWSNSLEKKVSLLQNESVEKNKSIQSLHNQICSFEIEIERQKEMLRNNESKILHLQRVIDSQAEKLKELDKEIRPFRQNWEEADSMKSSVESLQNRVTELESVDKSAGQVARNTGLLESQLSRHDQMLSVHDIRLADMDLRFQVLETASYNGVLIWKIRDYKRRKQEAVMGKTLSLYSQPFYTGYFGYKMCARVYLNGDGMGKGTHLSLFFVIMRGEYDALLPWPFKQKVTLMLMDQGSSRRHLGDAFKPDPNSSSFKKPTGEMNIASGCPVFVAQTVLENGTYIKDDTIFIKVIVDTSDLPDP

SEQ ID NO: 89063 - protein, 485 aa, Homo sapiens
  Payload ID: 17830
  Gene Name: TNF receptor-associated factor 3
  Uniprot ID: Q13114
  ENSP ID: ENSP00000445998
MESSKKMDSPGALQTNPPLKLHTDRSAGTPVFVPEQGGYKEKFVKTVEDKYKCEKCHLVLCSPKQTECGHRFCESCMAALLSSSSPKCTACQESIVKDKVFKDNCCKREILALQIYCRNESRGCAEQLMLGHLLVHLKNDCHFEELPCVRPDCKEKVLRKDLRDHVEKACKYREATCSHCKSQVPMIALQVSLLQNESVEKNKSIQSLHNQICSFEIEIERQKEMLRNNESKILHLQRVIDSQAEKLKELDKEIRPFRQNWEEADSMKSSVESLQNRVTELESVDKSAGQVARNTGLLESQLSRHDQMLSVHDIRLADMDLRFQVLETASYNGVLIWKIRDYKRRKQEAVMGKTLSLYSQPFYTGYFGYKMCARVYLNGDGMGKGTHLSLFFVIMRGEYDALLPWPFKQKVTLMLMDQGSSRRHLGDAFKPDPNSSSFKKPTGEMNIASGCPVFVAQTVLENGTYIKDDTIFIKVIVDTSDLPDP

SEQ ID NO: 89064 - protein, 207 aa, Homo sapiens
  Payload ID: 17830
  Gene Name: TNF receptor-associated factor 3
  ENSP ID: ENSP00000453031
PKCTACQESIVKDKVFKDNCCKREILALQIYCRNESRGCAEQLMLGHLLVHLKNDCHFEELPCVRPDCKEKVLRKDLRDHVEKACKYREATCSHCKSQVPMIALQKHEDTDCPCVVVSCPHKCSVQTLLRSELSAHLSECVNAPSTCSFKRYGCVFQGTNQQIKAHEASSAVQHVNLLKEWSNSLEKKGYENKESENSVPSLTDGNE

SEQ ID NO: 89065 - protein, 290 aa, Homo sapiens
  Payload ID: 17830
  Gene Name: TNF receptor-associated factor 3
  ENSP ID: ENSP00000453032
SRGCAEQLMLGHLLVHLKNDCHFEELPCVRPDCKEKVLRKDLRDHVEKACKYREATCSHCKSQVPMIALQGTNQQIKAHEASSAVQHVNLLKEWSNSLEKKVSLLQNESVEKNKSIQSLHNQICSFEIEIERQKEMLRNNESKILHLQRVIDSQAEKLKELDKEIRPFRQNWEEADSMKSSVESLQNRVTELESVDKSAGQVARNTGLLESQLSRHDQMLSVHDIRLADMDLRFQVLETASYNGVLIWKIRDYKRRKQEAVMGKTLSLYSQPFYTGYFGYKMCARVYLNG

SEQ ID NO: 89066 - protein, 94 aa, Homo sapiens
  Payload ID: 17830
  Gene Name: TNF receptor-associated factor 3
  ENSP ID: ENSP00000453623
MESSKKMDSPGALQTNPPLKLHTDRSAGTPVFVPEQGGYKEKFVKTVEDKYKCEKCHLVLCSPKQTECGHRFCESCMAALLSSSSPKCTACQES

SEQ ID NO: 89067 - protein, 568 aa, Homo sapiens; identical to SEQ ID NO: 89062
  Payload ID: 17830
  Gene Name: TNF receptor-associated factor 3
  Uniprot ID: Q13114
  ENSP ID: ENSP00000454207

SEQ ID NO: 89068 - protein, 691 aa, Homo sapiens
  Payload ID: 17831
  Gene Name: TNF receptor-associated factor 3 interacting protein 1
  Uniprot ID: Q8TDR0
  ENSP ID: ENSP00000362424
MNAAVVRRTQEALGKVIRRPPLTEKLLSKPPFRYLHDIITEVIRMTGFMKGLYTDAEMKSDNVKDKDAKISFLQKAIDVVVMVSGEPLLAKPARIVAGHEPERTNELLQIIGKCCLNKLSSDDAVRRVLAGEKGEVKGRASLTSRSQELDNKNVREEESRVHKNTEDRGDAEIKERSTSRDRKQKEELKEDRKPREKDKDKEKAKENGGNRHREGERERAKARARPDNERQKDRGNRERDRDSERKKETERKSEGGKEKERLRDRDRERDRDKGKDRDRRRVKNGEHSWDLDREKNREHDKPEKKSASSGEMSKKLSDGTFKDSKAETETEISTRASKSLTTKTSKRRSKNSVEGRKEDNISAKSLDSIVSGINNEPNQETTTSEIGTKEANINSTSISDDNSASLRCENIQPNPTEKQKGDSTSDAEGDAGPAGQDKSEVPETPEIPNELSSNIRRIPRPGSARPAPPRVKRQDSMEALQMDRSGSGKTVSNVITESHNSDNEEDDQFVVEAAPQLSEMSEIEMVTAVELEEEEKHGGLVKKILETKKDYEKLQQSPKPGEKERSLFESAWKKEKDIVSKEIEKLRTSIQTLCKSALPLGKIMDYIQEDVDAMQNELQMWHSENRQHAEALQQEQRITDCAVEPLKAELAELEQLIKDQQDKICAVKANILKNEEKIQKMVYSINLTSRR

SEQ ID NO: 89069 - protein, 625 aa, Homo sapiens
  Payload ID: 17831
  Gene Name: TNF receptor-associated factor 3 interacting protein 1
  Uniprot ID: Q8TDR0
  ENSP ID: ENSP00000375851
MNAAVVRRTQEALGKVIRRPPLTEKLLSKPPFRYLHDIITEVIRMTGFMKGLYTDAEMKSDNVKDKDAKISFLQKAIDVVVMVSGEPLLAKPARIVAGHEPERTNELLQIIGKCCLNKLSSDDAVRRVLAGEKGEVKGRASLTSRSQELDNKNVREEESRVHKNTEDRGDAEIKERSTSRDRKQKEELKEDRKPREKDKDKEKAKENGGNRHREGERERAKARARPDNERQKDRGNRERDRDSERKKETERKSEGGKEKERLRDRDRERDRDKGKDRDRRRVKNGEHSWDLDREKNREHDKPEKKSASSGEMSKKLSDGTFKDSKAETETEISTRASKSLTTKTSKRRSKNSVEGDSTSDAEGDAGPAGQDKSEVPETPEIPNELSSNIRRIPRPGSARPAPPRVKRQDSMEALQMDRSGSGKTVSNVITESHNSDNEEDDQFVVEAAPQLSEMSEIEMVTAVELEEEEKHGGLVKKILETKKDYEKLQQSPKPGEKERSLFESAWKKEKDIVSKEIEKLRTSIQTLCKSALPLGKIMDYIQEDVDAMQNELQMWHSENRQHAEALQQEQRITDCAVEPLKAELAELEQLIKDQQDKICAVKANILKNEEKIQKMVYSINLTSRR

SEQ ID NO: 89070 - protein, 52 aa, Homo sapiens
  Payload ID: 17831
  Gene Name: TNF receptor-associated factor 3 interacting protein 1
  ENSP ID: ENSP00000386648
MNAAVVRRTQEALGKVIRRPPLTEKLLSKPPFRYLHDIITEVGAGDRARPGD

SEQ ID NO: 89071 - protein, 470 aa, Homo sapiens
  Payload ID: 17832
  Gene Name: TNF receptor-associated factor 4
  Uniprot ID: Q9BUZ4
  ENSP ID: ENSP00000262395
MPGFDYKFLEKPKRRLLCPLCGKPMREPVQVSTCGHRFCDTCLQEFLSEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYESHEGMCPQESVYCENKCGARMMRRLLAQHATSECPKRTQPCTYCTKEFVFDTIQSHQYQCPRLPVACPNQCGVGTVAREDLPGHLKDSCNTALVLCPFKDSGCKHRCPKLAMARHVEESVKPHLAMMCALVSRQRQELQELRRELEELSVGSDGVLIWKIGSYGRRLQEAKAKPNLECFSPAFYTHKYGYKLQVSAFLNGNGSGEGTHLSLYIRVLPGAFDNLLEWPFARRVTFSLLDQSDPGLAKPQHVTETFHPDPNWKNFQKPGTWRGSLDESSLGFGYPKFISHQDIRKRNYVRDDAVFIRAAVELPRKILS

SEQ ID NO: 89072 - protein, 195 aa, Homo sapiens
  Payload ID: 17832
  Gene Name: TNF receptor-associated factor 4
  ENSP ID: ENSP00000262396
MPGFDYKFLEKPKRRLLCPLCGKPMREPVQVSTCGHRFCDTCLQEFLSEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYESSLGFGYPKFISHQDIRKRNYVRDDAVFIRAAVELPRKILS

SEQ ID NO: 89073 - protein, 112 aa, Homo sapiens
  Payload ID: 17832
  Gene Name: TNF receptor-associated factor 4
  ENSP ID: ENSP00000396602
EGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKAMRVCAPRRVSTVRISVVPA

SEQ ID NO: 89074 - protein, 182 aa, Homo sapiens
  Payload ID: 17832
  Gene Name: TNF receptor-associated factor 4
  ENSP ID: ENSP00000415789
MPGFDYKFLEKPKRRLLCPLCGKPMREPVQVSTCGHRFCDTCLQEFLSEGVFKCPEDQLPLDYAKFPHPYPQIYPDPELEVQVLGLPIRCIHSEEGCRWSGPLRHLQGHLNTCSFNVIPCPNRCPMKLSRRDLPAHLQHDCPKRRLKCEFCGCDFSGEAYESHEGMCPQESVYCENKCGARM

SEQ ID NO: 89075 - protein, 437 aa, Homo sapiens
  Payload ID: 17832
  Gene Name: TNF receptor-associated factor 4
  ENSP ID: ENSP00000438154
MPGFDYKFLEKPKRRLLCPLCGKPMREPVQVSTCGHRFCDTCLQEFLSEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYESHEGMCPQESVYCENKCGARMMRRLLAQHATSECPKRTQPCTYCTKEFVFDTIQSHQYQCPRLPVACPNQCGVGTVAREDLPGHLKDSCNTALVLCPFKDSGCKHRCPKLAMARHVEESVKPHLAMMCALVSRQRQELQELRRELEELSVGSDGVLIWKIGSYGRRLQEAKAKPNLECFSPAFYTHKYGYKLQVSAFLNGNGSGEGTHLSLYIRVLPGAFDNLLEWPFARRGLSPFLGRADMPWCRSHSTRTEVPAQVLCPKSHKGVGIGEGERVVQRVCLEI

SEQ ID NO: 89076 - protein, 49 aa, Homo sapiens
  Payload ID: 17832
  Gene Name: TNF receptor-associated factor 4
  ENSP ID: ENSP00000464097
MPGFDYKFLEKPKRRLLCPLCGKPMREPVQVSTCGHRFCDTCLQEFLRS

SEQ ID NO: 89077 - protein, 92 aa, Homo sapiens
  Payload ID: 17832
  Gene Name: TNF receptor-associated factor 4
  ENSP ID: ENSP00000464583
  MOD_RES (1)..(1): Any amino acid
XFCDTCLQEFLSEGVFKCPEDQLPLDYAKVSPHCQEEAQAQSVALGGRSCWQPVGSGPVSTKSLGMVRLHKDLPRPGAGSTSIGPAYPLHPQ

SEQ ID NO: 89078 - protein, 48 aa, Homo sapiens
  Payload ID: 17832
  Gene Name: TNF receptor-associated factor 4
  ENSP ID: ENSP00000465164
MKLSRRDLPAHLQHDCPKRRLKCEFCGCDFSGEAYESHEGMCPQESVY

SEQ ID NO: 89079 - protein, 53 aa, Homo sapiens
  Payload ID: 17832
  Gene Name: TNF receptor-associated factor 4
  ENSP ID: ENSP00000466306
MPGFDYKFLEKPKRRLLCPLCGKPMREPVQVSTCGHRFCDTCLQEFLRSLQVP

SEQ ID NO: 89080 - protein, 90 aa, Homo sapiens
  Payload ID: 17832
  Gene Name: TNF receptor-associated factor 4
  ENSP ID: ENSP00000468107
MKLSRRDLPAHLQHDCPKRRLKCEFCGCDFSGEAYESHEGMCPQESVYCENKCGARMMRRLLAQHATSECPKRTQPCTYCTKEFVFDTIQ

SEQ ID NO: 89081 - protein, 144 aa, Homo sapiens
  Payload ID: 17832
  Gene Name: TNF receptor-associated factor 4
  ENSP ID: ENSP00000481248
MPGFDYKFLEKPKRRLLCPLCGKPMREPVQVSTCGHRFCDTCLQEFLSEGVFKWPFARRVTFSLLDQSDPGLAKPQHVTETFHPDPNWKNFQKPGTWRGSLDESSLGFGYPKFISHQDIRKRNYVRDDAVFIRAAVELPRKILS

SEQ ID NO: 89082 - protein, 557 aa, Homo sapiens
  Payload ID: 17833
  Gene Name: TNF receptor-associated factor 5
  Uniprot ID: O00463
  ENSP ID: ENSP00000261464
MAYSEEHKGMPCGFIRQNSGNSISLDFEPSIEYQFVERLEERYKCAFCHSVLHNPHQTGCGHRFCQHCILSLRELNTVPICPVDKEVIKSQEVFKDNCCKREVLNLYVYCSNAPGCNAKVILGRYQDHLQQCLFQPVQCSNEKCREPVLRKDLKEHLSASCQFRKEKCLYCKKDVVVINLQNHEENLCPEYPVFCPNNCAKIILKTEVDEHLAVCPEAEQDCPFKHYGCAVTDKRRNLQQHEHSALREHMRLVLEKNVQLEEQISDLHKSLEQKESKIQQLAETIKKLEKEFKQFAQLFGKNGSFLPNIQVFASHIDKSAWLEAQVHQLLQMVNQQQNKFDLRPLMEAVDTVKQKITLLENNDQRLAVLEEETNKHDTHINIHKAQLSKNEERFKLLEGTCYNGKLIWKVTDYKMKKREAVDGHTVSIFSQSFYTSRCGYRLCARAYLNGDGSGRGSHLSLYFVVMRGEFDSLLQWPFRQRVTLMLLDQSGKKNIMETFKPDPNSSSFKRPDGEMNIASGCPRFVAHSVLENAKNAYIKDDTLFLKVAVDLTDLEDL

SEQ ID NO: 89083 - protein, 557 aa, Homo sapiens; identical to SEQ ID NO: 89082
  Payload ID: 17833
  Gene Name: TNF receptor-associated factor 5
  Uniprot ID: O00463
  ENSP ID: ENSP00000336825

SEQ ID NO: 89084 - protein, 557 aa, Homo sapiens; identical to SEQ ID NO: 89082
  Payload ID: 17833
  Gene Name: TNF receptor-associated factor 5
  Uniprot ID: O00463
  ENSP ID: ENSP00000355971

SEQ ID NO: 89085 - protein, 522 aa, Homo sapiens
  Payload ID: 17834
  Gene Name: TNF receptor-associated factor 6, E3 ubiquitin protein ligase
  Uniprot ID: Q9Y4K3
  ENSP ID: ENSP00000337853
MSLLNCENSCGSSQSESDCCVAMASSCSAVTKDDSVGGTASTGNLSSSFMEEIQGYDVEFDPPLESKYECPICLMALREAVQTPCGHRFCKACIIKSIRDAGHKCPVDNEILLENQLFPDNFAKREILSLMVKCPNEGCLHKMELRHLEDHQAHCEFALMDCPQCQRPFQKFHINIHILKDCPRRQVSCDNCAASMAFEDKEIHDQNCPLANVICEYCNTILIREQMPNHYDLDCPTAPIPCTFSTFGCHEKMQRNHLARHLQENTQSHMRMLAQAVHSLSVIPDSGYISEVRNFQETIHQLEGRLVRQDHQIRELTAKMETQSMYVSELKRTIRTLEDKVAEIEAQQCNGIYIWKIGNFGMHLKCQEEEKPVVIHSPGFYTGKPGYKLCMRLHLQLPTAQRCANYISLFVHTMQGEYDSHLPWPFQGTIRLTILDQSEAPVRQNHEEIMDAKPELLAFQRPTIPRNPKGFGYVTFMHLEALRQRTFIKDDTLLVRCEVSTRFDMGSLRREGFQPRSTDAGV

SEQ ID NO: 89086 - protein, 522 aa, Homo sapiens; identical to SEQ ID NO: 89085
  Payload ID: 17834
  Gene Name: TNF receptor-associated factor 6, E3 ubiquitin protein ligase
  Uniprot ID: Q9Y4K3
  ENSP ID: ENSP00000433623

SEQ ID NO: 89087 - protein, 670 aa, Homo sapiens
  Payload ID: 17835
  Gene Name: TNF receptor-associated factor 7, E3 ubiquitin protein ligase
  Uniprot ID: Q6Q0C0
  ENSP ID: ENSP00000318944
MSSGKSARYNRFSGGPSNLPTPDVTTGTRMETTFGPAFSAVTTITKADGTSTYKQHCRTPSSSSTLAYSPRDEEDSMPPISTPRRSDSAISVRSLHSESSMSLRSTFSLPEEEEEPEPLVFAEQPSVKLCCQLCCSVFKDPVITTCGHTFCRRCALKSEKCPVDNVKLTVVVNNIAVAEQIGELFIHCRHGCRVAGSGKPPIFEVDPRGCPFTIKLSARKDHEGSCDYRPVRCPNNPSCPPLLRMNLEAHLKECEHIKCPHSKYGCTFIGNQDTYETHLETCRFEGLKEFLQQTDDRFHEMHVALAQKDQEIAFLRSMLGKLSEKIDQLEKSLELKFDVLDENQSKLSEDLMEFRRDASMLNDELSHINARLNMGILGSYDPQQIFKCKGTFVGHQGPVWCLCVYSMGDLLFSGSSDKTIKVWDTCTTYKCQKTLEGHDGIVLALCIQGCKLYSGSADCTIIVWDIQNLQKVNTIRAHDNPVCTLVSSHNVLFSGSLKAIKVWDIVGTELKLKKELTGLNHWVRALVAAQSYLYSGSYQTIKIWDIRTLDCIHVLQTSGGSVYSIAVTNHHIVCGTYENLIHVWDIESKEQVRTLTGHVGTVYALAVISTPDQTKVFSASYDRSLRVWSMDNMICTQTLLRHQGSVTALAVSRGRLFSGAVDSTVKVWTC

SEQ ID NO: 89088 - protein, 147 aa, Homo sapiens
  Payload ID: 17835
  Gene Name: TNF receptor-associated factor 7, E3 ubiquitin protein ligase
  ENSP ID: ENSP00000456034
MSSGKSARYNRFSGGPSNLPTPDVTTGTRMETTFGPAFSAVTTITKADGTSTYKQHCRTPSSSSTLAYSPRDEEDSMPPISTPRRSDSAISVRSLHSESSMSLRSTFSLPEEEEEPEPLVFAEQPSVKLCCQLCCSVFKDPVITTCG

SEQ ID NO: 89089 - protein, 54 aa, Homo sapiens
  Payload ID: 17835
  Gene Name: TNF receptor-associated factor 7, E3 ubiquitin protein ligase
  ENSP ID: ENSP00000457735
MSSGKSARYNRFSGGPSNLPTPDVTTGVSSVLPLDQNGNDLRTRLFSRHHHHKS

SEQ ID NO: 89090 - protein, 86 aa, Homo sapiens
  Payload ID: 17835
  Gene Name: TNF receptor-associated factor 7, E3 ubiquitin protein ligase
  ENSP ID: ENSP00000478515
MSSGKSARYNRFSGGPSNLPTPDVTTGTRMETTFGPAFSAVTTITKADGTSTYKQHCRTPSSSSTLAYSPRDEEDSMVGPYPQEPV

SEQ ID NO: 89091 - protein, 54 aa, Homo sapiens; identical to SEQ ID NO: 89089
  Payload ID: 17835
  Gene Name: TNF receptor-associated factor 7, E3 ubiquitin protein ligase
  ENSP ID: ENSP00000479297

SEQ ID NO: 89092 - protein, 704 aa, Homo sapiens
  Payload ID: 17836
  Gene Name: TNF receptor-associated protein 1
  Uniprot ID: Q12931
  ENSP ID: ENSP00000246957
MARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 89093 - protein, 651 aa, Homo sapiens
  Payload ID: 17836
  Gene Name: TNF receptor-associated protein 1
  Uniprot ID: Q12931
  ENSP ID: ENSP00000442070
MARELRALLLWGRRLRPLLRAPALAAVPGGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 89094 - protein, 495 aa, Homo sapiens
  Payload ID: 17836
  Gene Name: TNF receptor-associated protein 1
  ENSP ID: ENSP00000458166
MVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 89095 - protein, 35 aa, Homo sapiens
  Payload ID: 17836
  Gene Name: TNF receptor-associated protein 1
  ENSP ID: ENSP00000458244
MEIHLQTNAEKGTITIQDTGIGMTQEELVSNLGTI

SEQ ID NO: 89096 - protein, 215 aa, Homo sapiens
  Payload ID: 17836
  Gene Name: TNF receptor-associated protein 1
  ENSP ID: ENSP00000459354
SLYSEKEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIK

SEQ ID NO: 89097 - protein, 59 aa, Homo sapiens
  Payload ID: 17836
  Gene Name: TNF receptor-associated protein 1
  ENSP ID: ENSP00000459385
  MOD_RES (1)..(1): Any amino acid
XRHALIKKLNQLRASEPGLAQLLVDQIYENAMIAAGLVDDPRAMVGRLNELLVKALERH

SEQ ID NO: 89098 - protein, 108 aa, Homo sapiens
  Payload ID: 17836
  Gene Name: TNF receptor-associated protein 1
  ENSP ID: ENSP00000459585
  MOD_RES (1)..(1): Any amino acid
XADRVEVYSRSAAPGSLGYQWLSDGSGVFEIAEASGVRTGTKIIIHLKSDCKEFSSEARVRDVVTKYSNFVSFPLYLNGRRMNTLQEPVQGQALHWLRPARWWRRRAW

SEQ ID NO: 89099 - protein, 86 aa, Homo sapiens
  Payload ID: 17836
  Gene Name: TNF receptor-associated protein 1
  ENSP ID: ENSP00000460545
MARELRALLLWGRRLRPLLRAPALAAVPGGKPILCPRRTTAQLGPRRNPAWSLQAGRLFSTQTAEDKEEPLHSIISSTESVQGRVL

SEQ ID NO: 89100 - protein, 37 aa, Homo sapiens
  Payload ID: 17836
  Gene Name: TNF receptor-associated protein 1
  ENSP ID: ENSP00000461354
MARELRALLLWGRRLRPLLRAPALAAVPGGSRRAIEM

SEQ ID NO: 89101 - protein, 37 aa, Homo sapiens; identical to SEQ ID NO: 89100
  Payload ID: 17836
  Gene Name: TNF receptor-associated protein 1
  ENSP ID: ENSP00000461618

SEQ ID NO: 89102 - protein, 636 aa, Homo sapiens
  Payload ID: 17837
  Gene Name: TNFAIP3 interacting protein 1
  Uniprot ID: Q15025
  ENSP ID: ENSP00000317891
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPESPKNDREGPQ

SEQ ID NO: 89103 - protein, 619 aa, Homo sapiens
  Payload ID: 17837
  Gene Name: TNFAIP3 interacting protein 1
  ENSP ID: ENSP00000374029
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLHQFCRSRNTPGVYPVEGFEIQIRAPK

SEQ ID NO: 89104 - protein, 492 aa, Homo sapiens
  Payload ID: 17837
  Gene Name: TNFAIP3 interacting protein 1
  ENSP ID: ENSP00000427854
MEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKGTHRGCPRHLPERKVK

SEQ ID NO: 89105 - protein, 636 aa, Homo sapiens; identical to SEQ ID NO: 89102
  Payload ID: 17837
  Gene Name: TNFAIP3 interacting protein 1
  Uniprot ID: Q15025
  ENSP ID: ENSP00000428187

SEQ ID NO: 89106 - protein, 635 aa, Homo sapiens
  Payload ID: 17837
  Gene Name: TNFAIP3 interacting protein 1
  Uniprot ID: Q15025
  ENSP ID: ENSP00000428243
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPEPADLRLPRN

SEQ ID NO: 89107 - protein, 133 aa, Homo sapiens
  Payload ID: 17837
  Gene Name: TNFAIP3 interacting protein 1
  ENSP ID: ENSP00000428404
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQ

SEQ ID NO: 89108 - protein, 257 aa, Homo sapiens
  Payload ID: 17837
  Gene Name: TNFAIP3 interacting protein 1
  ENSP ID: ENSP00000428487
MEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQR

SEQ ID NO: 89109 - protein, 583 aa, Homo sapiens
  Payload ID: 17837
  Gene Name: TNFAIP3 interacting protein 1
  Uniprot ID: Q15025
  ENSP ID: ENSP00000429891
MEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKASGERYHVEPHPEHLCGAYPYAYPPMPAMVPHHGFEDWSQIRYPPPPMAMEHPPPLPNSRLFHLPEYTWRLPCGGVRNPNQSSQVMDPPTARPTEPESPKNDREGPQ

SEQ ID NO: 89110 - protein, 556 aa, Homo sapiens
  Payload ID: 17837
  Gene Name: TNFAIP3 interacting protein 1
  Uniprot ID: Q15025
  ENSP ID: ENSP00000429912
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKSLQKMTVRGLSETRLCHLAPPSSCRAS

SEQ ID NO: 89111 - protein, 143 aa, Homo sapiens
  Payload ID: 17837
  Gene Name: TNFAIP3 interacting protein 1
  ENSP ID: ENSP00000430279
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHAN

SEQ ID NO: 89112 - protein, 146 aa, Homo sapiens
  Payload ID: 17837
  Gene Name: TNFAIP3 interacting protein 1
  ENSP ID: ENSP00000430739
AKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAMPATSAEGRQPEAARP

SEQ ID NO: 89113 - protein, 636 aa, Homo sapiens; identical to SEQ ID NO: 89102
  Payload ID: 17837
  Gene Name: TNFAIP3 interacting protein 1
  Uniprot ID: Q15025
  ENSP ID: ENSP00000430760

SEQ ID NO: 89114 - protein, 635 aa, Homo sapiens; identical to SEQ ID NO: 89106
  Payload ID: 17837
  Gene Name: TNFAIP3 interacting protein 1
  Uniprot ID: Q15025
  ENSP ID: ENSP00000430971

SEQ ID NO: 89115 - protein, 572 aa, Homo sapiens
  Payload ID: 17837
  Gene Name: TNFAIP3 interacting protein 1
  Uniprot ID: Q15025
  ENSP ID: ENSP00000431105
MEGRGPYRIYDPGGSVPSGEASAAFERLVKENSRLKEKMQGIKMLGELLEESQMEATRLRQKAEELVKDNELLPPPSPSLGSFDPLAELTGKDSNVTASPTAPACPSDKPAPVQKPPSSGTSSEFEVVTPEEQNSPESSSHANAMALGPLPREDGNLMLHLQRLETTLSVCAEEPDHGQLFTHLGRMALEFNRLASKVHKNEQRTSILQTLCEQLRKENEALKAKLDKGLEQRDQAAERLREENLELKKLLMSNGNKEGASGRPGSPKMEGTGKKAVAGQQQASVTAGKVPEVVALGAAEKKVKMLEQQRSELLEVNKQWDQHFRSMKQQYEQKITELRQKLADLQKQVTDLEAEREQKQRDFDRKLLLAKSKIEMEETDKEQLTAEAKELRQKVKYLQDQLSPLTRQREYQEKEIQRLNKALEEALSIQTPPSSPPTAFGSPEGAGALLRKQELVTQNELLKQQVKIFEEDFQRERSDRERMNEEKEELKKQVEKLQAQVTLSNAQLKAFKDEEKAREALRQQKRKAKPEYTWRLPCGGVRNPNQSSQVMDPPTARPTEPESPKNDREGPQ

SEQ ID NO: 89116 - protein, 572 aa, Homo sapiens; identical to SEQ ID NO: 89115
  Payload ID: 17837
  Gene Name: TNFAIP3 interacting protein 1
  Uniprot ID: Q15025
  ENSP ID: ENSP00000483944

SEQ ID NO: 89117 - protein, 556 aa, Homo sapiens; identical to SEQ ID NO: 89110
  Payload ID: 17837
  Gene Name: TNFAIP3 interacting protein 1
  Uniprot ID: Q15025
  ENSP ID: ENSP00000484665

SEQ ID NO: 89118 - protein, 429 aa, Homo sapiens
  Payload ID: 17838
  Gene Name: TNFAIP3 interacting protein 2
  Uniprot ID: Q8NFZ5
  ENSP ID: ENSP00000321203
MSRDPGSGGWEEAPRAAAALCTLYHEAGQRLRRLQDQLAARDALIARLRARLAALEGDAAPSLVDALLEQVARFREQLRRQEGGAAEAQMRQEIERLTERLEEKEREMQQLLSQPQHEREKEVVLLRRSMAEGERARAASDVLCRSLANETHQLRRTLTATAHMCQHLAKCLDERQHAQRNVGERSPDQSEHTDGHTSVQSVIEKLQEENRLLKQKVTHVEDLNAKWQRYNASRDEYVRGLHAQLRGLQIPHEPELMRKEISRLNRQLEEKINDCAEVKQELAASRTARDAALERVQMLEQQILAYKDDFMSERADRERAQSRIQELEEKVASLLHQVSWRQDSREPDAGRIHAGSKTAKYLAADALELMVPGGWRPGTGSQQPEPPAEGGHPGAAQRGQGDLQCPHCLQCFSDEQGEELLRHVAECCQ

SEQ ID NO: 89119 - protein, 346 aa, Homo sapiens
  Payload ID: 17838
  Gene Name: TNFAIP3 interacting protein 2
  ENSP ID: ENSP00000426314
MSRDPGSGGWEEAPRAAAALCTLYHEAGQRLRRLQDQLAARDALIARLRARLAALEGDAAPSLVDALLEQVARFREQLRRQEGGAAEAQMRQEIERLTERLEEKEREMQQLLSQPQHEREKEVVLLRRSMAEGERARAASDVLCRSLANETHQLRRTLTATAHMCQHLAKCLDERQHAQRNVGERSPDQSEHTDGHTSVQSVIEKLQEENRLLKQKVTHILAYKDDFMSERADRERAQSRIQELEEKVASLLHQVSWRQDSREPDAGRIHAGSKTAKYLAADALELMVPGGWRPGTGSQQPEPPAEGGHPGAAQRGQGDLQCPHCLQCFSDEQGEELLRHVAECCQ

SEQ ID NO: 89120 - protein, 322 aa, Homo sapiens
  Payload ID: 17838
  Gene Name: TNFAIP3 interacting protein 2
  Uniprot ID: Q8NFZ5
  ENSP ID: ENSP00000427613
MQQLLSQPQHEREKEVVLLRRSMAEGERARAASDVLCRSLANETHQLRRTLTATAHMCQHLAKCLDERQHAQRNVGERSPDQSEHTDGHTSVQSVIEKLQEENRLLKQKVTHVEDLNAKWQRYNASRDEYVRGLHAQLRGLQIPHEPELMRKEISRLNRQLEEKINDCAEVKQELAASRTARDAALERVQMLEQQILAYKDDFMSERADRERAQSRIQELEEKVASLLHQVSWRQDSREPDAGRIHAGSKTAKYLAADALELMVPGGWRPGTGSQQPEPPAEGGHPGAAQRGQGDLQCPHCLQCFSDEQGEELLRHVAECCQ

SEQ ID NO: 89121 - protein, 325 aa, Homo sapiens
  Payload ID: 17839
  Gene Name: TNFAIP3 interacting protein 3
  Uniprot ID: Q96KP6
  ENSP ID: ENSP00000057513
MAHFVQGTSRMIAAESSTEHKECAEPSTRKNLMNSLEQKIRCLEKQRKELLEVNQQWDQQFRSMKELYERKVAELKTKLDAAERFLSTREKDPHQRQRKDDRQREDDRQRDLTRDRLQREEKEKERLNEELHELKEENKLLKGKNTLANKEKEHYECEIKRLNKALQDALNIKCSFSEDCLRKSRVEFCHEEMRTEMEVLKQQVQIYEEDFKKERSDRERLNQEKEELQQINETSQSQLNRLNSQIKACQMEKEKLEKQLKQMYCPPCNCGLVFHLQDPWVPTGPGAVQKQREHPPDYQWYALDQLPPDVQHKANGLSSVKKVHP

SEQ ID NO: 89122 - protein, 86 aa, Homo sapiens
  Payload ID: 17839
  Gene Name: TNFAIP3 interacting protein 3
  ENSP ID: ENSP00000424284
CNCGLVFHLQDPWVPTGPGAVQKQREHPPDYQWYALDQLPPDVQHKANESAILSTACFYGLVRPPRSGLYKLSYNQNPTSILIKYT

SEQ ID NO: 89123 - protein, 376 aa, Homo sapiens
  Payload ID: 17839
  Gene Name: TNFAIP3 interacting protein 3
  Uniprot ID: Q96KP6
  ENSP ID: ENSP00000426613
MIPCGWLMNKNEKHDDKLVMFTNQSEDSERCESMELDKKIQDLIERNASPHPKRFTPEAMPTHRNLCSLKTPGKTASMAHFVQGTSRMIAAESSTEHKECAEPSTRKNLMNSLEQKIRCLEKQRKELLEVNQQWDQQFRSMKELYERKVAELKTKLDAAERFLSTREKDPHQRQRKDDRQREDDRQRDLTRDRLQREEKEKERLNEELHELKEENKLLKGKNTLANKEKEHYECEIKRLNKALQDALNIKCSFSEDCLRKSRVEFCHEEMRTEMEVLKQQVQIYEEDFKKERSDRERLNQEKEELQQINETSQSQLNRLNSQIKACQMEKEKLEKQLKQMYCPPCNCGLVFHLQDPWVPTGPGAVQKQREHPVYPQ

SEQ ID NO: 89124 - protein, 369 aa, Homo sapiens
  Payload ID: 17839
  Gene Name: TNFAIP3 interacting protein 3
  Uniprot ID: Q96KP6
  ENSP ID: ENSP00000427106
MNKNEKHDDKLVMFTNQSEDSERCESMELDKKIQDLIERNASPHPKRFTPEAMPTHRNLCSLKTPGKTASMAHFVQGTSRMIAAESSTEHKECAEPSTRKNLMNSLEQKIRCLEKQRKELLEVNQQWDQQFRSMKELYERKVAELKTKLDAAERFLSTREKDPHQRQRKDDRQREDDRQRDLTRDRLQREEKEKERLNEELHELKEENKLLKGKNTLANKEKEHYECEIKRLNKALQDALNIKCSFSEDCLRKSRVEFCHEEMRTEMEVLKQQVQIYEEDFKKERSDRERLNQEKEELQQINETSQSQLNRLNSQIKACQMEKEKLEKQLKQMYCPPCNCGLVFHLQDPWVPTGPGAVQKQREHPVYPQ

SEQ ID NO: 89125 - protein, 312 aa, Homo sapiens
  Payload ID: 17840
  Gene Name: TNFRSF1A-associated via death domain
  Uniprot ID: Q15628
  ENSP ID: ENSP00000341268
MAAGQNGHEEWVGSAYLFVESSLDKVVLSDAYAHPQQKVAVYRALQAALAESGGSPDVLQMLKIHRSDPQLIVQLRFCGRQPCGRFLRAYREGALRAALQRSLAAALAQHSVPLQLELRAGAERLDALLADEERCLSCILAQQPDRLRDEELAELEDALRNLKCGSGARGGDGEVASAPLQPPVPSLSEVKPPPPPPPAQTFLFQGQPVVNRPLSLKDQQTFARSVGLKWRKVGRSLQRGCRALRDPALDSLAYEYEREGLYEQAFQLLRRFVQAEGRRATLQRLVEALEENELTSLAEDLLGLTDPNGGLA

SEQ ID NO: 89126 - protein, 252 aa, Homo sapiens
  Payload ID: 17840
  Gene Name: TNFRSF1A-associated via death domain
  Uniprot ID: Q15628
  ENSP ID: ENSP00000462591
MLKIHRSDPQLIVQLRFCGRQPCGRFLRAYREGALRAALQRSLAAALAQHSVPLQLELRAGAERLDALLADEERCLSCILAQQPDRLRDEELAELEDALRNLKCGSGARGGDGEVASAPLQPPVPSLSEVKPPPPPPPAQTFLFQGQPVVNRPLSLKDQQTFARSVGLKWRKVGRSLQRGCRALRDPALDSLAYEYEREGLYEQAFQLLRRFVQAEGRRATLQRLVEALEENELTSLAEDLLGLTDPNGGLA

SEQ ID NO: 89127 - protein, 330 aa, Homo sapiens
  Payload ID: 17841
  Gene Name: TNFSF12-TNFSF13 readthrough
  ENSP ID: ENSP00000293826
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 89128 - protein, 835 aa, Homo sapiens
  Payload ID: 17842
  Gene Name: TNNI3 interacting kinase
  Uniprot ID: Q59H18
  ENSP ID: ENSP00000322251
MGNYKSRPTQTCTDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDPSRSSGEKDEQTCLMWAYEKGHDAIVTLLKHYKRPQDELPCNEYSQPGGDGSYVSVPSPLGKIKSMTKEKADILLLRAGLPSHFHLQLSEIEFHEIIGSGSFGKVYKGRCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNSHNILLYEDGHAVVADFGESRFLQSLDEDNMTKQPGNLRWMAPEVFTQCTRYTIKADVFSYALCLWEILTGEIPFAHLKPAAAAADMAYHHIRPPIGYSIPKPISSLLIRGWNACPEGRPEFSEVVMKLEECLCNIELMSPASSNSSGSLSPSSSSDCLVNRGGPGRSHVAALRSRFELEYALNARSYAALSQSAGQYSSQGLSLEEMKRSLQYTPIDKYGYVSDPMSSMHFHSCRNSSSFEDSS

SEQ ID NO: 89129 - protein, 150 aa, Homo sapiens
  Payload ID: 17842
  Gene Name: TNNI3 interacting kinase
  ENSP ID: ENSP00000431465
  MOD_RES (1)..(1): Any amino acid
XHFHLQLSEIEFHEIIGSGSFGKVYKGRCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNRCCTGWLSCYHPD

SEQ ID NO: 89130 - protein, 113 aa, Homo sapiens
  Payload ID: 17842
  Gene Name: TNNI3 interacting kinase
  ENSP ID: ENSP00000433550
  MOD_RES (1)..(1): Any amino acid
XCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNRAS

SEQ ID NO: 89131 - protein, 188 aa, Homo sapiens
  Payload ID: 17842
  Gene Name: TNNI3 interacting kinase
  ENSP ID: ENSP00000434975
VYKGRCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNRSAITSRIWITHSICIWRGAHYFNREECNFRCMLTSAILKESRFLQSLDEDNMTKQPGNLRWMAPEVFTQCTRY

SEQ ID NO: 89132 - protein, 278 aa, Homo sapiens
  Payload ID: 17843
  Gene Name: tocopherol (alpha) transfer protein
  Uniprot ID: P49638
  ENSP ID: ENSP00000260116
MAEARSQPSAGPQLNALPDHSPLLQPGLAALRRRAREAGVPLAPLPLTDSFLLRFLRARDFDLDLAWRLLKNYYKWRAECPEISADLHPRSIIGLLKAGYHGVLRSRDPTGSKVLIYRIAHWDPKVFTAYDVFRVSLITSELIVQEVETQRNGIKAIFDLEGWQFSHAFQITPSVAKKIAAVLTDSFPLKVRGIHLINEPVIFHAVFSMIKPFLTEKIKERIHMHGNNYKQSLLQHFPDILPLEYGGEEFSMEDICQEWTNFIMKSEDYLSSISESIQ

SEQ ID NO: 89133 - protein, 342 aa, Homo sapiens
  Payload ID: 17844
  Gene Name: tocopherol (alpha) transfer protein-like
  Uniprot ID: Q9BTX7
  ENSP ID: ENSP00000262605
MSEESDSLRTSPSVASLSENELPPPPEPPGYVCSLTEDLVTKAREELQEKPEWRLRDVQALRDMVRKEYPNLSTSLDDAFLLRFLRARKFDYDRALQLLVNYHSCRRSWPEVFNNLKPSALKDVLASGFLTVLPHTDPRGCHVVCIRPDRWIPSNYPITENIRAIYLTLEKLIQSEETQVNGIVILADYKGVSLSKASHFGPFIAKKVIGILQDGFPIRIKAVHVVNEPRIFKGIFAIIKPFLKEKIANRFFLHGSDLNSLHTNLPRSILPKEYGGTAGELDTATWNAVLLASEDDFVKEFCQPVPACDSILGQTLLPEGLTSDAQCDDSLRAVKSQLYSCY

SEQ ID NO: 89134 - protein, 342 aa, Homo sapiens; identical to SEQ ID NO: 89133
  Payload ID: 17844
  Gene Name: tocopherol (alpha) transfer protein-like
  Uniprot ID: Q9BTX7
  ENSP ID: ENSP00000361995

SEQ ID NO: 89135 - protein, 154 aa, Homo sapiens
  Payload ID: 17844
  Gene Name: tocopherol (alpha) transfer protein-like
  ENSP ID: ENSP00000361997
MSEESDSLRTSPSVASLSENELPPPPEPPGYVCSLTEDLVTKAREELQEKPEWRLRDVQALRDMVRKEYPNLSTSLDDAFLLRFLRARKFDYDRALQLLVNYHSCRRSWPEVFNNLKPSALKDVLASGFLTVLPHTDPRGCHVVCIRPVLPPWV

SEQ ID NO: 89136 - protein, 279 aa, Homo sapiens
  Payload ID: 17844
  Gene Name: tocopherol (alpha) transfer protein-like
  ENSP ID: ENSP00000412720
MSEESDSLRTSPSVASLSENELPPPPEPPGYVCSLTEDLVTKAREELQEKPEWRLRDVQALRDMVRKEYPNLSTSLDDAFLLRFLRARKFDYDRALQLLVNYHSCRRSWPEVFNNLKPSALKDVLASGFLTVLPHTDPRGCHVVCIRPDRWIPSNYPITENIRAIYLTLEKLIQSEETQDGFPIRIKAVHVVNEPRIFKGIFAIIKPFLKEKIANRFFLHGSDLNSLHTNLPRSILPKEYGGTAGELDTATWNAVLLASEDDFVKEFCQPVPACDSILG

SEQ ID NO: 89137 - protein, 246 aa, Homo sapiens
  Payload ID: 17845
  Gene Name: toll interacting protein
  ENSP ID: ENSP00000263646
MATTVQLDAQAAQQLQYGGAVGTVGRLNITVVQAKLAKNYGMTRMDPYCRLRLGYAVYETPTAHNGAKNPRWNKVIHCTVPPGVDSFYLEIFDERAFSMDDRIAWTHITIPESLRQGKVEDKWYSLSGRQGDDKEGMINLVMSYALLPAAMVMPPQPVVLMPTVYQQGVGYVPITGMPAVCSPGMVPVALPPAAVNAQPRCSEEDLKAIQDMFPNMDQEVIRSVLEAQRGNKDAAINSLLQMGEEP

SEQ ID NO: 89138 - protein, 274 aa, Homo sapiens
  Payload ID: 17845
  Gene Name: toll interacting protein
  Uniprot ID: Q9H0E2
  ENSP ID: ENSP00000314733
MATTVSTQRGPVYIGELPQDFLRITPTQQQRQVQLDAQAAQQLQYGGAVGTVGRLNITVVQAKLAKNYGMTRMDPYCRLRLGYAVYETPTAHNGAKNPRWNKVIHCTVPPGVDSFYLEIFDERAFSMDDRIAWTHITIPESLRQGKVEDKWYSLSGRQGDDKEGMINLVMSYALLPAAMVMPPQPVVLMPTVYQQGVGYVPITGMPAVCSPGMVPVALPPAAVNAQPRCSEEDLKAIQDMFPNMDQEVIRSVLEAQRGNKDAAINSLLQMGEEP

SEQ ID NO: 89139 - protein, 213 aa, Homo sapiens
  Payload ID: 17845
  Gene Name: toll interacting protein
  ENSP ID: ENSP00000432668
MATTVSTQRGPVYIGELPQDFLRITPTQQQRQVQLDAQAAQQLQYGGAVGTVGRLNITVVQRAFSMDDRIAWTHITIPESLRQGKVEDKWYSLSGRQGDDKEGMINLVMSYALLPAAMVMPPQPVVLMPTVYQQGVGYVPITGMPAVCSPGMVPVALPPAAVNAQPRCSEEDLKAIQDMFPNMDQEVIRSVLEAQRGNKDAAINSLLQMGEEP

SEQ ID NO: 89140 - protein, 80 aa, Homo sapiens
  Payload ID: 17845
  Gene Name: toll interacting protein
  ENSP ID: ENSP00000432778
MATTVSTQRGPVYIGELPQDFLRITPTQQQRQVQLDAQAAQQLQYGGAVGTVGRLNITVVQGCPLSVAPAWCPWPCPRPP

SEQ ID NO: 89141 - protein, 205 aa, Homo sapiens
  Payload ID: 17845
  Gene Name: toll interacting protein
  Uniprot ID: Q9H0E2
  ENSP ID: ENSP00000434035
MTRMDPYCRLRLGYAVYETPTAHNGAKNPRWNKVIHCTVPPGVDSFYLEIFDERAFSMDDRIAWTHITIPESLRQGKVEDKWYSLSGRQGDDKEGMINLVMSYALLPAAMVMPPQPVVLMPTVYQQGVGYVPITGMPAVCSPGMVPVALPPAAVNAQPRCSEEDLKAIQDMFPNMDQEVIRSVLEAQRGNKDAAINSLLQMGEEP

SEQ ID NO: 89142 - protein, 186 aa, Homo sapiens
  Payload ID: 17845
  Gene Name: toll interacting protein
  ENSP ID: ENSP00000434494
MATTVSTQRGPAKLAKNYGMTRMDPYCRLRLGYAVYETPTAHNGAKNPRWNKVIHCTVPPGVDSFYLEIFDERAFSMDDRIAWTHITIPESLRQGKVEDKWYSLSGRQGDDKEGMINLVMSYALLPAAMVMPPQPVVLMPTVYQQGVGYVPITGMPAVCSPGMVPVALPPAAVNAQPRCSEEDLKA

SEQ ID NO: 89143 - protein, 179 aa, Homo sapiens
  Payload ID: 17845
  Gene Name: toll interacting protein
  ENSP ID: ENSP00000436393
MATTVSTQRGPAKLAKNYGMTRMDPYCRLRLGYAVYETPTAHNGAKNPRWNKVIHCTVPPGVDSFYLEIFDERAFSMDDRIAWTHITIPESLRQGKVEDKWYSLSGRQGDDKEGMINLVMSYALLPAAMVMPPQPVVLMPTVYQQGVGYVPITDIVNFGTAPHFIEKFPRRCRNICQSL

SEQ ID NO: 89144 - protein, 235 aa, Homo sapiens
  Payload ID: 17846
  Gene Name: toll-interleukin 1 receptor (TIR) domain containing adaptor protein
  Uniprot ID: P58753
  ENSP ID: ENSP00000376445
MASSTSLPAPGSRPKKPLGKMADWFRQTLLKKPKKRPNSPESTSSDASQPTSQDSPLPPSLSSVTSPSLPPTHASDSGSSRWSKDYDVCVCHSEEDLVAAQDLVSYLEGSTASLRCFLQLRDATPGGAIVSELCQALSSSHCRVLLITPGFLQDPWCKYQMLQALTEAPGAEGCTIPLLSGLSRAAYPPELRFMYYVDGRGPDGGFRQVKEAVMRCKLLQEGEGERDSATVSDLL

SEQ ID NO: 89145 - protein, 221 aa, Homo sapiens
  Payload ID: 17846
  Gene Name: toll-interleukin 1 receptor (TIR) domain containing adaptor protein
  Uniprot ID: P58753
  ENSP ID: ENSP00000376446
MASSTSLPAPGSRPKKPLGKMADWFRQTLLKKPKKRPNSPESTSSDASQPTSQDSPLPPSLSSVTSPSLPPTHASDSGSSRWSKDYDVCVCHSEEDLVAAQDLVSYLEGSTASLRCFLQLRDATPGGAIVSELCQALSSSHCRVLLITPGFLQDPWCKYQMLQALTEAPGAEGCTIPLLSGLSRAAYPPELRFMYYVDGRGPDGGFRQVKEAVMRYLQTLS

SEQ ID NO: 89146 - protein, 221 aa, Homo sapiens; identical to SEQ ID NO: 89145
  Payload ID: 17846
  Gene Name: toll-interleukin 1 receptor (TIR) domain containing adaptor protein
  Uniprot ID: P58753
  ENSP ID: ENSP00000376447

SEQ ID NO: 89147 - protein, 221 aa, Homo sapiens; identical to SEQ ID NO: 89145
  Payload ID: 17846
  Gene Name: toll-interleukin 1 receptor (TIR) domain containing adaptor protein
  Uniprot ID: P58753
  ENSP ID: ENSP00000436967

SEQ ID NO: 89148 - protein, 49 aa, Homo sapiens
  Payload ID: 17846
  Gene Name: toll-interleukin 1 receptor (TIR) domain containing adaptor protein
  ENSP ID: ENSP00000446213
MASSTSLPAPGSRPKKPLGKMADWFRQTLLKKPKKRPGSLTYLTLHYLS

SEQ ID NO: 89149 - protein, 786 aa, Homo sapiens
  Payload ID: 17847
  Gene Name: toll-like receptor 1
  Uniprot ID: Q15399
  ENSP ID: ENSP00000354932
MTSIFHFAIIFMLILQIRIQLSEESEFLVDRSKNGLIHVPKDLSQKTTILNISQNYISELWTSDILSLSKLRILIISHNRIQYLDISVFKFNQELEYLDLSHNKLVKISCHPTVNLKHLDLSFNAFDALPICKEFGNMSQLKFLGLSTTHLEKSSVLPIAHLNISKVLLVLGETYGEKEDPEGLQDFNTESLHIVFPTNKEFHFILDVSVKTVANLELSNIKCVLEDNKCSYFLSILAKLQTNPKLSNLTLNNIETTWNSFIRILQLVWHTTVWYFSISNVKLQGQLDFRDFDYSGTSLKALSIHQVVSDVFGFPQSYIYEIFSNMNIKNFTVSGTRMVHMLCPSKISPFLHLDFSNNLLTDTVFENCGHLTELETLILQMNQLKELSKIAEMTTQMKSLQQLDISQNSVSYDEKKGDCSWTKSLLSLNMSSNILTDTIFRCLPPRIKVLDLHSNKIKSIPKQVVKLEALQELNVAFNSLTDLPGCGSFSSLSVLIIDHNSVSHPSADFFQSCQKMRSIKAGDNPFQCTCELGEFVKNIDQVSSEVLEGWPDSYKCDYPESYRGTLLKDFHMSELSCNITLLIVTIVATMLVLAVTVTSLCSYLDLPWYLRMVCQWTQTRRRARNIPLEELQRNLQFHAFISYSGHDSFWVKNELLPNLEKEGMQICLHERNFVPGKSIVENIITCIEKSYKSIFVLSPNFVQSEWCHYELYFAHHNLFHEGSNSLILILLEPIPQYSIPSSYHKLKSLMARRTYLEWPKEKSKRGLFWANLRAAINIKLTEQAKK

SEQ ID NO: 89150 - protein, 786 aa, Homo sapiens; identical to SEQ ID NO: 89149
  Payload ID: 17847
  Gene Name: toll-like receptor 1
  Uniprot ID: Q15399
  ENSP ID: ENSP00000421259

SEQ ID NO: 89151 - protein, 161 aa, Homo sapiens
  Payload ID: 17847
  Gene Name: toll-like receptor 1
  ENSP ID: ENSP00000421856
MTSIFHFAIIFMLILQIRIQLSEESEFLVDRSKNGLIHVPKDLSQKTTILNISQNYISELWTSDILSLSKLRILIISHNRIQYLDISVFKFNQELEYLDLSHNKLVKISCHPTVNLKHLDLSFNAFDALPICKEFGNMSQLKFLGLSTTHLEKSSVLPIAH

SEQ ID NO: 89152 - protein, 90 aa, Homo sapiens
  Payload ID: 17847
  Gene Name: toll-like receptor 1
  ENSP ID: ENSP00000423017
MTSIFHFAIIFMLILQIRIQLSEESEFLVDRSKNGLIHVPKDLSQKTTILNISQNYISELWTSDILSLSKLRILIISHNRIQYLDISVFK

SEQ ID NO: 89153 - protein, 48 aa, Homo sapiens
  Payload ID: 17847
  Gene Name: toll-like receptor 1
  ENSP ID: ENSP00000423725
MTSIFHFAIIFMLILQIRIQLSEESEFLVDRSKNGLIHVPKDLSQKTT

SEQ ID NO: 89154 - protein, 23 aa, Homo sapiens
  Payload ID: 17847
  Gene Name: toll-like receptor 1
  ENSP ID: ENSP00000424894
MTSIFHFAIIFMLILQIRIQLSE

SEQ ID NO: 89155 - protein, 811 aa, Homo sapiens
  Payload ID: 17848
  Gene Name: toll-like receptor 10
  Uniprot ID: Q9BXR5
  ENSP ID: ENSP00000308925
MRLIRNIYIFCSIVMTAEGDAPELPEERELMTNCSNMSLRKVPADLTPATTTLDLSYNLLFQLQSSDFHSVSKLRVLILCHNRIQQLDLKTFEFNKELRYLDLSNNRLKSVTWYLLAGLRYLDLSFNDFDTMPICEEAGNMSHLEILGLSGAKIQKSDFQKIAHLHLNTVFLGFRTLPHYEEGSLPILNTTKLHIVLPMDTNFWVLLRDGIKTSKILEMTNIDGKSQFVSYEMQRNLSLENAKTSVLLLNKVDLLWDDLFLILQFVWHTSVEHFQIRNVTFGGKAYLDHNSFDYSNTVMRTIKLEHVHFRVFYIQQDKIYLLLTKMDIENLTISNAQMPHMLFPNYPTKFQYLNFANNILTDELFKRTIQLPHLKTLILNGNKLETLSLVSCFANNTPLEHLDLSQNLLQHKNDENCSWPETVVNMNLSYNKLSDSVFRCLPKSIQILDLNNNQIQTVPKETIHLMALRELNIAFNFLTDLPGCSHFSRLSVLNIEMNFILSPSLDFVQSCQEVKTLNAGRNPFRCTCELKNFIQLETYSEVMMVGWSDSYTCEYPLNLRGTRLKDVHLHELSCNTALLIVTIVVIMLVLGLAVAFCCLHFDLPWYLRMLGQCTQTWHRVRKTTQEQLKRNVRFHAFISYSEHDSLWVKNELIPNLEKEDGSILICLYESYFDPGKSISENIVSFIEKSYKSIFVLSPNFVQNEWCHYEFYFAHHNLFHENSDHIILILLEPIPFYCIPTRYHKLKALLEKKAYLEWPKDRRKCGLFWANLRAAINVNVLATREMYELQTFTELNEESRGSTISLMRTDCL

SEQ ID NO: 89156 - protein, 811 aa, Homo sapiens; identical to SEQ ID NO: 89155
  Payload ID: 17848
  Gene Name: toll-like receptor 10
  Uniprot ID: Q9BXR5
  ENSP ID: ENSP00000354459

SEQ ID NO: 89157 - protein, 811 aa, Homo sapiens; identical to SEQ ID NO: 89155
  Payload ID: 17848
  Gene Name: toll-like receptor 10
  Uniprot ID: Q9BXR5
  ENSP ID: ENSP00000421483

SEQ ID NO: 89158 - protein, 811 aa, Homo sapiens; identical to SEQ ID NO: 89155
  Payload ID: 17848
  Gene Name: toll-like receptor 10
  Uniprot ID: Q9BXR5
  ENSP ID: ENSP00000424923

SEQ ID NO: 89159 - protein, 94 aa, Homo sapiens
  Payload ID: 17848
  Gene Name: toll-like receptor 10
  ENSP ID: ENSP00000427606
MTAEGDAPELPEERELMTNCSNMSLRKVPADLTPATTTLDLSYNLLFQLQSSDFHSVSKLRVLILCHNRIQQLDLKTFEFNKELRYLDLSNNRL

SEQ ID NO: 89160 - protein, 811 aa, Homo sapiens; identical to SEQ ID NO: 89155
  Payload ID: 17848
  Gene Name: toll-like receptor 10
  Uniprot ID: Q9BXR5
  ENSP ID: ENSP00000478206

SEQ ID NO: 89161 - protein, 811 aa, Homo sapiens; identical to SEQ ID NO: 89155
  Payload ID: 17848
  Gene Name: toll-like receptor 10
  Uniprot ID: Q9BXR5
  ENSP ID: ENSP00000478985

SEQ ID NO: 89162 - protein, 784 aa, Homo sapiens
  Payload ID: 17849
  Gene Name: toll-like receptor 2
  Uniprot ID: O60603
  ENSP ID: ENSP00000260010
MPHTLWMVWVLGVIISLSKEESSNQASLSCDRNGICKGSSGSLNSIPSGLTEAVKSLDLSNNRITYISNSDLQRCVNLQALVLTSNGINTIEEDSFSSLGSLEHLDLSYNYLSNLSSSWFKPLSSLTFLNLLGNPYKTLGETSLFSHLTKLQILRVGNMDTFTKIQRKDFAGLTFLEELEIDASDLQSYEPKSLKSIQNVSHLILHMKQHILLLEIFVDVTSSVECLELRDTDLDTFHFSELSTGETNSLIKKFTFRNVKITDESLFQVMKLLNQISGLLELEFDDCTLNGVGNFRASDNDRVIDPGKVETLTIRRLHIPRFYLFYDLSTLYSLTERVKRITVENSKVFLVPCLLSQHLKSLEYLDLSENLMVEEYLKNSACEDAWPSLQTLILRQNHLASLEKTGETLLTLKNLTNIDISKNSFHSMPETCQWPEKMKYLNLSSTRIHSVTGCIPKTLEILDVSNNNLNLFSLNLPQLKELYISRNKLMTLPDASLLPMLLVLKISRNAITTFSKEQLDSFHTLKTLEAGGNNFICSCEFLSFTQEQQALAKVLIDWPANYLCDSPSHVRGQQVQDVRLSVSECHRTALVSGMCCALFLLILLTGVLCHRFHGLWYMKMMWAWLQAKRKPRKAPSRNICYDAFVSYSERDAYWVENLMVQELENFNPPFKLCLHKRDFIPGKWIIDNIIDSIEKSHKTVFVLSENFVKSEWCKYELDFSHFRLFDENNDAAILILLEPIEKKAIPQRFCKLRKIMNTKTYLEWPMDEAQREGFWVNLRAAIKS

SEQ ID NO: 89163 - protein, 904 aa, Homo sapiens
  Payload ID: 17850
  Gene Name: toll-like receptor 3
  Uniprot ID: O15455
  ENSP ID: ENSP00000296795
MRQTLPCIYFWGGLLPFGMLCASSTTKCTVSHEVADCSHLKLTQVPDDLPTNITVLNLTHNQLRRLPAANFTRYSQLTSLDVGFNTISKLEPELCQKLPMLKVLNLQHNELSQLSDKTFAFCTNLTELHLMSNSIQKIKNNPFVKQKNLITLDLSHNGLSSTKLGTQVQLENLQELLLSNNKIQALKSEELDIFANSSLKKLELSSNQIKEFSPGCFHAIGRLFGLFLNNVQLGPSLTEKLCLELANTSIRNLSLSNSQLSTTSNTTFLGLKWTNLTMLDLSYNNLNVVGNDSFAWLPQLEYFFLEYNNIQHLFSHSLHGLFNVRYLNLKRSFTKQSISLASLPKIDDFSFQWLKCLEHLNMEDNDIPGIKSNMFTGLINLKYLSLSNSFTSLRTLTNETFVSLAHSPLHILNLTKNKISKIESDAFSWLGHLEVLDLGLNEIGQELTGQEWRGLENIFEIYLSYNKYLQLTRNSFALVPSLQRLMLRRVALKNVDSSPSPFQPLRNLTILDLSNNNIANINDDMLEGLEKLEILDLQHNNLARLWKHANPGGPIYFLKGLSHLHILNLESNGFDEIPVEVFKDLFELKIIDLGLNNLNTLPASVFNNQVSLKSLNLQKNLITSVEKKVFGPAFRNLTELDMRFNPFDCTCESIAWFVNWINETHTNIPELSSHYLCNTPPHYHGFPVRLFDTSSCKDSAPFELFFMINTSILLIFIFIVLLIHFEGWRISFYWNVSVHRVLGFKEIDRQTEQFEYAAYIIHAYKDKDWVWEHFSSMEKEDQSLKFCLEERDFEAGVFELEAIVNSIKRSRKIIFVITHHLLKDPLCKRFKVHHAVQQAIEQNLDSIILVFLEEIPDYKLNHALCLRRGMFKSHCILNWPVQKERIGAFRHKLQVALGSKNSVH

SEQ ID NO: 89164 - protein, 351 aa, Homo sapiens
  Payload ID: 17850
  Gene Name: toll-like receptor 3
  ENSP ID: ENSP00000423386
MRQTLPCIYFWGGLLPFGMLCASSTTKCTVSHEVADCSHLKLTQVPDDLPTNITVLNLTHNQLRRLPAANFTRYSQLTSLDVGFNTISKLEPELCQKLPMLKVLNLQHNELSQLSDKTFAFCTNLTELHLMSNSIQKIKNNPFVKQKNLITLDLSHNGLSSTKLGTQVQLENLQELLLSNNKIQALKSEELDIFANSSLKKLELSSNQIKEFSPGCFHAIGRLFGLFLNNVQLGPSLTEKLCLELANTSIRNLSLSNSQLSTTSNTTFLGLKWTNLTMLDLSYNNLNVWLKCLEHLNMEDNDIPGIKSNMFTGLINLKYLSLSNSFTSLRTLTNETFVSLAHSPLHILNLT

SEQ ID NO: 89165 - protein, 627 aa, Homo sapiens
  Payload ID: 17850
  Gene Name: toll-like receptor 3
  Uniprot ID: O15455
  ENSP ID: ENSP00000423684
MLDLSYNNLNVVGNDSFAWLPQLEYFFLEYNNIQHLFSHSLHGLFNVRYLNLKRSFTKQSISLASLPKIDDFSFQWLKCLEHLNMEDNDIPGIKSNMFTGLINLKYLSLSNSFTSLRTLTNETFVSLAHSPLHILNLTKNKISKIESDAFSWLGHLEVLDLGLNEIGQELTGQEWRGLENIFEIYLSYNKYLQLTRNSFALVPSLQRLMLRRVALKNVDSSPSPFQPLRNLTILDLSNNNIANINDDMLEGLEKLEILDLQHNNLARLWKHANPGGPIYFLKGLSHLHILNLESNGFDEIPVEVFKDLFELKIIDLGLNNLNTLPASVFNNQVSLKSLNLQKNLITSVEKKVFGPAFRNLTELDMRFNPFDCTCESIAWFVNWINETHTNIPELSSHYLCNTPPHYHGFPVRLFDTSSCKDSAPFELFFMINTSILLIFIFIVLLIHFEGWRISFYWNVSVHRVLGFKEIDRQTEQFEYAAYIIHAYKDKDWVWEHFSSMEKEDQSLKFCLEERDFEAGVFELEAIVNSIKRSRKIIFVITHHLLKDPLCKRFKVHHAVQQAIEQNLDSIILVFLEEIPDYKLNHALCLRRGMFKSHCILNWPVQKERIGAFRHKLQVALGSKNSVH

SEQ ID NO: 89166 - protein, 839 aa, Homo sapiens
  Payload ID: 17851
  Gene Name: toll-like receptor 4
  Uniprot ID: O00206
  ENSP ID: ENSP00000363089
MMSASRLAGTLIPAMAFLSCVRPESWEPCVEVVPNITYQCMELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 89167 - protein, 799 aa, Homo sapiens
  Payload ID: 17851
  Gene Name: toll-like receptor 4
  Uniprot ID: O00206
  ENSP ID: ENSP00000377997
MELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 89168 - protein, 858 aa, Homo sapiens
  Payload ID: 17852
  Gene Name: toll-like receptor 5
  Uniprot ID: O60602
  ENSP ID: ENSP00000355846
MGDHLDLLLGVVLMAGPVFGIPSCSFDGRIAFYRFCNLTQVPQVLNTTERLLLSFNYIRTVTASSFPFLEQLQLLELGSQYTPLTIDKEAFRNLPNLRILDLGSSKIYFLHPDAFQGLFHLFELRLYFCGLSDAVLKDGYFRNLKALTRLDLSKNQIRSLYLHPSFGKLNSLKSIDFSSNQIFLVCEHELEPLQGKTLSFFSLAANSLYSRVSVDWGKCMNPFRNMVLEILDVSGNGWTVDITGNFSNAISKSQAFSLILAHHIMGAGFGFHNIKDPDQNTFAGLARSSVRHLDLSHGFVFSLNSRVFETLKDLKVLNLAYNKINKIADEAFYGLDNLQVLNLSYNLLGELYSSNFYGLPKVAYIDLQKNHIAIIQDQTFKFLEKLQTLDLRDNALTTIHFIPSIPDIFLSGNKLVTLPKINLTANLIHLSENRLENLDILYFLLRVPHLQILILNQNRFSSCSGDQTPSENPSLEQLFLGENMLQLAWETELCWDVFEGLSHLQVLYLNHNYLNSLPPGVFSHLTALRGLSLNSNRLTVLSHNDLPANLEILDISRNQLLAPNPDVFVSLSVLDITHNKFICECELSTFINWLNHTNVTIAGPPADIYCVYPDSFSGVSLFSLSTEGCDEEEVLKSLKFSLFIVCTVTLTLFLMTILTVTKFRGFCFICYKTAQRLVFKDHPQGTEPDMYKYDAYLCFSSKDFTWVQNALLKHLDTQYSDQNRFNLCFEERDFVPGENRIANIQDAIWNSRKIVCLVSRHFLRDGWCLEAFSYAQGRCLSDLNSALIMVVVGSLSQYQLMKHQSIRGFVQKQQYLRWPEDLQDVGWFLHKLSQQILKKEKEKKKDNNIPLQTVATIS

SEQ ID NO: 89169 - protein, 21 aa, Homo sapiens
  Payload ID: 17852
  Gene Name: toll-like receptor 5
  ENSP ID: ENSP00000385458
MGDHLDLLLGVVLMAGPVFGI

SEQ ID NO: 89170 - protein, 858 aa, Homo sapiens; identical to SEQ ID NO: 89168
  Payload ID: 17852
  Gene Name: toll-like receptor 5
  Uniprot ID: O60602
  ENSP ID: ENSP00000440643

SEQ ID NO: 89171 - protein, 796 aa, Homo sapiens
  Payload ID: 17853
  Gene Name: toll-like receptor 6
  Uniprot ID: Q9Y2C9
  ENSP ID: ENSP00000371376
MTKDKEPIVKSFHFVCLMIIIVGTRIQFSDGNEFAVDKSKRGLIHVPKDLPLKTKVLDMSQNYIAELQVSDMSFLSELTVLRLSHNRIQLLDLSVFKFNQDLEYLDLSHNQLQKISCHPIVSFRHLDLSFNDFKALPICKEFGNLSQLNFLGLSAMKLQKLDLLPIAHLHLSYILLDLRNYYIKENETESLQILNAKTLHLVFHPTSLFAIQVNISVNTLGCLQLTNIKLNDDNCQVFIKFLSELTRGSTLLNFTLNHIETTWKCLVRVFQFLWPKPVEYLNIYNLTIIESIREEDFTYSKTTLKALTIEHITNQVFLFSQTALYTVFSEMNIMMLTISDTPFIHMLCPHAPSTFKFLNFTQNVFTDSIFEKCSTLVKLETLILQKNGLKDLFKVGLMTKDMPSLEILDVSWNSLESGRHKENCTWVESIVVLNLSSNMLTDSVFRCLPPRIKVLDLHSNKIKSVPKQVVKLEALQELNVAFNSLTDLPGCGSFSSLSVLIIDHNSVSHPSADFFQSCQKMRSIKAGDNPFQCTCELREFVKNIDQVSSEVLEGWPDSYKCDYPESYRGSPLKDFHMSELSCNITLLIVTIGATMLVLAVTVTSLCIYLDLPWYLRMVCQWTQTRRRARNIPLEELQRNLQFHAFISYSEHDSAWVKSELVPYLEKEDIQICLHERNFVPGKSIVENIINCIEKSYKSIFVLSPNFVQSEWCHYELYFAHHNLFHEGSNNLILILLEPIPQNSIPNKYHKLKALMTQRTYLQWPKEKSKRGLFWANIRAAFNMKLTLVTENNDVKS

SEQ ID NO: 89172 - protein, 796 aa, Homo sapiens; identical to SEQ ID NO: 89171
  Payload ID: 17853
  Gene Name: toll-like receptor 6
  Uniprot ID: Q9Y2C9
  ENSP ID: ENSP00000389600

SEQ ID NO: 89173 - protein, 91 aa, Homo sapiens
  Payload ID: 17853
  Gene Name: toll-like receptor 6
  ENSP ID: ENSP00000423326
MTKDKEPIVKSFHFVCLMIIIVGTRIQFSDGNEFAVDKSKRGLIHVPKDLPLKTKVLDMSQNYIAELQVSDMSFLSELTVLRLSHNRIQLL

SEQ ID NO: 89174 - protein, 150 aa, Homo sapiens
  Payload ID: 17853
  Gene Name: toll-like receptor 6
  ENSP ID: ENSP00000424718
MTKDKEPIVKSFHFVCLMIIIVGTRIQFSDGNEFAVDKSKRGLIHVPKDLPLKTKVLDMSQNYIAELQVSDMSFLSELTVLRLSHNRIQLLDLSVFKFNQDLEYLDLSHNQLQKISCHPIVSFRHLDLSFNDFKALPICKEFGNLSQLNF

SEQ ID NO: 89175 - protein, 480 aa, Homo sapiens
  Payload ID: 17853
  Gene Name: toll-like receptor 6
  Uniprot ID: Q9Y2C9
  ENSP ID: ENSP00000480266
MTKDKEPIVKSFHFVCLMIIIVGTRIQFSDGNEFAVDKSKRGLIHVPKDLPLKTKVLDMSQNYIAELQVSDMSFLSELTVLRLSHNRIQLLDLSVFKFNQDLEYLDLSHNQLQKISCHPIVSFRHLDLSFNDFKALPICKEFGNLSQLNFLGLSAMKLQKLDLLPIAHLHLSYILLDLRNYYIKENETESLQILNAKTLHLVFHPTSLFAIQVNISVNTLGCLQLTNIKLNDDNCQVFIKFLSELTRGSTLLNFTLNHIETTWKCLVRVFQFLWPKPVEYLNIYNLTIIESIREEDFTYSKTTLKALTIEHITNQVFLFSQTALYTVFSEMNIMMLTISDTPFIHMLCPHAPSTFKFLNFTQNVFTDSIFEKCSTLVKLETLIFVLSPNFVQSEWCHYELYFAHHNLFHEGSNNLILILLEPIPQNSIPNKYHKLKALMTQRTYLQWPKEKSKRGLFWANIRAAFNMKLTLVTENNDVKS

SEQ ID NO: 89176 - protein, 1049 aa, Homo sapiens
  Payload ID: 17854
  Gene Name: toll-like receptor 7
  Uniprot ID: Q9NYK1
  ENSP ID: ENSP00000370034
MVFPMWTLKRQILILFNIILISKLLGARWFPKTLPCDVTLDVPKNHVIVDCTDKHLTEIPGGIPTNTTNLTLTINHIPDISPASFHRLDHLVEIDFRCNCVPIPLGSKNNMCIKRLQIKPRSFSGLTYLKSLYLDGNQLLEIPQGLPPSLQLLSLEANNIFSIRKENLTELANIEILYLGQNCYYRNPCYVSYSIEKDAFLNLTKLKVLSLKDNNVTAVPTVLPSTLTELYLYNNMIAKIQEDDFNNLNQLQILDLSGNCPRCYNAPFPCAPCKNNSPLQIPVNAFDALTELKVLRLHSNSLQHVPPRWFKNINKLQELDLSQNFLAKEIGDAKFLHFLPSLIQLDLSFNFELQVYRASMNLSQAFSSLKSLKILRIRGYVFKELKSFNLSPLHNLQNLEVLDLGTNFIKIANLSMFKQFKRLKVIDLSVNKISPSGDSSEVGFCSNARTSVESYEPQVLEQLHYFRYDKYARSCRFKNKEASFMSVNESCYKYGQTLDLSKNSIFFVKSSDFQHLSFLKCLNLSGNLISQTLNGSEFQPLAELRYLDFSNNRLDLLHSTAFEELHKLEVLDISSNSHYFQSEGITHMLNFTKNLKVLQKLMMNDNDISSSTSRTMESESLRTLEFRGNHLDVLWREGDNRYLQLFKNLLKLEELDISKNSLSFLPSGVFDGMPPNLKNLSLAKNGLKSFSWKKLQCLKNLETLDLSHNQLTTVPERLSNCSRSLKNLILKNNQIRSLTKYFLQDAFQLRYLDLSSNKIQMIQKTSFPENVLNNLKMLLLHHNRFLCTCDAVWFVWWVNHTEVTIPYLATDVTCVGPGAHKGQSVISLDLYTCELDLTNLILFSLSISVSLFLMVMMTASHLYFWDVWYIYHFCKAKIKGYQRLISPDCCYDAFIVYDTKDPAVTEWVLAELVAKLEDPREKHFNLCLEERDWLPGQPVLENLSQSIQLSKKTVFVMTDKYAKTENFKIAFYLSHQRLMDEKVDVIILIFLEKPFQKSKFLQLRKRLCGSSVLEWPTNPQAHPYFWQCLKNALATDNHVAYSQVFKETV

SEQ ID NO: 89177 - protein, 1041 aa, Homo sapiens
  Payload ID: 17855
  Gene Name: toll-like receptor 8
  Uniprot ID: Q9NR97
  ENSP ID: ENSP00000218032
MENMFLQSSMLTCIFLLISGSCELCAEENFSRSYPCDEKKQNDSVIAECSNRRLQEVPQTVGKYVTELDLSDNFITHITNESFQGLQNLTKINLNHNPNVQHQNGNPGIQSNGLNITDGAFLNLKNLRELLLEDNQLPQIPSGLPESLTELSLIQNNIYNITKEGISRLINLKNLYLAWNCYFNKVCEKTNIEDGVFETLTNLELLSLSFNSLSHVPPKLPSSLRKLFLSNTQIKYISEEDFKGLINLTLLDLSGNCPRCFNAPFPCVPCDGGASINIDRFAFQNLTQLRYLNLSSTSLRKINAAWFKNMPHLKVLDLEFNYLVGEIASGAFLTMLPRLEILDLSFNYIKGSYPQHINISRNFSKLLSLRALHLRGYVFQELREDDFQPLMQLPNLSTINLGINFIKQIDFKLFQNFSNLEIIYLSENRISPLVKDTRQSYANSSSFQRHIRKRRSTDFEFDPHSNFYHFTRPLIKPQCAAYGKALDLSLNSIFFIGPNQFENLPDIACLNLSANSNAQVLSGTEFSAIPHVKYLDLTNNRLDFDNASALTELSDLEVLDLSYNSHYFRIAGVTHHLEFIQNFTNLKVLNLSHNNIYTLTDKYNLESKSLVELVFSGNRLDILWNDDDNRYISIFKGLKNLTRLDLSLNRLKHIPNEAFLNLPASLTELHINDNMLKFFNWTLLQQFPRLELLDLRGNKLLFLTDSLSDFTSSLRTLLLSHNRISHLPSGFLSEVSSLKHLDLSSNLLKTINKSALETKTTTKLSMLELHGNPFECTCDIGDFRRWMDEHLNVKIPRLVDVICASPGDQRGKSIVSLELTTCVSDVTAVILFFFTFFITTMVMLAALAHHLFYWDVWFIYNVCLAKVKGYRSLSTSQTFYDAYISYDTKDASVTDWVINELRYHLEESRDKNVLLCLEERDWDPGLAIIDNLMQSINQSKKTVFVLTKKYAKSWNFKTAFYLALQRLMDENMDVIIFILLEPVLQHSQYLRLRQRICKSSILQWPDNPKAEGLFWQTLRNVVLTENDSRYNNMYVDSIKQY

SEQ ID NO: 89178 - protein, 1059 aa, Homo sapiens
  Payload ID: 17855
  Gene Name: toll-like receptor 8
  Uniprot ID: Q9NR97
  ENSP ID: ENSP00000312082
MKESSLQNSSCSLGKETKKENMFLQSSMLTCIFLLISGSCELCAEENFSRSYPCDEKKQNDSVIAECSNRRLQEVPQTVGKYVTELDLSDNFITHITNESFQGLQNLTKINLNHNPNVQHQNGNPGIQSNGLNITDGAFLNLKNLRELLLEDNQLPQIPSGLPESLTELSLIQNNIYNITKEGISRLINLKNLYLAWNCYFNKVCEKTNIEDGVFETLTNLELLSLSFNSLSHVPPKLPSSLRKLFLSNTQIKYISEEDFKGLINLTLLDLSGNCPRCFNAPFPCVPCDGGASINIDRFAFQNLTQLRYLNLSSTSLRKINAAWFKNMPHLKVLDLEFNYLVGEIASGAFLTMLPRLEILDLSFNYIKGSYPQHINISRNFSKLLSLRALHLRGYVFQELREDDFQPLMQLPNLSTINLGINFIKQIDFKLFQNFSNLEIIYLSENRISPLVKDTRQSYANSSSFQRHIRKRRSTDFEFDPHSNFYHFTRPLIKPQCAAYGKALDLSLNSIFFIGPNQFENLPDIACLNLSANSNAQVLSGTEFSAIPHVKYLDLTNNRLDFDNASALTELSDLEVLDLSYNSHYFRIAGVTHHLEFIQNFTNLKVLNLSHNNIYTLTDKYNLESKSLVELVFSGNRLDILWNDDDNRYISIFKGLKNLTRLDLSLNRLKHIPNEAFLNLPASLTELHINDNMLKFFNWTLLQQFPRLELLDLRGNKLLFLTDSLSDFTSSLRTLLLSHNRISHLPSGFLSEVSSLKHLDLSSNLLKTINKSALETKTTTKLSMLELHGNPFECTCDIGDFRRWMDEHLNVKIPRLVDVICASPGDQRGKSIVSLELTTCVSDVTAVILFFFTFFITTMVMLAALAHHLFYWDVWFIYNVCLAKVKGYRSLSTSQTFYDAYISYDTKDASVTDWVINELRYHLEESRDKNVLLCLEERDWDPGLAIIDNLMQSINQSKKTVFVLTKKYAKSWNFKTAFYLALQRLMDENMDVIIFILLEPVLQHSQYLRLRQRICKSSILQWPDNPKAEGLFWQTLRNVVLTENDSRYNNMYVDSIKQY

SEQ ID NO: 89179 - protein, 1032 aa, Homo sapiens
  Payload ID: 17856
  Gene Name: toll-like receptor 9
  Uniprot ID: Q9NR96
  ENSP ID: ENSP00000353874
MGFCRSALHPLSLLVQAIMLAMTLALGTLPAFLPCELQPHGLVNCNWLFLKSVPHFSMAAPRGNVTSLSLSSNRIHHLHDSDFAHLPSLRHLNLKWNCPPVGLSPMHFPCHMTIEPSTFLAVPTLEELNLSYNNIMTVPALPKSLISLSLSHTNILMLDSASLAGLHALRFLFMDGNCYYKNPCRQALEVAPGALLGLGNLTHLSLKYNNLTVVPRNLPSSLEYLLLSYNRIVKLAPEDLANLTALRVLDVGGNCRRCDHAPNPCMECPRHFPQLHPDTFSHLSRLEGLVLKDSSLSWLNASWFRGLGNLRVLDLSENFLYKCITKTKAFQGLTQLRKLNLSFNYQKRVSFAHLSLAPSFGSLVALKELDMHGIFFRSLDETTLRPLARLPMLQTLRLQMNFINQAQLGIFRAFPGLRYVDLSDNRISGASELTATMGEADGGEKVWLQPGDLAPAPVDTPSSEDFRPNCSTLNFTLDLSRNNLVTVQPEMFAQLSHLQCLRLSHNCISQAVNGSQFLPLTGLQVLDLSHNKLDLYHEHSFTELPRLEALDLSYNSQPFGMQGVGHNFSFVAHLRTLRHLSLAHNNIHSQVSQQLCSTSLRALDFSGNALGHMWAEGDLYLHFFQGLSGLIWLDLSQNRLHTLLPQTLRNLPKSLQVLRLRDNYLAFFKWWSLHFLPKLEVLDLAGNQLKALTNGSLPAGTRLRRLDVSCNSISFVAPGFFSKAKELRELNLSANALKTVDHSWFGPLASALQILDVSANPLHCACGAAFMDFLLEVQAAVPGLPSRVKCGSPGQLQGLSIFAQDLRLCLDEALSWDCFALSLLAVALGLGVPMLHHLCGWDLWYCFHLCLAWLPWRGRQSGRDEDALPYDAFVVFDKTQSAVADWVYNELRGQLEECRGRWALRLCLEERDWLPGKTLFENLWASVYGSRKTLFVLAHTDRVSGLLRASFLLAQQRLLEDRKDVVVLVILSPDGRRSRYVRLRQRLCRQSVLLWPHQPSGQRSFWAQLGMALTRDNHHFYNRNFCQGPTAE

SEQ ID NO: 89180 - protein, 712 aa, Homo sapiens
  Payload ID: 17857
  Gene Name: toll-like receptor adaptor molecule 1
  Uniprot ID: Q8IUC6
  ENSP ID: ENSP00000248244
MACTGPSLPSAFDILGAAGQDKLLYLKHKLKTPRPGCQGQDLLHAMVLLKLGQETEARISLEALKADAVARLVARQWAGVDSTEDPEEPPDVSWAVARLYHLLAEEKLCPASLRDVAYQEAVRTLSSRDDHRLGELQDEARNRCGWDIAGDPGSIRTLQSNLGCLPPSSALPSGTRSLPRPIDGVSDWSQGCSLRSTGSPASLASNLEISQSPTMPFLSLHRSPHGPSKLCDDPQASLVPEPVPGGCQEPEEMSWPPSGEIASPPELPSSPPPGLPEVAPDATSTGLPDTPAAPETSTNYPVECTEGSAGPQSLPLPILEPVKNPCSVKDQTPLQLSVEDTTSPNTKPCPPTPTTPETSPPPPPPPPSSTPCSAHLTPSSLFPSSLESSSEQKFYNFVILHARADEHIALRVREKLEALGVPDGATFCEDFQVPGRGELSCLQDAIDHSAFIILLLTSNFDCRLSLHQVNQAMMSNLTRQGSPDCVIPFLPLESSPAQLSSDTASLLSGLVRLDEHSQIFARKVANTFKPHRLQARKAMWRKEQDTRALREQSQHLDGERMQAAALNAAYSAYLQSYLSYQAQMEQLQVAFGSHMSFGTGAPYGARMPFGGQVPLGAPPPFPTWPGCPQPPPLHAWQAGTPPPPSPQPAAFPQSLPFPQSPAFPTASPAPPQSPGLQPLIIHHAQMVQLGLNNHMWNQRGSQAPEDKTQEAE

SEQ ID NO: 89181 - protein, 546 aa, Homo sapiens [sequence omitted]

SEQ ID NO: 89182 - protein, 235 aa, Homo sapiens
  Payload ID: 17858
  Gene Name: toll-like receptor adaptor molecule 2
  Uniprot ID: Q86XR7
  ENSP ID: ENSP00000415139
MGIGKSKINSCPLSLSWGKRHSVDTSPGYHESDSKKSEDLSLCNVAEHSNTTEGPTGKQEGAQSVEEMFEEEAEEEVFLKFVILHAEDDTDEALRVQNLLQDDFGIKPGIIFAEMPCGRQHLQNLDDAVNGSAWTILLLTENFLRDTWCNFQFYTSLMNSVNRQHKYNSVIPMRPLNNPLPRERTPFALQTINALEEESRGFPTQVERIFQESVYKTQQTIWKETRNMVQRQFIA

SEQ ID NO: 89183 - protein, 1013 aa, Homo sapiens
  Payload ID: 17859
  Gene Name: tolloid-like 1
  Uniprot ID: O43897
  ENSP ID: ENSP00000061240
MGLGTLSPRMLVWLVASGIVFYGELWVCAGLDYDYTFDGNEEDKTETIDYKDPCKAAVFWGDIALDDEDLNIFQIDRTIDLTQNPFGNLGHTTGGLGDHAMSKKRGALYQLIDRIRRIGFGLEQNNTVKGKVPLQFSGQNEKNRVPRAATSRTERIWPGGVIPYVIGGNFTGSQRAMFKQAMRHWEKHTCVTFIERSDEESYIVFTYRPCGCCSYVGRRGNGPQAISIGKNCDKFGIVVHELGHVIGFWHEHTRPDRDNHVTIIRENIQPGQEYNFLKMEPGEVNSLGERYDFDSIMHYARNTFSRGMFLDTILPSRDDNGIRPAIGQRTRLSKGDIAQARKLYRCPACGETLQESNGNLSSPGFPNGYPSYTHCIWRVSVTPGEKIVLNFTTMDLYKSSLCWYDYIEVRDGYWRKSPLLGRFCGDKLPEVLTSTDSRMWIEFRSSSNWVGKGFAAVYEAICGGEIRKNEGQIQSPNYPDDYRPMKECVWKITVSESYHVGLTFQSFEIERHDNCAYDYLEVRDGTSENSPLIGRFCGYDKPEDIRSTSNTLWMKFVSDGTVNKAGFAANFFKEEDECAKPDRGGCEQRCLNTLGSYQCACEPGYELGPDRRSCEAACGGLLTKLNGTITTPGWPKEYPPNKNCVWQVVAPTQYRISVKFEFFELEGNEVCKYDYVEIWSGLSSESKLHGKFCGAEVPEVITSQFNNMRIEFKSDNTVSKKGFKAHFFSDKDECSKDNGGCQHECVNTMGSYMCQCRNGFVLHDNKHDCKEAECEQKIHSPSGLITSPNWPDKYPSRKECTWEISATPGHRIKLAFSEFEIEQHQECAYDHLEVFDGETEKSPILGRLCGNKIPDPLVATGNKMFVRFVSDASVQRKGFQATHSTECGGRLKAESKPRDLYSHAQFGDNNYPGQVDCEWLLVSERGSRLELSFQTFEVEEEADCGYDYVELFDGLDSTAVGLGRFCGSGPPEEIYSIGDSVLIHFHTDDTINKKGFHIRYKSIRYPDTTHTKK

SEQ ID NO: 89184 - protein, 57 aa, Homo sapiens
  Payload ID: 17859
  Gene Name: tolloid-like 1
  ENSP ID: ENSP00000421732
MGLGTLSPRMLVWLVASGIVFYGELWVCAGLDYDYTFDGNEEDKTETIDYKDPCKAD

SEQ ID NO: 89185 - protein, 130 aa, Homo sapiens
  Payload ID: 17859
  Gene Name: tolloid-like 1
  ENSP ID: ENSP00000422692
MGLGTLSPRMLVWLVASGIVFYGELWVCAGLDYDYTFDGNEEDKTETIDYKDPCKAAVFWGDIALDDEDLNIFQIDRTIDLTQNPFGNLGHTTGGLGDHAMSKKRGALYQLIDRIRRIGFGISMFKVADA

SEQ ID NO: 89186 - protein, 392 aa, Homo sapiens
  Payload ID: 17859
  Gene Name: tolloid-like 1
  Uniprot ID: O43897
  ENSP ID: ENSP00000422937
MGLGTLSPRMLVWLVASGIVFYGELWVCAGLDYDYTFDGNEEDKTETIDYKDPCKAAVFWGDIALDDEDLNIFQIDRTIDLTQNPFGNLGHTTGGLGDHAMSKKRGALYQLIDRIRRIGFGLEQNNTVKGKVPLQFSGQNEKNRVPRAATSRTERIWPGGVIPYVIGGNFTGSQRAMFKQAMRHWEKHTCVTFIERSDEESYIVFTYRPCGCCSYVGRRGNGPQAISIGKNCDKFGIVVHELGHVIGFWHEHTRPDRDNHVTIIRENIQPGQEYNFLKMEPGEVNSLGERYDFDSIMHYARNTFSRGMFLDTILPSRDDNGIRPAIGQRTRLSKGDIAQARKLYRCPACGETLQESNGNLSSPGFPNGYPSYTHCIWRVSVTPGEKVVFSLC

SEQ ID NO: 89187 - protein, 110 aa, Homo sapiens
  Payload ID: 17859
  Gene Name: tolloid-like 1
  ENSP ID: ENSP00000423748
MSKKRGALYQLIDRIRRIGFGLEQNNTVKGKVPLQFSGQNEKNRVPRAATSRTERIWPGGVIPYVIGGNFTGSQRAMFKQAMRHWEKHTCVTFIERSDEESYIVFTYRPC

SEQ ID NO: 89188 - protein, 1036 aa, Homo sapiens
  Payload ID: 17859
  Gene Name: tolloid-like 1
  ENSP ID: ENSP00000426082
MGLGTLSPRMLVWLVASGIVFYGELWVCAGLDYDYTFDGNEEDKTETIDYKDPCKAAVFWGDIALDDEDLNIFQIDRTIDLTQNPFGNLGHTTGGLGDHAMSKKRGALYQLIDRIRRIGFGLEQNNTVKGKVPLQFSGQNEKNRVPRAATSRTERIWPGGVIPYVIGGNFTGSQRAMFKQAMRHWEKHTCVTFIERSDEESYIVFTYRPCGCCSYVGRRGNGPQAISIGKNCDKFGIVVHELGHVIGFWHEHTRPDRDNHVTIIRENIQPGQEYNFLKMEPGEVNSLGERYDFDSIMHYARNTFSRGMFLDTILPSRDDNGIRPAIGQRTRLSKGDIAQARKLYRCPACGETLQESNGNLSSPGFPNGYPSYTHCIWRVSVTPGEKIVLNFTTMDLYKSSLCWYDYIEVRDGYWRKSPLLGRFCGDKLPEVLTSTDSRMWIEFRSSSNWVGKGFAAVYEAICGGEIRKNEGQIQSPNYPDDYRPMKECVWKITVSESYHVGLTFQSFEQEHQENPGIASKARESLILIWKPIERHDNCAYDYLEVRDGTSENSPLIGRFCGYDKPEDIRSTSNTLWMKFVSDGTVNKAGFAANFFKEEDECAKPDRGGCEQRCLNTLGSYQCACEPGYELGPDRRSCEAACGGLLTKLNGTITTPGWPKEYPPNKNCVWQVVAPTQYRISVKFEFFELEGNEVCKYDYVEIWSGLSSESKLHGKFCGAEVPEVITSQFNNMRIEFKSDNTVSKKGFKAHFFSDKDECSKDNGGCQHECVNTMGSYMCQCRNGFVLHDNKHDCKEAECEQKIHSPSGLITSPNWPDKYPSRKECTWEISATPGHRIKLAFSEFEIEQHQECAYDHLEVFDGETEKSPILGRLCGNKIPDPLVATGNKMFVRFVSDASVQRKGFQATHSTECGGRLKAESKPRDLYSHAQFGDNNYPGQVDCEWLLVSERGSRLELSFQTFEVEEEADCGYDYVELFDGLDSTAVGLGRFCGSGPPEEIYSIGDSVLIHFHTDDTINKKGFHIRYKSIRYPDTTHTKK

SEQ ID NO: 89189 - protein, 1015 aa, Homo sapiens
  Payload ID: 17860
  Gene Name: tolloid-like 2
  Uniprot ID: Q9Y6L7
  ENSP ID: ENSP00000350630
MPRATALGALVSLLLLLPLPRGAGGLGERPDATADYSELDGEEGTEQQLEHYHDPCKAAVFWGDIALDEDDLKLFHIDKARDWTKQTVGATGHSTGGLEEQASESSPDTTAMDTGTKEAGKDGRENTTLLHSPGTLHAAAKTFSPRVRRATTSRTERIWPGGVIPYVIGGNFTGSQRAIFKQAMRHWEKHTCVTFIERTDEESFIVFSYRTCGCCSYVGRRGGGPQAISIGKNCDKFGIVAHELGHVVGFWHEHTRPDRDQHVTIIRENIQPGQEYNFLKMEAGEVSSLGETYDFDSIMHYARNTFSRGVFLDTILPRQDDNGVRPTIGQRVRLSQGDIAQARKLYKCPACGETLQDTTGNFSAPGFPNGYPSYSHCVWRISVTPGEKIVLNFTSMDLFKSRLCWYDYVEVRDGYWRKAPLLGRFCGDKIPEPLVSTDSRLWVEFRSSSNILGKGFFAAYEATCGGDMNKDAGQIQSPNYPDDYRPSKECVWRITVSEGFHVGLTFQAFEIERHDSCAYDYLEVRDGPTEESALIGHFCGYEKPEDVKSSSNRLWMKFVSDGSINKAGFAANFFKEVDECSWPDHGGCEHRCVNTLGSYKCACDPGYELAADKKMCEVACGGFITKLNGTITSPGWPKEYPTNKNCVWQVVAPAQYRISLQFEVFELEGNDVCKYDFVEVRSGLSPDAKLHGRFCGSETPEVITSQSNNMRVEFKSDNTVSKRGFRAHFFSDKDECAKDNGGCQHECVNTFGSYLCRCRNGYWLHENGHDCKEAGCAHKISSVEGTLASPNWPDKYPSRRECTWNISSTAGHRVKLTFNEFEIEQHQECAYDHLEMYDGPDSLAPILGRFCGSKKPDPTVASGSSMFLRFYSDASVQRKGFQAVHSTECGGRLKAEVQTKELYSHAQFGDNNYPSEARCDWVIVAEDGYGVELTFRTFEVEEEADCGYDYMEAYDGYDSSAPRLGRFCGSGPLEEIYSAGDSLMIRFRTDDTINKKGFHARYTSTKFQDALHMKK

SEQ ID NO: 89190 - protein, 1378 aa, Homo sapiens
  Payload ID: 17861
  Gene Name: tonsoku-like, DNA repair protein
  Uniprot ID: Q96HA7
  ENSP ID: ENSP00000386239
MSLERELRQLSKAKAKAQRAGQRREEAALCHQLGELLAGHGRYAEALEQHWQELQLRERADDPLGCAVAHRKIGERLAEMEDYPAALQHQHQYLELAHSLRNHTELQRAWATIGRTHLDIYDHCQSRDALLQAQAAFEKSLAIVDEELEGTLAQGELNEMRTRLYLNLGLTFESLQQTALCNDYFRKSIFLAEQNHLYEDLFRARYNLGTIHWRAGQHSQAMRCLEGARECAHTMRKRFMESECCVVIAQVLQDLGDFLAAKRALKKAYRLGSQKPVQRAAICQNLQHVLAVVRLQQQLEEAEGRDPQGAMVICEQLGDLFSKAGDFPRAAEAYQKQLRFAELLDRPGAERAIIHVSLATTLGDMKDHHGAVRHYEEELRLRSGNVLEEAKTWLNIALSREEAGDAYELLAPCFQKALSCAQQAQRPQLQRQVLQHLHTVQLRLQPQEAPETETRLRELSVAEDEDEEEEAEEAAATAESEALEAGEVELSEGEDDTDGLTPQLEEDEELQGHLGRRKGSKWNRRNDMGETLLHRACIEGQLRRVQDLVRQGHPLNPRDYCGWTPLHEACNYGHLEIVRFLLDHGAAVDDPGGQGCEGITPLHDALNCGHFEVAELLLERGASVTLRTRKGLSPLETLQQWVKLYRRDLDLETRQKARAMEMLLQAAASGQDPHSSQAFHTPSSLLFDPETSPPLSPCPEPPSNSTRLPEASQAHVRVSPGQAAPAMARPRRSRHGPASSSSSSEGEDSAGPARPSQKRPRCSATAQRVAAWTPGPASNREAATASTSRAAYQAAIRGVGSAQSRLGPGPPRGHSKALAPQAALIPEEECLAGDWLELDMPLTRSRRPRPRGTGDNRRPSSTSGSDSEESRPRARAKQVRLTCMQSCSAPVNAGPSSLASEPPGSPSTPRVSEPSGDSSAAGQPLGPAPPPPIRVRVQVQDHLFLIPVPHSSDTHSVAWLAEQAAQRYYQTCGLLPRLTLRKEGALLAPQDLIPDVLQSNDEVLAEVTSWDLPPLTDRYRRACQSLGQGEHQQVLQAVELQGLGLSFSACSLALDQAQLTPLLRALKLHTALRELRLAGNRLGDKCVAELVAALGTMPSLALLDLSSNHLGPEGLRQLAMGLPGQATLQSLEELDLSMNPLGDGCGQSLASLLHACPLLSTLRLQACGFGPSFFLSHQTALGSAFQDAEHLKTLSLSYNALGAPALARTLQSLPAGTLLHLELSSVAAGKGDSDLMEPVFRYLAKEGCALAHLTLSANHLGDKAVRDLCRCLSLCPSLISLDLSANPEISCASLEELLSTLQKRPQGLSFLGLSGCAVQGPLGLGLWDKIAAQLRELQLCSRRLCAEDRDALRQLQPSRPGPGECTLDHGSKLFFRRL

SEQ ID NO: 89191 - protein, 477 aa, Homo sapiens [sequence omitted]

SEQ ID NO: 89192 - protein, 1910 aa, Homo sapiens
  Payload ID: 17862
  Gene Name: TOPBP1-interacting checkpoint and replication regulator
  Uniprot ID: Q7Z2Z1
  ENSP ID: ENSP00000268138
MACCHKVMLLLDTAGGAARHSRVRRAALRLLTYLSCRFGLARVHWAFKFFDSQGARSRPSRVSDFRELGSRSWEDFEEELEARLEDRAHLPGPAPRATHTHGALMETLLDYQWDRPEITSPTKPILRSSGRRLLDVESEAKEAEAALGGLVNAVFLLAPCPHSQRELLQFVSGCEAQAQRLPPTPKQVMEKLLPKRVREVMVARKITFYWVDTTEWSKLWESPDHLGYWTVCELLHHGGGTVLPSESFSWDFAQAGEMLLRSGIKLSSEPHLSPWISMLPTDATLNRLLYNSPEYEASFPRMEGMLFLPVEAGKEIQETWTVTLEPLAMHQRHFQKPVRIFLKGSVAQWSLPTSSTLGTDSWMLGSPEESTATQRLLFQQLVSRLTAEELHLVADVDPGEGRPPITGVISPLSASAMILTVCRTKEAEFQRHVLQTAVADSPRDTASLFSDVVDSILNQTHDSLADTASAASPVPEWAQQELGHTTPWSPAVVEKWFPFCNISGASSDLMESFGLLQAASANKEESSKTEGELIHCLAELYQRKSREESTIAHQEDSKKKRGVPRTPVRQKMNTMCRSLKMLNVARLNVKAQKLHPDGSPDVAGEKGIQKIPSGRTVDKLEDRGRTLRSSKPKDFKTEEELLSYIRENYQKTVATGEIMLYACARNMISTVKMFLKSKGTKELEVNCLNQVKSSLLKTSKSLRQNLGKKLDKEDKVRECQLQVFLRLEMCLQCPSINESTDDMEQVVEEVTDLLRMVCLTEDSAYLAEFLEEILRLYIDSIPKTLGNLYNSLGFVIPQKLAGVLPTDFFSDDSMTQENKSPLLSVPFLSSARRSVSGSPESDELQELRTRSAKKRRKNALIRHKSIAEVSQNLRQIEIPKVSKRATKKENSHPAPQQPSQPVKDTVQEVTKVRRNLFNQELLSPSKRSLKRGLPRSHSVSAVDGLEDKLDNFKKNKGYHKLLTKSVAETPVHKQISKRLLHRQIKGRSSDPGPDIGVVEESPEKGDEISLRRSPRIKQLSFSRTHSASFYSVSQPKSRSVQRVHSFQQDKSDQRENSPVQSIRSPKSLLFGAMSEMISPSEKGSARMKKRSRNTLDSEVPAAYQTPKKSHQKSLSFSKTTPRRISHTPQTPLYTPERLQKSPAKMTPTKQAAFKESLKDSSSPGHDSPLDSKITPQKRHTQAGEGTSLETKTPRTPKRQGTQPPGFLPNCTWPHSVNSSPESPSCPAPPTSSTAQPRRECLTPIRDPLRTPPRAAAFMGTPQNQTHQQPHVLRAARAEEPAQKLKDKAIKTPKRPGNSTVTSSPPVTPKKLFTSPLCDVSKKSPFRKSKIECPSPGELDQKEPQMSPSVAASLSCPVPSTPPELSQRATLDTVPPPPPSKVGKRCRKTSDPRRSIVECQPDASATPGVGTADSPAAPTDSRDDQKGLSLSPQSPPERRGYPGPGLRSDWHASSPLLITSDTEHVTLLSEAEHHGIGDLKSNVLSVEEGEGLRTADAEKSSLSHPGIPPSPPSCGPGSPLMPSRDVHCTTDGRQCQASAQLDNLPASAWHSTDSASPQTYEVELEMQASGLPKLRIKKIDPSSSLEAEPLSKEESSLGEESFLPALSMPRASRSLSKPEPTYVSPPCPRLSHSTPGKSRGQTYICQACTPTHGPSSTPSPFQTDGVPWTPSPKHSGKTTPDIIKDWPRRKRAVGCGAGSSSGRGEVGADLPGSLSLLESEGKDHGLELSIHRTPILEDFELEGVCQLPDQSPPRNSMPKAEEASSWGQFGLSSRKRVLLAKEEADRGAKRICDLREDSEVSKSKEGSPSWSAWQLPSTGDEEVFVSGSTPPPSCAVRSCLSASALQALTQSPLLFQGKTPSSQSKDPRDEDVDVLPSTVEDSPFSRAFSRRRPISRTYTRKKLMGTWLEDL

SEQ ID NO: 89193 - protein, 1909 aa, Homo sapiens
  Payload ID: 17862
  Gene Name: TOPBP1-interacting checkpoint and replication regulator
  Uniprot ID: Q7Z2Z1
  ENSP ID: ENSP00000453306
MACCHKVMLLLDTAGGAARHSRVRRAALRLLTYLSCRFGLARVHWAFKFFDSQGARSRPSRVSDFRELGSRSWEDFEEELEARLEDRAHLPGPAPRATHTHGALMETLLDYQWDRPEITSPTKPILRSSGRRLLDVESEAKEAEAALGGLVNAVFLLAPCPHSQRELLQFVSGCEAQAQRLPPTPKQVMEKLLPKRVREVMVARKITFYWVDTTEWSKLWESPDHLGYWTVCELLHHGGGTVLPSESFSWDFAQAGEMLLRSGIKLSSEPHLSPWISMLPTDATLNRLLYNSPEYEASFPRMEGMLFLPVEGKEIQETWTVTLEPLAMHQRHFQKPVRIFLKGSVAQWSLPTSSTLGTDSWMLGSPEESTATQRLLFQQLVSRLTAEELHLVADVDPGEGRPPITGVISPLSASAMILTVCRTKEAEFQRHVLQTAVADSPRDTASLFSDVVDSILNQTHDSLADTASAASPVPEWAQQELGHTTPWSPAVVEKWFPFCNISGASSDLMESFGLLQAASANKEESSKTEGELIHCLAELYQRKSREESTIAHQEDSKKKRGVPRTPVRQKMNTMCRSLKMLNVARLNVKAQKLHPDGSPDVAGEKGIQKIPSGRTVDKLEDRGRTLRSSKPKDFKTEEELLSYIRENYQKTVATGEIMLYACARNMISTVKMFLKSKGTKELEVNCLNQVKSSLLKTSKSLRQNLGKKLDKEDKVRECQLQVFLRLEMCLQCPSINESTDDMEQVVEEVTDLLRMVCLTEDSAYLAEFLEEILRLYIDSIPKTLGNLYNSLGFVIPQKLAGVLPTDFFSDDSMTQENKSPLLSVPFLSSARRSVSGSPESDELQELRTRSAKKRRKNALIRHKSIAEVSQNLRQIEIPKVSKRATKKENSHPAPQQPSQPVKDTVQEVTKVRRNLFNQELLSPSKRSLKRGLPRSHSVSAVDGLEDKLDNFKKNKGYHKLLTKSVAETPVHKQISKRLLHRQIKGRSSDPGPDIGVVEESPEKGDEISLRRSPRIKQLSFSRTHSASFYSVSQPKSRSVQRVHSFQQDKSDQRENSPVQSIRSPKSLLFGAMSEMISPSEKGSARMKKRSRNTLDSEVPAAYQTPKKSHQKSLSFSKTTPRRISHTPQTPLYTPERLQKSPAKMTPTKQAAFKESLKDSSSPGHDSPLDSKITPQKRHTQAGEGTSLETKTPRTPKRQGTQPPGFLPNCTWPHSVNSSPESPSCPAPPTSSTAQPRRECLTPIRDPLRTPPRAAAFMGTPQNQTHQQPHVLRAARAEEPAQKLKDKAIKTPKRPGNSTVTSSPPVTPKKLFTSPLCDVSKKSPFRKSKIECPSPGELDQKEPQMSPSVAASLSCPVPSTPPELSQRATLDTVPPPPPSKVGKRCRKTSDPRRSIVECQPDASATPGVGTADSPAAPTDSRDDQKGLSLSPQSPPERRGYPGPGLRSDWHASSPLLITSDTEHVTLLSEAEHHGIGDLKSNVLSVEEGEGLRTADAEKSSLSHPGIPPSPPSCGPGSPLMPSRDVHCTTDGRQCQASAQLDNLPASAWHSTDSASPQTYEVELEMQASGLPKLRIKKIDPSSSLEAEPLSKEESSLGEESFLPALSMPRASRSLSKPEPTYVSPPCPRLSHSTPGKSRGQTYICQACTPTHGPSSTPSPFQTDGVPWTPSPKHSGKTTPDIIKDWPRRKRAVGCGAGSSSGRGEVGADLPGSLSLLESEGKDHGLELSIHRTPILEDFELEGVCQLPDQSPPRNSMPKAEEASSWGQFGLSSRKRVLLAKEEADRGAKRICDLREDSEVSKSKEGSPSWSAWQLPSTGDEEVFVSGSTPPPSCAVRSCLSASALQALTQSPLLFQGKTPSSQSKDPRDEDVDVLPSTVEDSPFSRAFSRRRPISRTYTRKKLMGTWLEDL

SEQ ID NO: 89194 - protein, 214 aa, Homo sapiens
  Payload ID: 17862
  Gene Name: TOPBP1-interacting checkpoint and replication regulator
  ENSP ID: ENSP00000453922
  MOD_RES (1)..(1): Any amino acid
XSSSGRGEVGADLPGSLSLLESEGKDHGLELSIHRTPILEDFELEGVCQLPDQSPPRNSMPKAEEASSWGQFGLSSRKRVLLAKEEADRGAKRICDLREDSEVSKSKEGSPSWSAWQLPSTGDEEVFVSGSTPPPSCAVRSCLSASALQALTQSPLLFQGKTPSSQSKDPRDEDVDVLPSTVEDSPFSRAFSRRRPISRTYTRKKLMGTWLEDL

SEQ ID NO: 89195 - protein, 765 aa, Homo sapiens
  Payload ID: 17863
  Gene Name: topoisomerase (DNA) I
  Uniprot ID: P11387
  ENSP ID: ENSP00000354522
MSGDHLHNDSQIEADFRLNDSHKHKDKHKDREHRHKEHKKEKDREKSKHSNSEHKDSEKKHKEKEKTKHKDGSSEKHKDKHKDRDKEKRKEEKVRASGDAKIKKEKENGFSSPPQIKDEPEDDGYFVPPKEDIKPLKRPRDEDDADYKPKKIKTEDTKKEKKRKLEEEEDGKLKKPKNKDKDKKVPEPDNKKKKPKKEEEQKWKWWEEERYPEGIKWKFLEHKGPVFAPPYEPLPENVKFYYDGKVMKLSPKAEEVATFFAKMLDHEYTTKEIFRKNFFKDWRKEMTNEEKNIITNLSKCDFTQMSQYFKAQTEARKQMSKEEKLKIKEENEKLLKEYGFCIMDNHKERIANFKIEPPGLFRGRGNHPKMGMLKRRIMPEDIIINCSKDAKVPSPPPGHKWKEVRHDNKVTWLVSWTENIQGSIKYIMLNPSSRIKGEKDWQKYETARRLKKCVDKIRNQYREDWKSKEMKVRQRAVALYFIDKLALRAGNEKEEGETADTVGCCSLRVEHINLHPELDGQEYVVEFDFLGKDSIRYYNKVPVEKRVFKNLQLFMENKQPEDDLFDRLNTGILNKHLQDLMEGLTAKVFRTYNASITLQQQLKELTAPDENIPAKILSYNRANRAVAILCNHQRAPPKTFEKSMMNLQTKIDAKKEQLADARRDLKSAKADAKVMKDAKTKKVVESKKKAVQRLEEQLMKLEVQATDREENKQIALGTSKLNYLDPRITVAWCKKWGVPIEKIYNKTQREKFAWAIDMADEDYEF

SEQ ID NO: 89196 - protein, 601 aa, Homo sapiens
  Payload ID: 17864
  Gene Name: topoisomerase (DNA) I, mitochondrial
  Uniprot ID: Q969P6
  ENSP ID: ENSP00000328835
MRVVRLLRLRAALTLLGEVPRRPASRGVPGSRRTQKGSGARWEKEKHEDGVKWRQLEHKGPYFAPPYEPLPDGVRFFYEGRPVRLSVAAEEVATFYGRMLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTTTSLNKHLQELMDGLTAKVFRTYNASITLQEQLRALTRAEDSIAAKILSYNRANRVVAILCNHQRATPSTFEKSMQNLQTKIQAKKEQVAEARAELRRARAEHKAQGDGKSRSVLEKKRRLLEKLQEQLAQLSVQATDKEENKQVALGTSKLNYLDPRISIAWCKRFRVPVEKIYSKTQRERFAWALAMAGEDFEF

SEQ ID NO: 89197 - protein, 111 aa, Homo sapiens
  Payload ID: 17864
  Gene Name: topoisomerase (DNA) I, mitochondrial
  ENSP ID: ENSP00000427925
  MOD_RES (1)..(1): Any amino acid
XEQVAEARAELRRARAEHKAQGDGKSRSVLEKKRRLLEKLQEQLAQLSVQATDKEENKQVALGTSKLNYLDPRISIAWCKRFRVPVEKIYSKTQRERFAWALAMAGEDFEF

SEQ ID NO: 89198 - protein, 221 aa, Homo sapiens
  Payload ID: 17864
  Gene Name: topoisomerase (DNA) I, mitochondrial
  ENSP ID: ENSP00000427998
MLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFID

SEQ ID NO: 89199 - protein, 503 aa, Homo sapiens
  Payload ID: 17864
  Gene Name: topoisomerase (DNA) I, mitochondrial
  Uniprot ID: Q969P6
  ENSP ID: ENSP00000428369
MLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTTTSLNKHLQELMDGLTAKVFRTYNASITLQEQLRALTRAEDSIAAKILSYNRANRVVAILCNHQRATPSTFEKSMQNLQTKIQAKKEQVAEARAELRRARAEHKAQGDGKSRSVLEKKRRLLEKLQEQLAQLSVQATDKEENKQVALGTSKLNYLDPRISIAWCKRFRVPVEKIYSKTQRERFAWALAMAGEDFEF

SEQ ID NO: 89200 - protein, 376 aa, Homo sapiens
  Payload ID: 17864
  Gene Name: topoisomerase (DNA) I, mitochondrial
  ENSP ID: ENSP00000428451
MLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTVSWDGPAKPRNYRDHFPPQTTSLNKHLQELMDGLTAKVFRTYNASITLQEQLRALTRAEDSIAAKILSY

SEQ ID NO: 89201 - protein, 164 aa, Homo sapiens
  Payload ID: 17864
  Gene Name: topoisomerase (DNA) I, mitochondrial
  ENSP ID: ENSP00000428723
MKSHPRKKAKNSQKGPFRNVCCTCFPLSDPSETSCCSEDTHPSRPGPPGPQQHYLAGVTCRSPGSGRWEKEKHEDGVKWRQLEHKGPYFAPPYEPLPDGVRFFYEGRPVRLSVAAEEVATFYGRMLDHEYTTKEVFRKNFFNDWRKEMAVEEREVIKSLDKCDF

SEQ ID NO: 89202 - protein, 167 aa, Homo sapiens
  Payload ID: 17864
  Gene Name: topoisomerase (DNA) I, mitochondrial
  ENSP ID: ENSP00000428727
MRVVRLLRLRAALTLLGEVPRRPASRGVPGSRRTQKGSGARWEKEKHEDGVKWRQLEHKGPYFAPPYEPLPDGVRFFYEGRPVRLSVAAEEVATFYGRMLDHEYTTKEVFRKNFFNDWRKEMAVEEREVIKSLDKCDFTEIHRYFVDKAAARKVLSREEKQMVTKKK

SEQ ID NO: 89203 - protein, 164 aa, Homo sapiens
  Payload ID: 17864
  Gene Name: topoisomerase (DNA) I, mitochondrial
  ENSP ID: ENSP00000428931
MRVVRLLRLRAALTLLGEVPRRPASRGVPGSRRTQKGSGARNSQKGPFRNVCCTCFPLSDPSETSCCSEDTHPSRPGPPGPQQHYLAGVTCRSPGSGRWEKEKHEDGVKWRQLEHKGPYFAPPYEPLPDGVRFFYEGRPVRLSVAAEEVATFYGRMLDHEYTTK

SEQ ID NO: 89204 - protein, 503 aa, Homo sapiens; identical to SEQ ID NO: 89199
  Payload ID: 17864
  Gene Name: topoisomerase (DNA) I, mitochondrial
  Uniprot ID: Q969P6
  ENSP ID: ENSP00000429169

SEQ ID NO: 89205 - protein, 201 aa, Homo sapiens
  Payload ID: 17864
  Gene Name: topoisomerase (DNA) I, mitochondrial
  ENSP ID: ENSP00000429177
MLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRA

SEQ ID NO: 89206 - protein, 503 aa, Homo sapiens; identical to SEQ ID NO: 89199
  Payload ID: 17864
  Gene Name: topoisomerase (DNA) I, mitochondrial
  Uniprot ID: Q969P6
  ENSP ID: ENSP00000429181

SEQ ID NO: 89207 - protein, 49 aa, Homo sapiens
  Payload ID: 17864
  Gene Name: topoisomerase (DNA) I, mitochondrial
  ENSP ID: ENSP00000430139
ATFYGRMLDHEYTTKEVFRKNFFNDWRKAPLLDPLLWPDATPLPFTTAL

SEQ ID NO: 89208 - protein, 134 aa, Homo sapiens
  Payload ID: 17864
  Gene Name: topoisomerase (DNA) I, mitochondrial
  ENSP ID: ENSP00000430209
MKSHPRKKAKWEKEKHEDGVKWRQLEHKGPYFAPPYEPLPDGVRFFYEGRPVRLSVAAEEVATFYGRMLDHEYTTKEVFRKNFFNDWRKEMAVEEREVIKSLDKCDFTEIHRYFVDKAAARKVLSREEKQKLKE

SEQ ID NO: 89209 - protein, 33 aa, Homo sapiens
  Payload ID: 17864
  Gene Name: topoisomerase (DNA) I, mitochondrial
  ENSP ID: ENSP00000430635
MLDHEYTTKEVFRKNFFNDWRKEMAVEEREVIK

SEQ ID NO: 89210 - protein, 123 aa, Homo sapiens
  Payload ID: 17864
  Gene Name: topoisomerase (DNA) I, mitochondrial
  ENSP ID: ENSP00000430679
  MOD_RES (1)..(1): Any amino acid
XLRLRAALTLLGEVPRRPASRGVPGSRRTQKGSGARWEKEKHEDGVKWRQLEHKGPYFAPPYEPLPDGVRFFYEGRPVRLSVAAEEVATFYGRMLDHEYTTKEVFRKNFFNDWRKVLCQTHML

SEQ ID NO: 89211 - protein, 1531 aa, Homo sapiens
  Payload ID: 17865
  Gene Name: topoisomerase (DNA) II alpha
  Uniprot ID: P11388
  ENSP ID: ENSP00000411532
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 89212 - protein, 147 aa, Homo sapiens
  Payload ID: 17865
  Gene Name: topoisomerase (DNA) II alpha
  ENSP ID: ENSP00000462908
MQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVT

SEQ ID NO: 89213 - protein, 27 aa, Homo sapiens
  Payload ID: 17865
  Gene Name: topoisomerase (DNA) II alpha
  ENSP ID: ENSP00000464055
AVAPRAKSVRAKKPIKYLEESDEDDLF

SEQ ID NO: 89214 - protein, 1626 aa, Homo sapiens
  Payload ID: 17866
  Gene Name: topoisomerase (DNA) II beta
  Uniprot ID: Q02880
  ENSP ID: ENSP00000264331
MAKSGGCGAGAGVGGGNGALTWVTLFDQNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 89215 - protein, 70 aa, Homo sapiens
  Payload ID: 17866
  Gene Name: topoisomerase (DNA) II beta
  ENSP ID: ENSP00000388216
VLFDHMGCLKKYETVQDILKEFFDLRLSYYGLRKEWLVGMLGAESTKLNNQARFILEKIQGKITIGSRRG

SEQ ID NO: 89216 - protein, 1150 aa, Homo sapiens
  Payload ID: 17866
  Gene Name: topoisomerase (DNA) II beta
  ENSP ID: ENSP00000391112
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLT

SEQ ID NO: 89217 - protein, 1621 aa, Homo sapiens
  Payload ID: 17866
  Gene Name: topoisomerase (DNA) II beta
  Uniprot ID: Q02880
  ENSP ID: ENSP00000396704
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 89218 - protein, 1522 aa, Homo sapiens
  Payload ID: 17867
  Gene Name: topoisomerase (DNA) II binding protein 1
  Uniprot ID: Q92547
  ENSP ID: ENSP00000260810
MSRNDKEPFFVKFLKSSDNSKCFFKALESIKEFQSEEYLQIITEEEALKIKENDRSLYICDPFSGVVFDHLKKLGCRIVGPQVVIFCMHHQRCVPRAEHPVYNMVMSDVTISCTSLEKEKREEVHKYVQMMGGRVYRDLNVSVTHLIAGEVGSKKYLVAANLKKPILLPSWIKTLWEKSQEKKITRYTDINMEDFKCPIFLGCIICVTGLCGLDRKEVQQLTVKHGGQYMGQLKMNECTHLIVQEPKGQKYECAKRWNVHCVTTQWFFDSIEKGFCQDESIYKTEPRPEAKTMPNSSTPTSQINTIDSRTLSDVSNISNINASCVSESICNSLNSKLEPTLENLENLDVSAFQAPEDLLDGCRIYLCGFSGRKLDKLRRLINSGGGVRFNQLNEDVTHVIVGDYDDELKQFWNKSAHRPHVVGAKWLLECFSKGYMLSEEPYIHANYQPVEIPVSHKPESKAALLKKKNSSFSKKDFAPSEKHEQADEDLLSQYENGSSTVVEAKTSEARPFNDSTHAEPLNDSTHISLQEENQSSVSHCVPDVSTITEEGLFSQKSFLVLGFSNENESNIANIIKENAGKIMSLLSRTVADYAVVPLLGCEVEATVGEVVTNTWLVTCIDYQTLFDPKSNPLFTPVPVMTGMTPLEDCVISFSQCAGAEKESLTFLANLLGASVQEYFVRKSNAKKGMFASTHLILKERGGSKYEAAKKWNLPAVTIAWLLETARTGKRADESHFLIENSTKEERSLETEITNGINLNSDTAEHPGTRLQTHRKTVVTPLDMNRFQSKAFRAVVSQHARQVAASPAVGQPLQKEPSLHLDTPSKFLSKDKLFKPSFDVKDALAALETPGRPSQQKRKPSTPLSEVIVKNLQLALANSSRNAVALSASPQLKEAQSEKEEAPKPLHKVVVCVSKKLSKKQSELNGIAASLGADYRWSFDETVTHFIYQGRPNDTNREYKSVKERGVHIVSEHWLLDCAQECKHLPESLYPHTYNPKMSLDISAVQDGRLCNSRLLSAVSSTKDDEPDPLILEENDVDNMATNNKESAPSNGSGKNDSKGVLTQTLEMRENFQKQLQEIMSATSIVKPQGQRTSLSRSGCNSASSTPDSTRSARSGRSRVLEALRQSRQTVPDVNTEPSQNEQIIWDDPTAREERARLASNLQWPSCPTQYSELQVDIQNLEDSPFQKPLHDSEIAKQAVCDPGNIRVTEAPKHPISEELETPIKDSHLIPTPQAPSIAFPLANPPVAPHPREKIITIEETHEELKKQYIFQLSSLNPQERIDYCHLIEKLGGLVIEKQCFDPTCTHIVVGHPLRNEKYLASVAAGKWVLHRSYLEACRTAGHFVQEEDYEWGSSSILDVLTGINVQQRRLALAAMRWRKKIQQRQESGIVEGAFSGWKVILHVDQSREAGFKRLLQSGGAKVLPGHSVPLFKEATHLFSDLNKLKPDDSGVNIAEAAAQNVYCLRTEYIADYLMQESPPHVENYCLPEAISFIQNNKELGTGLSQKRKAPTEKNKIKRPRVH

SEQ ID NO: 89219 - protein, 206 aa, Homo sapiens
  Payload ID: 17867
  Gene Name: topoisomerase (DNA) II binding protein 1
  ENSP ID: ENSP00000421179
  MOD_RES (1)..(1): Any amino acid
XLVAANLKKPILLPSWIKTLWEKSQEKKITRYTDINMEDFKCPIFLGCIICVTGLCGLDRKEVQQLTVKHGGQYMGQLKMNECTHLIVQEPKGQKYECAKRWNVHCVTTQWFFDSIEKGFCQDESIYKTEPRPEAKTMPNSSTPTSQINTIDNVSNISNINASCVSESICNSLNSKLEPTLENLENLDVSAFQAPEDLLDGCRIYL

SEQ ID NO: 89220 - protein, 50 aa, Homo sapiens
  Payload ID: 17867
  Gene Name: topoisomerase (DNA) II binding protein 1
  ENSP ID: ENSP00000458790
FFDSIEKGFCQDESIYKTEPRPEAKTMPNSSTPTSQINTIDTNWSLHLKI

SEQ ID NO: 89221 - protein, 1001 aa, Homo sapiens
  Payload ID: 17868
  Gene Name: topoisomerase (DNA) III alpha
  Uniprot ID: Q13472
  ENSP ID: ENSP00000321636
MIFPVARYALRWLRRPEDRAFSRAAMEMALRGVRKVLCVAEKNDAAKGIADLLSNGRMRRREGLSKFNKIYEFDYHLYGQNVTMVMTSVSGHLLAHDFQMQFRKWQSCNPLVLFEAEIEKYCPENFVDIKKTLERETRQCQALVIWTDCDREGENIGFEIIHVCKAVKPNLQVLRARFSEITPHAVRTACENLTEPDQRVSDAVDVRQELDLRIGAAFTRFQTLRLQRIFPEVLAEQLISYGSCQFPTLGFVVERFKAIQAFVPEIFHRIKVTHDHKDGIVEFNWKRHRLFNHTACLVLYQLCVEDPMATVVEVRSKPKSKWRPQALDTVELEKLASRKLRINAKETMRIAEKLYTQGYISYPRTETNIFPRDLNLTVLVEQQTPDPRWGAFAQSILERGGPTPRNGNKSDQAHPPIHPTKYTNNLQGDEQRLYEFIVRHFLACCSQDAQGQETTVEIDIAQERFVAHGLMILARNYLDVYPYDHWSDKILPVYEQGSHFQPSTVEMVDGETSPPKLLTEADLIALMEKHGIGTDATHAEHIETIKARMYVGLTPDKRFLPGHLGMGLVEGYDSMGYEMSKPDLRAELEADLKLICDGKKDKFVVLRQQVQKYKQVFIEAVAKAKKLDEALAQYFGNGTELAQQEDIYPAMPEPIRKCPQCNKDMVLKTKKNGGFYLSCMGFPECRSAVWLPDSVLEASRDSSVCPVCQPHPVYRLKLKFKRGSLPPTMPLEFVCCIGGCDDTLREILDLRFSGGPPRASQPSGRLQANQSLNRMDNSQHPQPADSRQTGSSKALAQTLPPPTAAGESNSVTCNCGQEAVLLTVRKEGPNRGRQFFKCNGGSCNFFLWADSPNPGAGGPPALAYRPLGASLGCPPGPGIHLGGFGNPGDGSGSGTSCLCSQPSVTRTVQKDGPNKGRQFHTCAKPREQQCGFFQWVDENTAPGTSGAPSWTGDRGRTLESEARSKRPRASSSDMGSTAKKPRKCSLCHQPGHTRPFCPQNR

SEQ ID NO: 89222 - protein, 1001 aa, Homo sapiens; identical to SEQ ID NO: 89221
  Payload ID: 17868
  Gene Name: topoisomerase (DNA) III alpha
  Uniprot ID: Q13472
  ENSP ID: ENSP00000442336

SEQ ID NO: 89223 - protein, 69 aa, Homo sapiens
  Payload ID: 17868
  Gene Name: topoisomerase (DNA) III alpha
  ENSP ID: ENSP00000462136
MIFPVARYALRWLRRPEDRAFSRAAMEMALRGVRKVLCVAEKNDAAKGIADLLSNGRMRRAELQPSCPL

SEQ ID NO: 89224 - protein, 89 aa, Homo sapiens
  Payload ID: 17868
  Gene Name: topoisomerase (DNA) III alpha
  ENSP ID: ENSP00000462378
MIFPVARYALRWLRRPEDRAFSRAAMEMALRGVRKVLCVAEKNDAAKGIADLLSNGRMRRREGLSKFNKIYEFDYHLYGQAELQPSCPL

SEQ ID NO: 89225 - protein, 976 aa, Homo sapiens
  Payload ID: 17868
  Gene Name: topoisomerase (DNA) III alpha
  Uniprot ID: Q13472
  ENSP ID: ENSP00000462790
MEMALRGVRKVLCVAEKNDAAKGIADLLSNGRMRRREGLSKFNKIYEFDYHLYGQNVTMVMTSVSGHLLAHDFQMQFRKWQSCNPLVLFEAEIEKYCPENFVDIKKTLERETRQCQALVIWTDCDREGENIGFEIIHVCKAVKPNLQVLRARFSEITPHAVRTACENLTEPDQRVSDAVDVRQELDLRIGAAFTRFQTLRLQRIFPEVLAEQLISYGSCQFPTLGFVVERFKAIQAFVPEIFHRIKVTHDHKDGIVEFNWKRHRLFNHTACLVLYQLCVEDPMATVVEVRSKPKSKWRPQALDTVELEKLASRKLRINAKETMRIAEKLYTQGYISYPRTETNIFPRDLNLTVLVEQQTPDPRWGAFAQSILERGGPTPRNGNKSDQAHPPIHPTKYTNNLQGDEQRLYEFIVRHFLACCSQDAQGQETTVEIDIAQERFVAHGLMILARNYLDVYPYDHWSDKILPVYEQGSHFQPSTVEMVDGETSPPKLLTEADLIALMEKHGIGTDATHAEHIETIKARMYVGLTPDKRFLPGHLGMGLVEGYDSMGYEMSKPDLRAELEADLKLICDGKKDKFVVLRQQVQKYKQVFIEAVAKAKKLDEALAQYFGNGTELAQQEDIYPAMPEPIRKCPQCNKDMVLKTKKNGGFYLSCMGFPECRSAVWLPDSVLEASRDSSVCPVCQPHPVYRLKLKFKRGSLPPTMPLEFVCCIGGCDDTLREILDLRFSGGPPRASQPSGRLQANQSLNRMDNSQHPQPADSRQTGSSKALAQTLPPPTAAGESNSVTCNCGQEAVLLTVRKEGPNRGRQFFKCNGGSCNFFLWADSPNPGAGGPPALAYRPLGASLGCPPGPGIHLGGFGNPGDGSGSGTSCLCSQPSVTRTVQKDGPNKGRQFHTCAKPREQQCGFFQWVDENTAPGTSGAPSWTGDRGRTLESEARSKRPRASSSDMGSTAKKPRKCSLCHQPGHTRPFCPQNR

SEQ ID NO: 89226 - protein, 139 aa, Homo sapiens
  Payload ID: 17868
  Gene Name: topoisomerase (DNA) III alpha
  ENSP ID: ENSP00000464338
MIFPVARYALRWLRRPEDRAFSRAAMEMALRGVRKVLCVAEKNDAAKGIADLLSNGRMRRREGLSKFNKIYEFDYHLYGQNVTMVMTSVSGHLLAHDFQMQFRKWSVQFSREGLSDYSRAATLLSSLKQKLKSTAQRIL

SEQ ID NO: 89227 - protein, 95 aa, Homo sapiens
  Payload ID: 17868
  Gene Name: topoisomerase (DNA) III alpha
  ENSP ID: ENSP00000464493
MIFPVARYALRWLRRPEDRAFSRAAMEMALRGVRKVLCVAEKNDAAKGIADLLSNGRMRRREGLSKFNKIYEFDYHLYGQNVTMAGVQWHNLDSL

SEQ ID NO: 89228 - protein, 52 aa, Homo sapiens
  Payload ID: 17868
  Gene Name: topoisomerase (DNA) III alpha
  ENSP ID: ENSP00000465014
  MOD_RES (1)..(1): Any amino acid
XTGDRGRTLESEARSKRPRASSSDMGSTAKKPRKCSLCHQPGHTRPFCPQNR

SEQ ID NO: 89229 - protein, 25 aa, Homo sapiens
  Payload ID: 17868
  Gene Name: topoisomerase (DNA) III alpha
  ENSP ID: ENSP00000465864
  MOD_RES (1)..(1): Any amino acid
XAKKPRKCSLCHQPGHTRPFCPQNR

SEQ ID NO: 89230 - protein, 133 aa, Homo sapiens
  Payload ID: 17868
  Gene Name: topoisomerase (DNA) III alpha
  ENSP ID: ENSP00000466099
FVAHGLMILARNYLDVYPYDHWSDKILPVYEQGSHFQPSTVEMVDGETSPPKLLTEADLIALMEKHGIGQWLLWVRMPLMRSTSRPSKPGCTWASPQTSGSSLGTWAWDLWKVMIPWAMKCLSLTSGLNWKLI

SEQ ID NO: 89231 - protein, 163 aa, Homo sapiens
  Payload ID: 17868
  Gene Name: topoisomerase (DNA) III alpha
  ENSP ID: ENSP00000466641
  MOD_RES (1)..(1): Any amino acid
XSYGSCQFPTLGFVVERFKAIQAFVPEIFHRIKVTHDHKDGIVEFNWKRHRLFNHTACLVLYQLCVEDPMATVVEVRSKPKSKWRPQALDTVELEKLASRKLRINAKETMRIAEKLYTQGEMNSDCTSLLFAISWLAAPRMLRGRRPQWRSTSLRNALWPMAS

SEQ ID NO: 89232 - protein, 862 aa, Homo sapiens
  Payload ID: 17869
  Gene Name: topoisomerase (DNA) III beta
  Uniprot ID: O95985
  ENSP ID: ENSP00000349705
MKTVLMVAEKPSLAQSIAKILSRGSLSSHKGLNGACSVHEYTGTFAGQPVRFKMTSVCGHVMTLDFLGKYNKWDKVDPAELFSQAPTEKKEANPKLNMVKFLQVEGRGCDYIVLWLDCDKEGENICFEVLDAVLPVMNKAHGGEKTVFRARFSSITDTDICNAMACLGEPDHNEALSVDARQELDLRIGCAFTRFQTKYFQGKYGDLDSSLISFGPCQTPTLGFCVERHDKIQSFKPETYWVLQAKVNTDKDRSLLLDWDRVRVFDREIAQMFLNMTKLEKEAQVEATSRKEKAKQRPLALNTVEMLRVASSSLGMGPQHAMQTAERLYTQGYISYPRTETTHYPENFDLKGSLRQQANHPYWADTVKRLLAEGINRPRKGHDAGDHPPITPMKSATEAELGGDAWRLYEYITRHFIATVSHDCKYLQSTISFRIGPELFTCSGKTVLSPGFTEVMPWQSVPLEESLPTCQRGDAFPVGEVKMLEKQTNPPDYLTEAELITLMEKHGIGTDASIPVHINNICQRNYVTVESGRRLKPTNLGIVLVHGYYKIDAELVLPTIRSAVEKQLNLIAQGKADYRQVLGHTLDVFKRKFHYFVDSIAGMDELMEVSFSPLAATGKPLSRCGKCHRFMKYIQAKPSRLHCSHCDETYTLPQNGTIKLYKELRCPLDDFELVLWSSGSRGKSYPLCPYCYNHPPFRDMKKGMGCNECTHPSCQHSLSMLGIGQCVECESGVLVLDPTSGPKWKVACNKCNVVAHCFENAHRVRVSADTCSVCEAALLDVDFNKAKSPLPGDETQHMGCVFCDPVFQELVELKHAASCHPMHRGGPGRRQGRGRGRARRPPGKPNPRRPKDKMSALAAYFV

SEQ ID NO: 89233 - protein, 862 aa, Homo sapiens; identical to SEQ ID NO: 89232
  Payload ID: 17869
  Gene Name: topoisomerase (DNA) III beta
  Uniprot ID: O95985
  ENSP ID: ENSP00000381773

SEQ ID NO: 89234 - protein, 42 aa, Homo sapiens
  Payload ID: 17869
  Gene Name: topoisomerase (DNA) III beta
  ENSP ID: ENSP00000387554
MKTVLMVAEKPSLAQSIAKILSRGSLSSHKGLNGACSVHEYT

SEQ ID NO: 89235 - protein, 46 aa, Homo sapiens
  Payload ID: 17869
  Gene Name: topoisomerase (DNA) III beta
  ENSP ID: ENSP00000390209
MKTVLMVAEKPSLAQSIAKILSRGSLSSHKGLNGACSVHEYTGTFA

SEQ ID NO: 89236 - protein, 21 aa, Homo sapiens
  Payload ID: 17869
  Gene Name: topoisomerase (DNA) III beta
  ENSP ID: ENSP00000390824
MKTVLMVAEKPSLAQSIAKIL

SEQ ID NO: 89237 - protein, 246 aa, Homo sapiens
  Payload ID: 17869
  Gene Name: topoisomerase (DNA) III beta
  ENSP ID: ENSP00000390977
MKTVLMVAEKPSLAQSIAKILSRGSLSSHKGLNGACSVHEYTGTFAGQPVRFKMTSVCGHVMTLDFLGKYNKWDKVDPAELFSQAPTEKKEANPKLNMVKFLQVEGRGCDYIVLWLDCDKEGENICFEVLDAVLPVMNKAHGGEKTVFRARFSSITDTDICNAMACLGEPDHNEALSVDARQELDLRIGCAFTRFQTKYFQGKYGDLDSSLISFGPCQTPTLGFCVERHDKIQSFKPETYWVLQAK

SEQ ID NO: 89238 - protein, 61 aa, Homo sapiens
  Payload ID: 17869
  Gene Name: topoisomerase (DNA) III beta
  ENSP ID: ENSP00000391857
MKTVLMVAEKPSLAQSIAKILSRGSLSSHKGLNGACSVHEYTGTFAGQPVRFKMTSVCGHV

SEQ ID NO: 89239 - protein, 129 aa, Homo sapiens
  Payload ID: 17869
  Gene Name: topoisomerase (DNA) III beta
  ENSP ID: ENSP00000392480
MKTVLMVAEKPSLAQSIAKILSRGSLSSHKGLNGACSVHEYTGTFAGQPVRFKMTSVCGHVMTLDFLGKYNKWDKVDPAELFSQAPTEKKEANPKLNMVKFLQVEGRGCDYIVLWLDCDKEGENICFEK

SEQ ID NO: 89240 - protein, 129 aa, Homo sapiens; identical to SEQ ID NO: 89239
  Payload ID: 17869
  Gene Name: topoisomerase (DNA) III beta
  ENSP ID: ENSP00000397221

SEQ ID NO: 89241 - protein, 122 aa, Homo sapiens
  Payload ID: 17869
  Gene Name: topoisomerase (DNA) III beta
  ENSP ID: ENSP00000402622
MKTVLMVAEKPSLAQSIAKILSRGSLSSHKGLNGACSVHEYTGTFAGQPVRFKMTSVCGHVMTLDFLGKYNKWDKVDPAELFSQAPTEKKEANPKLNMVKFLQVEGRGCDYIVLWLDCDKEG

SEQ ID NO: 89242 - protein, 60 aa, Homo sapiens
  Payload ID: 17869
  Gene Name: topoisomerase (DNA) III beta
  ENSP ID: ENSP00000404600
MKTVLMVAEKPSLAQSIAKILSRGSLSSHKGLNGACSVHEYTGTFAGQPVRFKMTSVCGH

SEQ ID NO: 89243 - protein, 525 aa, Homo sapiens
  Payload ID: 17869
  Gene Name: topoisomerase (DNA) III beta
  ENSP ID: ENSP00000408282
  MOD_RES (1)..(1): Any amino acid
XLDSSLISFGPCQTPTLGFCVERHDKIQSFKPETYWVLQAKVNTDKDRSLLLDWDRVRVFDREIAQMFLNMTKLEKEAQVEATSRKEKAKQRPLALNTVEMLRVASSSLGMGPQHAMQTAERLYTQGYISYPRTETTHYPENFDLKGSLRQQANHPYWADTVKRLLAEGINRPRKGHDAGDHPPITPMKSATEAELGGDAWRLYEYITRHFIATVSHDCKYLQSTISFRIGPELFTCSGKTVLSPGFTEVMPWQSVPLEESLPTCQRGDAFPVGEVKMLEKQTNPPDYLTEAELITLMEKHGIGTDASIPVHINNICQRNYVTVESGRRLKPTNLGIVLVHGYYKIDAELVLPTIRSAVEKQLNLIAQGKADYRQVLGHTLDVFKRKFHYFVDSIAGMDELMEVSFSPLAATGKPLSRCGKCHRFMKYIQAKPSRLHCSHCDETYTLPQNGTIKLYKELRCPLDDFELVLWSSGSRGKSYPLCPYCYNHPPFRDMKKGECSHSLLSTGSCSLFSVPTPALHQAGL

SEQ ID NO: 89244 - protein, 121 aa, Homo sapiens
  Payload ID: 17869
  Gene Name: topoisomerase (DNA) III beta
  ENSP ID: ENSP00000414538
MKTVLMVAEKPSLAQSIAKILSRGSLSSHKGLNGACSVHEYTGTFAGQPVRFKMTSVCGHVMTLDFLGKYNKWDKVDPAELFSQAPTEKKEANPKLNMVKFLQVEGRGCDYIVLWLDCDKE

SEQ ID NO: 89245 - protein, 168 aa, Homo sapiens
  Payload ID: 17869
  Gene Name: topoisomerase (DNA) III beta
  ENSP ID: ENSP00000416451
IAQMFLNMTKLEKEAQVEATSRKEKAKQRPLALNTVEMLRVASSSLGMGPQHAMQTAERLYTQGYISYPRTETTHYPENFDLKGSLRQQANHPYWADTVKRLLAEGINRPRKGHDAGDHPPITPMKSATEAELGFAVCPAQRLCKQELAARARVLGAPHGQSPQLAPN

SEQ ID NO: 89246 - protein, 1045 aa, Homo sapiens
  Payload ID: 17870
  Gene Name: topoisomerase I binding, arginine/serine-rich, E3 ubiquitin protein ligase
  Uniprot ID: Q9NS56
  ENSP ID: ENSP00000353735
MGSQPPLGSPLSREEGEAPPPAPASEGRRRSRRVRLRGSCRHRPSFLGCRELAASAPARPAPASSEIMASAAKEFKMDNFSPKAGTSKLQQTVPADASPDSKCPICLDRFDNVSYLDRCLHKFCFRCVQEWSKNKAECPLCKQPFDSIFHSVRAEDDFKEYVLRPSYNGSFVTPDRRFRYRTTLTRERNASVYSPSGPVNRRTTTPPDSGVLFEGLGISTRPRDVEIPQFMRQIAVRRPTTADERSLRKIQEQDIINFRRTLYRAGARVRNIEDGGRYRDISAEFFRRNPACLHRLVPWLKRELTVLFGAHGSLVNIVQHIIMSNVTRYDLESQAFVSDLRPFLLNRTEHFIHEFISFARSPFNMAAFDQHANYDCPAPSYEEGSHSDSSVITISPDEAETQELDINVATVSQAPWDDETPGPSYSSSEQVHVTMSSLLNTSDSSDEELVTGGATSQIQGVQTNDDLNNDSDDSSDNCVIVGFVKPLAERTPELVELSSDSEDLGSYEKMETVKTQEQEQSYSSGDSDVSRCSSPHSVLGKDEQINKGHCDSSTRIKSKKEEKRSTSLSSPRNLNSSVRGDRVYSPYNHRHRKRGRSRSSDSRSQSRSGHDQKNHRKHHGKKRMKSKRSRSRESSRPRGRRDKKRSRTRDSSWSRRSQTLSLSSESTSRSRSRSSDHGKRRSRSRNRDRYYLRNNYGSRYKWEYTYYSRNKDRDGYESSYRRRTLSRAHYSRQSSSPEFRVQSFSERTNARKKNNHSERKYYYYERHRSRSLSSNRSRTASTGTDRVRNEKPGGKRKYKTRHLEGTNEVAQPSREFASKAKDSHYQKSSSKLDGNYKNESDTFSDSRSSDRETKHKRRKRKTRSLSVEIVYEGKATDTTKHHKKKKKKHKKKHKKHHGDNASRSPVVITIDSDSDKDSEVKEDTECDNSGPQDPLQNEFLAPSLEPFETKDVVTIEAEFGVLDKECDIATLSNNLNNANKTVDNIPPLAASVEQTLDVREESTFVSDLENQPSNIVSLQTEPSRQLPSPRTSLMSVCLGRDCDMS

SEQ ID NO: 89247 - protein, 980 aa, Homo sapiens
  Payload ID: 17870
  Gene Name: topoisomerase I binding, arginine/serine-rich, E3 ubiquitin protein ligase
  Uniprot ID: Q9NS56
  ENSP ID: ENSP00000369187
MIMASAAKEFKMDNFSPKAGTSKLQQTVPADASPDSKCPICLDRFDNVSYLDRCLHKFCFRCVQEWSKNKAECPLCKQPFDSIFHSVRAEDDFKEYVLRPSYNGSFVTPDRRFRYRTTLTRERNASVYSPSGPVNRRTTTPPDSGVLFEGLGISTRPRDVEIPQFMRQIAVRRPTTADERSLRKIQEQDIINFRRTLYRAGARVRNIEDGGRYRDISAEFFRRNPACLHRLVPWLKRELTVLFGAHGSLVNIVQHIIMSNVTRYDLESQAFVSDLRPFLLNRTEHFIHEFISFARSPFNMAAFDQHANYDCPAPSYEEGSHSDSSVITISPDEAETQELDINVATVSQAPWDDETPGPSYSSSEQVHVTMSSLLNTSDSSDEELVTGGATSQIQGVQTNDDLNNDSDDSSDNCVIVGFVKPLAERTPELVELSSDSEDLGSYEKMETVKTQEQEQSYSSGDSDVSRCSSPHSVLGKDEQINKGHCDSSTRIKSKKEEKRSTSLSSPRNLNSSVRGDRVYSPYNHRHRKRGRSRSSDSRSQSRSGHDQKNHRKHHGKKRMKSKRSRSRESSRPRGRRDKKRSRTRDSSWSRRSQTLSLSSESTSRSRSRSSDHGKRRSRSRNRDRYYLRNNYGSRYKWEYTYYSRNKDRDGYESSYRRRTLSRAHYSRQSSSPEFRVQSFSERTNARKKNNHSERKYYYYERHRSRSLSSNRSRTASTGTDRVRNEKPGGKRKYKTRHLEGTNEVAQPSREFASKAKDSHYQKSSSKLDGNYKNESDTFSDSRSSDRETKHKRRKRKTRSLSVEIVYEGKATDTTKHHKKKKKKHKKKHKKHHGDNASRSPVVITIDSDSDKDSEVKEDTECDNSGPQDPLQNEFLAPSLEPFETKDVVTIEAEFGVLDKECDIATLSNNLNNANKTVDNIPPLAASVEQTLDVREESTFVSDLENQPSNIVSLQTEPSRQLPSPRTSLMSVCLGRDCDMS

SEQ ID NO: 89248 - protein, 178 aa, Homo sapiens
  Payload ID: 17871
  Gene Name: TOR signaling pathway regulator
  Uniprot ID: O75663
  ENSP ID: ENSP00000356804
MMIHGFQSSHRDFCFGPWKLTASKTHIMKSADVEKLADELHMPSLPEMMFGDNVLRIQHGSGFGIEFNATDALRCVNNYQGMLKVACAEEWQESRTEGEHSKEVIKPYDWTYTTDYKGTLLGESLKLKVVPTTDHIDTEKLKAREQIKFFEEVLLFEDELHDHGVSSLSVKIPGGGHL

SEQ ID NO: 89249 - protein, 272 aa, Homo sapiens
  Payload ID: 17871
  Gene Name: TOR signaling pathway regulator
  Uniprot ID: O75663
  ENSP ID: ENSP00000356807
MMIHGFQSSHRDFCFGPWKLTASKTHIMKSADVEKLADELHMPSLPEMMFGDNVLRIQHGSGFGIEFNATDALRCVNNYQGMLKVACAEEWQESRTEGEHSKEVIKPYDWTYTTDYKGTLLGESLKLKVVPTTDHIDTEKLKAREQIKFFEEVLLFEDELHDHGVSSLSVKIRVMPSSFFLLLRFFLRIDGVLIRMNDTRLYHEADKTYMLREYTSRESKISSLMHVPPSLFTEPNEISQYLPIKEAVCEKLIFPERIDPNPADSQKSTQVE

SEQ ID NO: 89250 - protein, 599 aa, Homo sapiens
  Payload ID: 17872
  Gene Name: torsin A interacting protein 1
  ENSP ID: ENSP00000271583
MAGDGRRAEAVREGWGVYVTPRAPIREGRGRLAPQNGGSSDAPAYRTPPSRQGRREVRFSDEPPEVYGDFEPLVAKERSPVGKRTRLEEFRSDSAKEEVRESAYYLRSRQRRQPRPQETEEMKTRRTTRLQQQHSEQPPLQPSPVMTRRGLRDSHSSEEDEASSQTDLSQTISKKTVRSIQEAPAVSEDLVIRLRRPPLRYPRYEATSVQQKVNFSEEGETEEDDQDSSHSSVTTVKARSRDSDESGDKTTRSSSQYIESFWQSSQSQNFTAHDKQPSVLSSGYQKTPQEWAPQTARIRTRMQTSSPGKSSIYGSFSDDDSILKSELGNQSPSTSSRQVTGQPQNASFVKRNRWWLLPLIAALASGSFWFFSTPEVETTAVQEFQNQMNQLKNKYQGQDEKLWKRSQTFLEKHLNSSHPRSQPAILLLTAARDAEEALRCLSEQIADAYSSFRSVRAIRIDGTDKATQDSDTVKLEVDQELSNGFKNGQNAAVVHRFESFPAGSTLIFYKYCDHENAAFKDVALVLTVLLEEETLGTSLGLKEVEEKVRDFLKVKFTNSNTPNSYNHMDPDKLNGLWSRISHLVLPVQPENALKRGICL

SEQ ID NO: 89251 - protein, 462 aa, Homo sapiens
  Payload ID: 17872
  Gene Name: torsin A interacting protein 1
  ENSP ID: ENSP00000393292
MKTRRTTRLQQQHSEQPPLQPSPVMTRRGLRDSHSSEEDEASSQTDLSQTISKKTVRSIQEAPVSEDLVIRLRRPPLRYPRYEATSVQQKVNFSEEGETEEDDQDSSHSSVTTVKARSRDSDESGDKTTRSSSQYIESFWQSSQSQNFTAHDKQPSVLSSGYQKTPQEWAPQTARIRTRMQNDSILKSELGNQSPSTSSRQVTGQPQNASFVKRNRWWLLPLIAALASGSFWFFSTPEVETTAVQEFQNQMNQLKNKYQGQDEKLWKRSQTFLEKHLNSSHPRSQPAILLLTAARDAEEALRCLSEQIADAYSSFRSVRAIRIDGTDKATQDSDTVKLEVDQELSNGFKNGQNAAVVHRFESFPAGSTLIFYKYCDHENAAFKDVALVLTVLLEEETLGTSLGLKEVEEKVRDFLKVKFTNSNTPNSYNHMDPDKLNGLWSRISHLVLPVQPENALKRGICL

SEQ ID NO: 89252 - protein, 296 aa, Homo sapiens
  Payload ID: 17872
  Gene Name: torsin A interacting protein 1
  ENSP ID: ENSP00000393613
  MOD_RES (1)..(1): Any amino acid
XKTTRSSSQYIESFWQSSQSQNFTAHDKQPSVLSSGYQKTPQEWAPQTARIRTRMQKVTGQPQNASFVKRNRWWLLPLIAALASGSFWFFSTPEVETTAVQEFQNQMNQLKNKYQGQDEKLWKRSQTFLEKHLNSSHPRSQPAILLLTAARDAEEALRCLSEQIADAYSSFRSVRAIRIDGTDKATQDSDTVKLEVDQELSNGFKNGQNAAVVHRFESFPAGSTLIFYKYCDHENAAFKDVALVLTVLLEEETLGTSLGLKEVEEKVRDFLKVKFTNSNTPNSYNHMDPDKLNGLW

SEQ ID NO: 89253 - protein, 198 aa, Homo sapiens
  Payload ID: 17872
  Gene Name: torsin A interacting protein 1
  ENSP ID: ENSP00000432717
  MOD_RES (1)..(1): Any amino acid
XLQQQHSEQPPLQPSPVMTRRGLRDSHSSEGEDRGEDEASSQTDLSQTISKKTVRSIQEAPVSEDLVIRLRRPPLRYPRYEATSVQQKVNFSEEGETEEDDQDSSHSSVTTVKARSRDSDESGDKTTRSSSQYIESFWQSSQSQNFTAHDKQPSVLSSGYQKTPQEWAPQTARIRTRMQNDSILKSELGNQSPSTSSR

SEQ ID NO: 89254 - protein, 63 aa, Homo sapiens
  Payload ID: 17872
  Gene Name: torsin A interacting protein 1
  ENSP ID: ENSP00000433759
  MOD_RES (1)..(1): Any amino acid
XSSEGEDRGGNSPSREPGNARGRARASVELMPAWCGGPCQKSATLVAVTVTSSSLANQTDKVT

SEQ ID NO: 89255 - protein, 193 aa, Homo sapiens
  Payload ID: 17872
  Gene Name: torsin A interacting protein 1
  ENSP ID: ENSP00000434316
EVRESAYYLRSRQRRQPRPQETEEMKTRRTTRLQQQHSEQPPLQPSPVMTRRGLRDSHSSEEDEASSQTDLSQTISKKTVRSIQEAPVSEDLVIRLRRPPLRYPRYGETEEDDQDSSHSSVTTVKARSRDSDESGDKTTRSSSQYIESFWQSSQSQNFTAHDKQPSVLSSGYQKTPQEWAPQTARIRTRMQND

SEQ ID NO: 89256 - protein, 584 aa, Homo sapiens
  Payload ID: 17872
  Gene Name: torsin A interacting protein 1
  Uniprot ID: Q5JTV8
  ENSP ID: ENSP00000435365
MAGDGRRAEAVREGWGVYVTPRAPIREGRGRLAPQNGGSSDAPAYRTPPSRQGRREVRFSDEPPEVYGDFEPLVAKERSPVGKRTRLEEFRSDSAKEEVRESAYYLRSRQRRQPRPQETEEMKTRRTTRLQQQHSEQPPLQPSPVMTRRGLRDSHSSEEDEASSQTDLSQTISKKTVRSIQEAPAVSEDLVIRLRRPPLRYPRYEATSVQQKVNFSEEGETEEDDQDSSHSSVTTVKARSRDSDESGDKTTRSSSQYIESFWQSSQSQNFTAHDKQPSVLSSGYQKTPQEWAPQTARIRTRMQNDSILKSELGNQSPSTSSRQVTGQPQNASFVKRNRWWLLPLIAALASGSFWFFSTPEVETTAVQEFQNQMNQLKNKYQGQDEKLWKRSQTFLEKHLNSSHPRSQPAILLLTAARDAEEALRCLSEQIADAYSSFRSVRAIRIDGTDKATQDSDTVKLEVDQELSNGFKNGQNAAVVHRFESFPAGSTLIFYKYCDHENAAFKDVALVLTVLLEEETLGTSLGLKEVEEKVRDFLKVKFTNSNTPNSYNHMDPDKLNGLWSRISHLVLPVQPENALKRGICL

SEQ ID NO: 89257 - protein, 583 aa, Homo sapiens
  Payload ID: 17872
  Gene Name: torsin A interacting protein 1
  Uniprot ID: Q5JTV8
  ENSP ID: ENSP00000476687
MAGDGRRAEAVREGWGVYVTPRAPIREGRGRLAPQNGGSSDAPAYRTPPSRQGRREVRFSDEPPEVYGDFEPLVAKERSPVGKRTRLEEFRSDSAKEEVRESAYYLRSRQRRQPRPQETEEMKTRRTTRLQQQHSEQPPLQPSPVMTRRGLRDSHSSEEDEASSQTDLSQTISKKTVRSIQEAPVSEDLVIRLRRPPLRYPRYEATSVQQKVNFSEEGETEEDDQDSSHSSVTTVKARSRDSDESGDKTTRSSSQYIESFWQSSQSQNFTAHDKQPSVLSSGYQKTPQEWAPQTARIRTRMQNDSILKSELGNQSPSTSSRQVTGQPQNASFVKRNRWWLLPLIAALASGSFWFFSTPEVETTAVQEFQNQMNQLKNKYQGQDEKLWKRSQTFLEKHLNSSHPRSQPAILLLTAARDAEEALRCLSEQIADAYSSFRSVRAIRIDGTDKATQDSDTVKLEVDQELSNGFKNGQNAAVVHRFESFPAGSTLIFYKYCDHENAAFKDVALVLTVLLEEETLGTSLGLKEVEEKVRDFLKVKFTNSNTPNSYNHMDPDKLNGLWSRISHLVLPVQPENALKRGICL

SEQ ID NO: 89258 - protein, 470 aa, Homo sapiens
  Payload ID: 17873
  Gene Name: torsin A interacting protein 2
  Uniprot ID: Q8NFQ8
  ENSP ID: ENSP00000356584
MADSGLREPQEDSQKDLENDPSVNSQAQETTIIASNAEEAEILHSACGLSKDHQEVETEGPESADTGDKSESPDEANVGKHPKDKTEDENKQSFLDGGKGHHLPSENLGKEPLDPDPSHSPSDKVGRADAHLGSSSVALPKEASDGTGASQEPPTTDSQEAQSPGHSSAGQEGEDTLRRRLLAPEAGSHPQQTQKLEEIKENAQDTMRQINKKGFWSYGPVILVVLVVAVVASSVNSYYSSPAQQVPKNPALEAFLAQFSQLEDKFPGQSSFLWQRGRKFLQKHLNASNPTEPATIIFTAAREGRETLKCLSHHVADAYTSSQKVSPIQIDGAGRTWQDSDTVKLLVDLELSYGFENGQKAAVVHHFESFPAGSTLIFYKYCDHENAAFKDVALVLTVLLEEETLEASVGPRETEEKVRDLLWAKFTNSDTPTSFNHMDSDKLSGLWSRISHLVLPVQPVSSIEEQGCLF

SEQ ID NO: 89259 - protein, 470 aa, Homo sapiens; identical to SEQ ID NO: 89258
  Payload ID: 17873
  Gene Name: torsin A interacting protein 2
  Uniprot ID: Q8NFQ8
  ENSP ID: ENSP00000477486

SEQ ID NO: 89260 - protein, 37 aa, Homo sapiens
  Payload ID: 17873
  Gene Name: torsin A interacting protein 2
  ENSP ID: ENSP00000485107
MFSDNSHCPDCGQQWFPSLELGHWLYQTELVENECYQ

SEQ ID NO: 89261 - protein, 131 aa, Homo sapiens
  Payload ID: 17873
  Gene Name: torsin A interacting protein 2
  Uniprot ID: Q9H496
  ENSP ID: ENSP00000485355
MFSDNSHCPDCGQQWFPSLELGHWLYQTELVENECYQVFLDRINRADYCPECYPDNPANRSLVLPWSFPLEWAPQNLTRWTFEKACHPFLLGPPLVRKRIHDSRVAGFNPALQLILTRTDKTLNKKLGQNK

SEQ ID NO: 89262 - protein, 332 aa, Homo sapiens
  Payload ID: 17874
  Gene Name: torsin family 1, member A (torsin A)
  Uniprot ID: O14656
  ENSP ID: ENSP00000345719
MKLGRAVLGLLLLAPSVVQAVEPISLGLALAGVLTGYIYPRLYCLFAECCGQKRSLSREALQKDLDDNLFGQHLAKKIILNAVFGFINNPKPKKPLTLSLHGWTGTGKNFVSKIIAENIYEGGLNSDYVHLFVATLHFPHASNITLYKDQLQLWIRGNVSACARSIFIFDEMDKMHAGLIDAIKPFLDYYDLVDGVSYQKAMFIFLSNAGAERITDVALDFWRSGKQREDIKLKDIEHALSVSVFNNKNSGFWHSSLIDRNLIDYFVPFLPLEYKHLKMCIRVEMQSRGYEIDEDIVSRVAEEMTFFPKEERVFSDKGCKTVFTKLDYYYDD

SEQ ID NO: 89263 - protein, 336 aa, Homo sapiens
  Payload ID: 17875
  Gene Name: torsin family 1, member B (torsin B)
  Uniprot ID: O14657
  ENSP ID: ENSP00000259339
MLRAGWLRGAAALALLLAARVVAAFEPITVGLAIGAASAITGYLSYNDIYCRFAECCREERPLNASALKLDLEEKLFGQHLATEVIFKALTGFRNNKNPKKPLTLSLHGWAGTGKNFVSQIVAENLHPKGLKSNFVHLFVSTLHFPHEQKIKLYQDQLQKWIRGNVSACANSVFIFDEMDKLHPGIIDAIKPFLDYYEQVDGVSYRKAIFIFLSNAGGDLITKTALDFWRAGRKREDIQLKDLEPVLSVGVFNNKHSGLWHSGLIDKNLIDYFIPFLPLEYRHVKMCVRAEMRARGSAIDEDIVTRVAEEMTFFPRDEKIYSDKGCKTVQSRLDFH

SEQ ID NO: 89264 - protein, 141 aa, Homo sapiens
  Payload ID: 17875
  Gene Name: torsin family 1, member B (torsin B)
  ENSP ID: ENSP00000411912
  MOD_RES (1)..(1): Any amino acid
XRVVAAFEPITVGLAIGAASAITGYLSYNDIYCRFAECCREERPLNASALKLDLEEKLFGQHLATEVIFKALTGFRNNKNPKKPLTLSLHGWAGTGKNFVSQIVAENLHPKGLKSNFVHLFVSTLHFPHEQKIKLYQSSLT

SEQ ID NO: 89265 - protein, 242 aa, Homo sapiens
  Payload ID: 17876
  Gene Name: torsin family 2, member A
  Uniprot ID: Q8N2E6
  ENSP ID: ENSP00000338317
MAAATRGCRPWGSLLGLLGLVSAAAAAWDLASLRCTLGAFCECDFRPDLPGLECDLAQHLAGQHLAKALVVKALKAFVRDPAPTKPLVLSLHGWTGTGKSYVSSLLAHYLFQGGLRSPRVHHFSPVLHFPHPSHIERYKKDLKSWVQGNLTACGRSLFLFDEMDKMPPGLMEVLRPFLGSSWVVYGTNYRKAIFIFIRWLLKLGHHGRAPPRRSGALPPAPAAPRPALRAQRAGPAGPGAKG

SEQ ID NO: 89266 - protein, 253 aa, Homo sapiens
  Payload ID: 17876
  Gene Name: torsin family 2, member A
  Uniprot ID: Q5JU69
  ENSP ID: ENSP00000362378
MAAATRGCRPWGSLLGLLGLVSAAAAAWDLASLRCTLGAFCECDFRPDLPGLECDLAQHLAGQHLAKALVVKALKAFVRDPAPTKPLVLSLHGWTGTGKSYVSSLLAHYLFQGGLRSPRVHHFSPVLHFPHPSHIERYKKDLKSWVQGNLTACGRSLFLFDEMDKMPPGLMEVLRPFLGSSWVVYGTNYRKAIFIFIRWGPALQWAQWGGHFSEVQLYSLSLCSQQNPVPHGLSWAFPVPSATLRDDIVIPPG

SEQ ID NO: 89267 - protein, 321 aa, Homo sapiens
  Payload ID: 17876
  Gene Name: torsin family 2, member A
  Uniprot ID: Q5JU69
  ENSP ID: ENSP00000362381
MAAATRGCRPWGSLLGLLGLVSAAAAAWDLASLRCTLGAFCECDFRPDLPGLECDLAQHLAGQHLAKALVVKALKAFVRDPAPTKPLVLSLHGWTGTGKSYVSSLLAHYLFQGGLRSPRVHHFSPVLHFPHPSHIERYKKDLKSWVQGNLTACGRSLFLFDEMDKMPPGLMEVLRPFLGSSWVVYGTNYRKAIFIFISNTGGKQINQVALEAWRSRRDREEILLQELEPVISRAVLDNPHHGFSNSGIMEERLLDAVVPFLPLQRHHVRHCVLNELAQLGLEPRDEVVQAVLDSTTFFPEDEQLFSSNGCKTVASRIAFFL

SEQ ID NO: 89268 - protein, 72 aa, Homo sapiens
  Payload ID: 17876
  Gene Name: torsin family 2, member A
  Uniprot ID: Q5JU69
  ENSP ID: ENSP00000485268
MAAATRGCRPWGSLLGLLGLVSAAAAAWDLASLRCTLGAFCECDFRPDLPEGSEELGPREPHCLWPLPLPLR

SEQ ID NO: 89269 - protein, 72 aa, Homo sapiens; identical to SEQ ID NO: 89268
  Payload ID: 17876
  Gene Name: torsin family 2, member A
  Uniprot ID: Q5JU69
  ENSP ID: ENSP00000485360

SEQ ID NO: 89270 - protein, 72 aa, Homo sapiens; identical to SEQ ID NO: 89268
  Payload ID: 17876
  Gene Name: torsin family 2, member A
  Uniprot ID: Q5JU69
  ENSP ID: ENSP00000485544

SEQ ID NO: 89271 - protein, 72 aa, Homo sapiens; identical to SEQ ID NO: 89268
  Payload ID: 17876
  Gene Name: torsin family 2, member A
  Uniprot ID: Q5JU69
  ENSP ID: ENSP00000485648

SEQ ID NO: 89272 - protein, 336 aa, Homo sapiens
  Payload ID: 17877
  Gene Name: torsin family 3, member A
  Uniprot ID: Q9H497
  ENSP ID: ENSP00000335351
MLRGPWRQLWLFFLLLLPGAPEPRGASRPWEGTDEPGSAWAWPGFQRLQEQLRAAGALSKRYWTLFSCQVWPDDCDEDEEAATGPLGWRLPLLGQRYLDLLTTWYCSFKDCCPRGDCRISNNFTGLEWDLNVRLHGQHLVQQLVLRTVRGYLETPQPEKALALSFHGWSGTGKNFVARMLVENLYRDGLMSDCVRMFIATFHFPHPKYVDLYKEQLMSQIRETQQLCHQTLFIFDEAEKLHPGLLEVLGPHLERRAPEGHRAESPWTIFLFLSNLRGDIINEVVLKLLKAGWSREEITMEHLEPHLQAEIVETIGFSFLTTRWPHLDLPTSSVAPT

SEQ ID NO: 89273 - protein, 153 aa, Homo sapiens
  Payload ID: 17877
  Gene Name: torsin family 3, member A
  ENSP ID: ENSP00000356597
MLRGPWRQLWLFFLLLLPGAPEPRGASRPWEGTDEPGSAWAWPGFQRLQEQLRAAGALSKRYWTLFSCQVWPDDCDEDEEAATGPLGWRLPLLGQRYLDLLTTWYCSFKDCCPRGDCRISNNFTGKNFVARMLVENLYRDGLMSDCVRMFIAT

SEQ ID NO: 89274 - protein, 397 aa, Homo sapiens
  Payload ID: 17877
  Gene Name: torsin family 3, member A
  Uniprot ID: Q9H497
  ENSP ID: ENSP00000356599
MLRGPWRQLWLFFLLLLPGAPEPRGASRPWEGTDEPGSAWAWPGFQRLQEQLRAAGALSKRYWTLFSCQVWPDDCDEDEEAATGPLGWRLPLLGQRYLDLLTTWYCSFKDCCPRGDCRISNNFTGLEWDLNVRLHGQHLVQQLVLRTVRGYLETPQPEKALALSFHGWSGTGKNFVARMLVENLYRDGLMSDCVRMFIATFHFPHPKYVDLYKEQLMSQIRETQQLCHQTLFIFDEAEKLHPGLLEVLGPHLERRAPEGHRAESPWTIFLFLSNLRGDIINEVVLKLLKAGWSREEITMEHLEPHLQAEIVETIDNGFGHSRLVKENLIDYFIPFLPLEYRHVRLCARDAFLSQELLYKEETLDEIAQMMVYVPKEEQLFSSQGCKSISQRINYFLS

SEQ ID NO: 89275 - protein, 174 aa, Homo sapiens
  Payload ID: 17877
  Gene Name: torsin family 3, member A
  ENSP ID: ENSP00000410195
MGLCVPFAVTTSFLSLGLEWDLNVRLHGQHLVQQLVLRTVRGYLETPQPEKALALSFHGWSGTGKNFVARMLVENLYRDGLMSDCVRMFIATFHFPHPKYVDLYKEQLMSQIRETQQLCHQTLFIFDEAEKLHPGLLEVLGPHLERRAPEGHRAESPWTIFLFLSNLRGDIINE

SEQ ID NO: 89276 - protein, 97 aa, Homo sapiens
  Payload ID: 17877
  Gene Name: torsin family 3, member A
  ENSP ID: ENSP00000435744
MLRGPWRQLWLFFLLLLPGAPEPRGASRPWEGTDEPGSAWAWPGFQRLQEQLRAAGALSKRYWTLFSCQVWPDDCDEDEEAATGPLALGNVRCGHAW

SEQ ID NO: 89277 - protein, 423 aa, Homo sapiens
  Payload ID: 17878
  Gene Name: torsin family 4, member A
  Uniprot ID: Q9NXH8
  ENSP ID: ENSP00000350102
MDRGQPSLEPAAAAPRASGRCVIAPVRAVLRLRRRVCVLRKRRLLQPGGGPDVGTGAPRPGCSPRAPRADLDQPKFFTFDSPAELPSRTPRKKRRRSRLVLYPETSRKYRPRVEHRSRAQRCLLLLVAIVGFQVLNAIENLDDNAQRYDLDGLEKALQRAVFGQPAAVSRIVALMRDYLATHVHSRPLLLALHGPSGVGKSHVGRLLARHFRSVLEDSALVLQYHARHHCPEARAAQDCREELARRVADVVARAEAEEKTPLLVLDDVELMPRPLLDELHGFLQPQRSHHFHNAIYVLLSGAGGAEVTRFVLQNASRALPLRPDGFRSAEAAAAQAEEDLRASLLAVLSREHPLWQAAAIVPFLLLDKRDVVSCFRDEMAGEGFFPDQARAENLAAQLSFYRVAGREFAVTGCKQVVATVNLL

SEQ ID NO: 89278 - protein, 116 aa, Homo sapiens
  Payload ID: 17879
  Gene Name: tousled-like kinase 1
  ENSP ID: ENSP00000352810
MSVQSSSGSLEGPPSWSQLSTSPTPGSAAAARSLLNHTPPSGRPREGAMDELHSLDPRRQELLEARFTGVASGSTGSTGSCSVGAKASTNNESSNHSFGSLGSLSDKESEKQLAGS

SEQ ID NO: 89279 - protein, 787 aa, Homo sapiens
  Payload ID: 17879
  Gene Name: tousled-like kinase 1
  Uniprot ID: Q9UKI8
  ENSP ID: ENSP00000354089
MSVQSSSGSLEGPPSWSQLSTSPTPGSAAAARSLLNHTPPSGRPREGAMDELHSLDPRRQELLEARFTGVASGSTGSTGSCSVGAKASTNNESSNHSFGSLGSLSDKESETPEKKQSESSRGRKRKAENQNESSQGFPNLPVFQSLAYWEMGRTAGGKSIGGRGHKISDYFEYQGGNGSSPVRGIPPAIRSPQNSHSHSTPSSSVRPNSPSPTALAFGDHPIVQPKQLSFKIIQTDLTMLKLAALESNKIQDLEKKEGRIDDLLRANCDLRRQIDEQQKLLEKYKERLNKCISMSKKLLIEKSTQEKLSSREKSMQDRLRLGHFTTVRHGASFTEQWTDGFAFQNLVKQQEWVNQQREDIERQRKLLAKRKPPTANNSQAPSTNSEPKQRKNKAVNGAENDPFVRPNLPQLLTLAEYHEQEEIFKLRLGHLKKEEAEIQAELERLERVRNLHIRELKRINNEDNSQFKDHPTLNERYLLLHLLGRGGFSEVYKAFDLYEQRYAAVKIHQLNKSWRDEKKENYHKHACREYRIHKELDHPRIVKLYDYFSLDTDTFCTVLEYCEGNDLDFYLKQHKLMSEKEARSIVMQIVNALRYLNEIKPPIIHYDLKPGNILLVDGTACGEIKITDFGLSKIMDDDSYGVDGMDLTSQGAGTYWYLPPECFVVGKEPPKISNKVDVWSVGVIFFQCLYGRKPFGHNQSQQDILQENTILKATEVQFPVKPVVSSEAKAFIRRCLAYRKEDRFDVHQLANDPYLLPHMRRSNSSGNLHMAGLTASPTPPSSSIITY

SEQ ID NO: 89280 - protein, 413 aa, Homo sapiens
  Payload ID: 17879
  Gene Name: tousled-like kinase 1
  ENSP ID: ENSP00000387313
MSVQSSSGSLEGPPSWSQLSTSPTPGSAAAARSLLNHTPPSGRPREGAMDELHSLDPRRQELLEARFTGVASGSTGSTGSCSVGAKASTNNESSNHSFGSLGSLSDKESETPEKKQSESSRGRKRKAENQNESSQGKSIGGRGHKISDYFEYQGGNGSSPVRGIPPAIRSPQNSHSHSTPSSSVRPNSPSPTALAFGDHPIVQPKQLSFKIIQTDLTMLKLAALESNKIQDLEKKEGRIDDLLRANCDLRRQIDEQQKLLEKYKERLNKCISMSKKLLIEKSTQEKLSSREKSMQDRLRLGHFTTVRHGASFTEQWTDGFAFQNLVKQQEWVNQQREDIERQRKLLAKRKPPTANNSQAPSTNSEPKQRKNKAVNGAENDPFVRPNLPQLLTLAEYHEQEEIFKLRLGHLKKR

SEQ ID NO: 89281 - protein, 162 aa, Homo sapiens
  Payload ID: 17879
  Gene Name: tousled-like kinase 1
  ENSP ID: ENSP00000393165
MAVLFLYDLKTTGKTPEKKQSESSRGRKRKAENQNESSQGFPNLPVFQSLAYWEMGRTAGGKSIGGRGHKISDYFEYQGGNGSSPVRGIPPAIRSPQNSHSHSTPSSSVRPNSPSPTALAFGDHPIVQPKQLSFKIIQTDLTMLKLAALESNKIQDLEKKEG

SEQ ID NO: 89282 - protein, 670 aa, Homo sapiens
  Payload ID: 17879
  Gene Name: tousled-like kinase 1
  Uniprot ID: Q9UKI8
  ENSP ID: ENSP00000409222
MAVLFLYDLKTTGKTPEKKQSESSRGRKRKAENQNESSQGKSIGGRGHKISDYFEYQGGNGSSPVRGIPPAIRSPQNSHSHSTPSSSVRPNSPSPTALAFGDHPIVQPKQLSFKIIQTDLTMLKLAALESNKIQDLEKKEGRIDDLLRANCDLRRQIDEQQKLLEKYKERLNKCISMSKKLLIEKSTQEKLSSREKSMQDRLRLGHFTTVRHGASFTEQWTDGFAFQNLVKQQEWVNQQREDIERQRKLLAKRKPPTANNSQAPSTNSEPKQRKNKAVNGAENDPFVRPNLPQLLTLAEYHEQEEIFKLRLGHLKKEEAEIQAELERLERVRNLHIRELKRINNEDNSQFKDHPTLNERYLLLHLLGRGGFSEVYKAFDLYEQRYAAVKIHQLNKSWRDEKKENYHKHACREYRIHKELDHPRIVKLYDYFSLDTDTFCTVLEYCEGNDLDFYLKQHKLMSEKEARSIVMQIVNALRYLNEIKPPIIHYDLKPGNILLVDGTACGEIKITDFGLSKIMDDDSYGVDGMDLTSQGAGTYWYLPPECFVVGKEPPKISNKVDVWSVGVIFFQCLYGRKPFGHNQSQQDILQENTILKATEVQFPVKPVVSSEAKAFIRRCLAYRKEDRFDVHQLANDPYLLPHMRRSNSSGNLHMAGLTASPTPPSSSIITY

SEQ ID NO: 89283 - protein, 766 aa, Homo sapiens
  Payload ID: 17879
  Gene Name: tousled-like kinase 1
  Uniprot ID: Q9UKI8
  ENSP ID: ENSP00000411099
MSVQSSSGSLEGPPSWSQLSTSPTPGSAAAARSLLNHTPPSGRPREGAMDELHSLDPRRQELLEARFTGVASGSTGSTGSCSVGAKASTNNESSNHSFGSLGSLSDKESETPEKKQSESSRGRKRKAENQNESSQGKSIGGRGHKISDYFEYQGGNGSSPVRGIPPAIRSPQNSHSHSTPSSSVRPNSPSPTALAFGDHPIVQPKQLSFKIIQTDLTMLKLAALESNKIQDLEKKEGRIDDLLRANCDLRRQIDEQQKLLEKYKERLNKCISMSKKLLIEKSTQEKLSSREKSMQDRLRLGHFTTVRHGASFTEQWTDGFAFQNLVKQQEWVNQQREDIERQRKLLAKRKPPTANNSQAPSTNSEPKQRKNKAVNGAENDPFVRPNLPQLLTLAEYHEQEEIFKLRLGHLKKEEAEIQAELERLERVRNLHIRELKRINNEDNSQFKDHPTLNERYLLLHLLGRGGFSEVYKAFDLYEQRYAAVKIHQLNKSWRDEKKENYHKHACREYRIHKELDHPRIVKLYDYFSLDTDTFCTVLEYCEGNDLDFYLKQHKLMSEKEARSIVMQIVNALRYLNEIKPPIIHYDLKPGNILLVDGTACGEIKITDFGLSKIMDDDSYGVDGMDLTSQGAGTYWYLPPECFVVGKEPPKISNKVDVWSVGVIFFQCLYGRKPFGHNQSQQDILQENTILKATEVQFPVKPVVSSEAKAFIRRCLAYRKEDRFDVHQLANDPYLLPHMRRSNSSGNLHMAGLTASPTPPSSSIITY

SEQ ID NO: 89284 - protein, 718 aa, Homo sapiens
  Payload ID: 17879
  Gene Name: tousled-like kinase 1
  Uniprot ID: Q9UKI8
  ENSP ID: ENSP00000428113
MDELHSLDPRRQELLEARFTGVASGSTGSTGSCSVGAKASTNNESSNHSFGSLGSLSDKESETPEKKQSESSRGRKRKAENQNESSQGKSIGGRGHKISDYFEYQGGNGSSPVRGIPPAIRSPQNSHSHSTPSSSVRPNSPSPTALAFGDHPIVQPKQLSFKIIQTDLTMLKLAALESNKIQDLEKKEGRIDDLLRANCDLRRQIDEQQKLLEKYKERLNKCISMSKKLLIEKSTQEKLSSREKSMQDRLRLGHFTTVRHGASFTEQWTDGFAFQNLVKQQEWVNQQREDIERQRKLLAKRKPPTANNSQAPSTNSEPKQRKNKAVNGAENDPFVRPNLPQLLTLAEYHEQEEIFKLRLGHLKKEEAEIQAELERLERVRNLHIRELKRINNEDNSQFKDHPTLNERYLLLHLLGRGGFSEVYKAFDLYEQRYAAVKIHQLNKSWRDEKKENYHKHACREYRIHKELDHPRIVKLYDYFSLDTDTFCTVLEYCEGNDLDFYLKQHKLMSEKEARSIVMQIVNALRYLNEIKPPIIHYDLKPGNILLVDGTACGEIKITDFGLSKIMDDDSYGVDGMDLTSQGAGTYWYLPPECFVVGKEPPKISNKVDVWSVGVIFFQCLYGRKPFGHNQSQQDILQENTILKATEVQFPVKPVVSSEAKAFIRRCLAYRKEDRFDVHQLANDPYLLPHMRRSNSSGNLHMAGLTASPTPPSSSIITY

SEQ ID NO: 89285 - protein, 750 aa, Homo sapiens
  Payload ID: 17880
  Gene Name: tousled-like kinase 2
  Uniprot ID: Q86UE8
  ENSP ID: ENSP00000275780
MMEELHSLDPRRQELLEARFTGVGVSKGPLNSESSNQSLCSVGSLSDKEVETPEKKQNDQRNRKRKAEPYETSQGKGTPRGHKISDYFEFAGGSAPGTSPGRSVPPVARSSPQHSLSNPLPRRVEQPLYGLDGSAAKEATEEQSALPTLMSVMLAKPRLDTEQLAQRGAGLCFTFVSAQQNSPSSTGSGNTEHSCSSQKQISIQHRQTQSDLTIEKISALENSKNSDLEKKEGRIDDLLRANCDLRRQIDEQQKMLEKYKERLNRCVTMSKKLLIEKSKQEKMACRDKSMQDRLRLGHFTTVRHGASFTEQWTDGYAFQNLIKQQERINSQREEIERQRKMLAKRKPPAMGQAPPATNEQKQRKSKTNGAENETLTLAEYHEQEEIFKLRLGHLKKEEAEIQAELERLERVRNLHIRELKRIHNEDNSQFKDHPTLNDRYLLLHLLGRGGFSEVYKAFDLTEQRYVAVKIHQLNKNWRDEKKENYHKHACREYRIHKELDHPRIVKLYDYFSLDTDSFCTVLEYCEGNDLDFYLKQHKLMSEKEARSIIMQIVNALKYLNEIKPPIIHYDLKPGNILLVNGTACGEIKITDFGLSKIMDDDSYNSVDGMELTSQGAGTYWYLPPECFVVGKEPPKISNKVDVWSVGVIFYQCLYGRKPFGHNQSQQDILQENTILKATEVQFPPKPVVTPEAKAFIRRCLAYRKEDRIDVQQLACDPYLLPHIRKSVSTSSPAGAAIASTSGASNNSSSN

SEQ ID NO: 89286 - protein, 772 aa, Homo sapiens
  Payload ID: 17880
  Gene Name: tousled-like kinase 2
  Uniprot ID: Q86UE8
  ENSP ID: ENSP00000316512
MMEELHSLDPRRQELLEARFTGVGVSKGPLNSESSNQSLCSVGSLSDKEVETPEKKQNDQRNRKRKAEPYETSQGKGTPRGHKISDYFEFAGGSAPGTSPGRSVPPVARSSPQHSLSNPLPRRVEQPLYGLDGSAAKEATEEQSALPTLMSVMLAKPRLDTEQLAQRGAGLCFTFVSAQQNSPSSTGSGNTEHSCSSQKQISIQHRQTQSDLTIEKISALENSKNSDLEKKEGRIDDLLRANCDLRRQIDEQQKMLEKYKERLNRCVTMSKKLLIEKSKQEKMACRDKSMQDRLRLGHFTTVRHGASFTEQWTDGYAFQNLIKQQERINSQREEIERQRKMLAKRKPPAMGQAPPATNEQKQRKSKTNGAENETPSSGNTELKDTAPALGAHSLLRLTLAEYHEQEEIFKLRLGHLKKEEAEIQAELERLERVRNLHIRELKRIHNEDNSQFKDHPTLNDRYLLLHLLGRGGFSEVYKAFDLTEQRYVAVKIHQLNKNWRDEKKENYHKHACREYRIHKELDHPRIVKLYDYFSLDTDSFCTVLEYCEGNDLDFYLKQHKLMSEKEARSIIMQIVNALKYLNEIKPPIIHYDLKPGNILLVNGTACGEIKITDFGLSKIMDDDSYNSVDGMELTSQGAGTYWYLPPECFVVGKEPPKISNKVDVWSVGVIFYQCLYGRKPFGHNQSQQDILQENTILKATEVQFPPKPVVTPEAKAFIRRCLAYRKEDRIDVQQLACDPYLLPHIRKSVSTSSPAGAAIASTSGASNNSSSN

SEQ ID NO: 89287 - protein, 718 aa, Homo sapiens
  Payload ID: 17880
  Gene Name: tousled-like kinase 2
  Uniprot ID: Q86UE8
  ENSP ID: ENSP00000340800
MMEELHSLDPRRQELLEARFTGVGVSKGPLNSESSNQSLCSVGSLSDKEVETPEKKQNDQRNRKRKAEPYETSQGKGTPRGHKISDYFERRVEQPLYGLDGSAAKEATEEQSALPTLMSVMLAKPRLDTEQLAQRGAGLCFTFVSAQQNSPSSTGSGNTEHSCSSQKQISIQHRQTQSDLTIEKISALENSKNSDLEKKEGRIDDLLRANCDLRRQIDEQQKMLEKYKERLNRCVTMSKKLLIEKSKQEKMACRDKSMQDRLRLGHFTTVRHGASFTEQWTDGYAFQNLIKQQERINSQREEIERQRKMLAKRKPPAMGQAPPATNEQKQRKSKTNGAENETLTLAEYHEQEEIFKLRLGHLKKEEAEIQAELERLERVRNLHIRELKRIHNEDNSQFKDHPTLNDRYLLLHLLGRGGFSEVYKAFDLTEQRYVAVKIHQLNKNWRDEKKENYHKHACREYRIHKELDHPRIVKLYDYFSLDTDSFCTVLEYCEGNDLDFYLKQHKLMSEKEARSIIMQIVNALKYLNEIKPPIIHYDLKPGNILLVNGTACGEIKITDFGLSKIMDDDSYNSVDGMELTSQGAGTYWYLPPECFVVGKEPPKISNKVDVWSVGVIFYQCLYGRKPFGHNQSQQDILQENTILKATEVQFPPKPVVTPEAKAFIRRCLAYRKEDRIDVQQLACDPYLLPHIRKSVSTSSPAGAAIASTSGASNNSSSN

SEQ ID NO: 89288 - protein, 593 aa, Homo sapiens
  Payload ID: 17880
  Gene Name: tousled-like kinase 2
  ENSP ID: ENSP00000462036
MMEELHSLDPRRQELLEARFTGVGVSKGPLNSESSNQSLCSVGSLSDKEVETPEKKQNDQRNRKRKAEPYETSQGKGTPRGHKISDYFERRVEQPLYGLDGSAAKEATEEQSALPTLMSVMLAKPRLDTEQLAQRGAGLCFTFVSSDLTIEKISALENSKNSDLEKKEGRIDDLLRANCDLRRQIDEQQKMLEKYKERLNRCVTMSKKLLIEKSKQEKMACRDKSMQDRLRLGHFTTVRHGASFTEQWTDGYAFQNLIKQQERINSQREEIERQRKMLAKRKPPAMGQAPPATNEQKQRKSKTNGAENETLTLAEYHEQEEIFKLRLGHLKKEEAEIQAELERLERVRNLHIRELKRIHNEDNSQFKDHPTLNDRYLLLHLLGRGGFSEVYKAFDLTEQRYVAVKIHQLNKNWRDEKKENYHKHACREYRIHKELDHPRIVKLYDYFSLDTDSFCTVLEYCEGNDLDFYLKQHKLMSEKEARSIIMQIVNALKYLNEIKPPIIHYDLKPGNILLVNGTACGEIKITDFGLSKIMDDDSYNSVDGMELTSQGAGTYWYLPPECFVVGKEPPKISNKVDVWSVGVIFYQCLYGRK

SEQ ID NO: 89289 - protein, 89 aa, Homo sapiens
  Payload ID: 17880
  Gene Name: tousled-like kinase 2
  ENSP ID: ENSP00000462637
MMEELHSLDPRRQELLEARFTGVGVSKGPLNSESSNQSLCSVGSLSDKEVETPEKKQNDQRNRKRKAEPYETSQGKGTPRGHKISDYFE

SEQ ID NO: 89290 - protein, 176 aa, Homo sapiens
  Payload ID: 17880
  Gene Name: tousled-like kinase 2
  ENSP ID: ENSP00000462851
QQNSPSSTGSGNTEHSCSSQKQISIQHRQTQANCDLRRQIDEQQKMLEKYKERLNRCVTMSKKLLIEKSKQEKMACRDKSMQDRLRLGHFTTVRHGASFTEQWTDGYAFQNLIKQQERINSQREEIERQRKMLAKRKPPAMGQAPPATNEQKQRKSKTNGAENETLTLAEYHEQEE

SEQ ID NO: 89291 - protein, 601 aa, Homo sapiens
  Payload ID: 17880
  Gene Name: tousled-like kinase 2
  ENSP ID: ENSP00000463595
MSVMLAKPRLDTEQLAQRGAGLCFTFVSAQQNSPSSTGSGNTEHSCSSQKQISIQHRQTQSDLTIEKISALENSKNSDLEKKEGRIDDLLRANCDLRRQIDEQQKMLEKYKERLNRCVTMSKKLLIEKSKQEKMACRDKSMQDRLRLGHFTTVRHGASFTEQWTDGYAFQNLIKQQERINSQREEIERQRKMLAKRKPPAMGQAPPATNEQKQRKSKTNGAENETLTLAEYHEQEEIFKLRLGHLKKEEAEIQAELERLERVRNLHIRELKRIHNEDNSQFKDHPTLNDRYLLLHLLGRGGFSEVYKAFDLTEQRYVAVKIHQLNKNWRDEKKENYHKHACREYRIHKELDHPRIVKLYDYFSLDTDSFCTVLEYCEGNDLDFYLKQHKLMSEKEARSIIMQIVNALKYLNEIKPPIIHYDLKPGNILLVNGTACGEIKITDFGLSKIMDDDSYNSVDGMELTSQGAGTYWYLPPECFVVGKEPPKISNKVDVWSVGVIFYQCLYGRKPFGHNQSQQDILQENTILKATEVQFPPKPVVTPEAKAFIRRCLAYRKEDRIDVQQLACDPYLLPHIRKSVSTSSPAGAAIASTSGASNNSSSN

SEQ ID NO: 89292 - protein, 40 aa, Homo sapiens
  Payload ID: 17880
  Gene Name: tousled-like kinase 2
  ENSP ID: ENSP00000463814
MSVMLAKPRLDTEQLAQRGAGLCFTFVSAQQNSPSSTGSG

SEQ ID NO: 89293 - protein, 51 aa, Homo sapiens
  Payload ID: 17880
  Gene Name: tousled-like kinase 2
  ENSP ID: ENSP00000463986
MEELHSLDPRRQELLEARFTGVGVSKECCKVSGSQTILMAILTLVWYEKEN

SEQ ID NO: 89294 - protein, 176 aa, Homo sapiens
  Payload ID: 17880
  Gene Name: tousled-like kinase 2
  ENSP ID: ENSP00000464516
MMEELHSLDPRRQELLEARFTGVGVSKGPLNSESSNQSLCSVGSLSDKEVERRVEQPLYGLDGSAAKEATEEQSALPTLMSVMLAKPRLDTEQLAQRGAGLCFTFVSAQQNSPSSTGSGNTEHSCSSQKQISIQHRQTQSDLTIEKISALENSKNSDLEKKEGRIDDLLRANCDLR

SEQ ID NO: 89295 - protein, 72 aa, Homo sapiens
  Payload ID: 17880
  Gene Name: tousled-like kinase 2
  ENSP ID: ENSP00000464557
MMEELHSLDPRRQELLEARFTGVGVSKGPLNSESSNQSLCSVGSLSDKEVETPEKKQNDQRNRKRKAEPYET

SEQ ID NO: 89296 - protein, 506 aa, Homo sapiens
  Payload ID: 17881
  Gene Name: TOX high mobility group box family member 2
  Uniprot ID: Q96NM4
  ENSP ID: ENSP00000344724
MDVRLYPSAPAVGARPGAEPAGLAHLDYYHGGKFDGDSAYVGMSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQAYKRKTEAAKKEYLKALAAYRASLVSKSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 89297 - protein, 488 aa, Homo sapiens
  Payload ID: 17881
  Gene Name: TOX high mobility group box family member 2
  Uniprot ID: Q96NM4
  ENSP ID: ENSP00000350849
MQQTRTEAVAGAFSRCLGFCGMRLGLLLLARHWCIAGVFPQKFDGDSAYVGMSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 89298 - protein, 464 aa, Homo sapiens
  Payload ID: 17881
  Gene Name: TOX high mobility group box family member 2
  Uniprot ID: Q96NM4
  ENSP ID: ENSP00000362090
MSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQAYKRKTEAAKKEYLKALAAYRASLVSKSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 89299 - protein, 464 aa, Homo sapiens; identical to SEQ ID NO: 89298
  Payload ID: 17881
  Gene Name: TOX high mobility group box family member 2
  Uniprot ID: Q96NM4
  ENSP ID: ENSP00000390278

SEQ ID NO: 89300 - protein, 196 aa, Homo sapiens
  Payload ID: 17881
  Gene Name: TOX high mobility group box family member 2
  ENSP ID: ENSP00000390876
RRRRKRRTPMSRRSLCRPTHSSSETLRPPSRVRTPVPLSVTCPKSWPPCGTAWERNRSRTSRTSLSSPAARDPAHLAHPTPPAAGTGTAATPVGSVASAPAACSPGTNRSTSPNPASLPSLRLAGRHCSEPEGLTAEKRPWPEAGWPIGESSDTPIARGLSLFLNLPPDSAEAAHCPPPAQRTCRNLPPADLLAPG

SEQ ID NO: 89301 - protein, 576 aa, Homo sapiens
  Payload ID: 17882
  Gene Name: TOX high mobility group box family member 3
  Uniprot ID: O15405
  ENSP ID: ENSP00000219746
MDVRFYPAAAGDPASLDFAQCLGYYGYSKFGNNNNYMNMAEANNAFFAASEQTFHTPSLGDEEFEIPPITPPPESDPALGMPDVLLPFQALSDPLPSQGSEFTPQFPPQSLDLPSITISRNLVEQDGVLHSSGLHMDQSHTQVSQYRQDPSLIMRSIVHMTDAARSGVMPPAQLTTINQSQLSAQLGLNLGGASMPHTSPSPPASKSATPSPSSSINEEDADEANRAIGEKRAAPDSGKKPKTPKKKKKKDPNEPQKPVSAYALFFRDTQAAIKGQNPNATFGEVSKIVASMWDSLGEEQKQVYKRKTEAAKKEYLKALAAYRASLVSKAAAESAEAQTIRSVQQTLASTNLTSSLLLNTPLSQHGTVSASPQTLQQSLPRSIAPKPLTMRLPMNQIVTSVTIAANMPSNIGAPLISSMGTTMVGSAPSTQVSPSVQTQQHQMQLQQQQQQQQQQMQQMQQQQLQQHQMHQQIQQQMQQQHFQHHMQQHLQQQQQHLQQQINQQQLQQQLQQRLQLQQLQHMQHQSQPSPRQHSPVASQITSPIPAIGSPQPASQQHQSQIQSQTQTQVLSQVSIF

SEQ ID NO: 89302 - protein, 571 aa, Homo sapiens
  Payload ID: 17882
  Gene Name: TOX high mobility group box family member 3
  Uniprot ID: O15405
  ENSP ID: ENSP00000385705
MKCQPRSGARRIEERLHYLITTYLKFGNNNNYMNMAEANNAFFAASETFHTPSLGDEEFEIPPITPPPESDPALGMPDVLLPFQALSDPLPSQGSEFTPQFPPQSLDLPSITISRNLVEQDGVLHSSGLHMDQSHTQVSQYRQDPSLIMRSIVHMTDAARSGVMPPAQLTTINQSQLSAQLGLNLGGASMPHTSPSPPASKSATPSPSSSINEEDADEANRAIGEKRAAPDSGKKPKTPKKKKKKDPNEPQKPVSAYALFFRDTQAAIKGQNPNATFGEVSKIVASMWDSLGEEQKQVYKRKTEAAKKEYLKALAAYRASLVSKAAAESAEAQTIRSVQQTLASTNLTSSLLLNTPLSQHGTVSASPQTLQQSLPRSIAPKPLTMRLPMNQIVTSVTIAANMPSNIGAPLISSMGTTMVGSAPSTQVSPSVQTQQHQMQLQQQQQQQQQQMQQMQQQQLQQHQMHQQIQQQMQQQHFQHHMQQHLQQQQQHLQQQINQQQLQQQLQQRLQLQQLQHMQHQSQPSPRQHSPVASQITSPIPAIGSPQPASQQHQSQIQSQTQTQVLSQVSIF

SEQ ID NO: 89303 - protein, 166 aa, Homo sapiens
  Payload ID: 17882
  Gene Name: TOX high mobility group box family member 3
  ENSP ID: ENSP00000457401
MNMAEANNAFFAASEQTFHTPSLGDEEFEIPPITPPPESDPALGMPDVLLPFQALSDPLPSQGSEFTPQFPPQSLDLPSITISRNLVEQDGVLHSSGLHMDQSHTQVSQYRQDPSLIMRSIVHMTDAARSGVMPPAQLTTINQSQLSAQLGLNLGGASMPHTSPSP

SEQ ID NO: 89304 - protein, 60 aa, Homo sapiens
  Payload ID: 17882
  Gene Name: TOX high mobility group box family member 3
  ENSP ID: ENSP00000463843
MDVRFYPAAAGDPASLDFAQCLGYYGYSKHFACRLESVLFIAVCAQPRKAPIPSTQPPST

SEQ ID NO: 89305 - protein, 42 aa, Homo sapiens
  Payload ID: 17883
  Gene Name: TOX high mobility group box family member 4
  ENSP ID: ENSP00000389333
MEFPGGNDNYLTITGPSHPFLSGAEVSQSCRRRGDIPYTKLG

SEQ ID NO: 89306 - protein, 81 aa, Homo sapiens
  Payload ID: 17883
  Gene Name: TOX high mobility group box family member 4
  ENSP ID: ENSP00000392234
MEFPGGNDNYLTITGPSHPFLSGAETFHTPSLGDEEFEIPPISLDSDPSLAVSDVVGHFDDLADPSSSQDGSFSAQTWTTL

SEQ ID NO: 89307 - protein, 43 aa, Homo sapiens
  Payload ID: 17883
  Gene Name: TOX high mobility group box family member 4
  ENSP ID: ENSP00000392482
MEFPGGNDNYLTITGPSHPFLSGAEPLLQKGPGIEQRRKGKLS

SEQ ID NO: 89308 - protein, 621 aa, Homo sapiens
  Payload ID: 17883
  Gene Name: TOX high mobility group box family member 4
  Uniprot ID: O94842
  ENSP ID: ENSP00000393080
MEFPGGNDNYLTITGPSHPFLSGAETFHTPSLGDEEFEIPPISLDSDPSLAVSDVVGHFDDLADPSSSQDGSFSAQYGVQTLDMPVGMTHGLMEQGGGLLSGGLTMDLDHSIGTQYSANPPVTIDVPMTDMTSGLMGHSQLTTIDQSELSSQLGLSLGGGTILPPAQSPEDRLSTTPSPTSSLHEDGVEDFRRQLPSQKTVVVEAGKKQKAPKKRKKKDPNEPQKPVSAYALFFRDTQAAIKGQNPNATFGEVSKIVASMWDSLGEEQKQVYKRKTEAAKKEYLKALAAYKDNQECQATVETVELDPAPPSQTPSPPPMATVDPASPAPASIEPPALSPSIVVNSTLSSYVANQASSGAGGQPNITKLIITKQMLPSSITMSQGGMVTVIPATVVTSRGLQLGQTSTATIQPSQQAQIVTRSVLQAAAAAAAAASMQLPPPRLQPPPLQQMPQPPTQQQVTILQQPPPLQAMQQPPPQKVRINLQQQPPPLQIKSVPLPTLKMQTTLVPPTVESSPERPMNNSPEAHTVEAPSPETICEMITDVVPEVESPSQMDVELVSGSPVALSPQPRCVRSGCENPPIVSKDWDNEYCSNECVVKHCRDVFLAWVASRNSNTVVFVK

SEQ ID NO: 89309 - protein, 222 aa, Homo sapiens
  Payload ID: 17883
  Gene Name: TOX high mobility group box family member 4
  ENSP ID: ENSP00000402195
MDFPDQRRGAPEPRPRPPRTAPPVSNRPAHKFPGGNDNYLTITGPSHPFLSGAETFHTPSLGDEEFEIPPISLDSDPSLAVSDVVGHFDDLADPSSSQDGSFSAQYGVQTLDMPVGMTHGLMEQGGGLLSGGLTMDLDHSIGTQYSANPPVTIDVPMTDMTSGLMGHSQLTTIDQSELSSQLGLSLGGGTILPPAQSPEDRLSTTPSPTSSLHEDGVEDFRR

SEQ ID NO: 89310 - protein, 170 aa, Homo sapiens
  Payload ID: 17883
  Gene Name: TOX high mobility group box family member 4
  ENSP ID: ENSP00000406196
METFHTPSLGDEEFEIPPISLDSDPSLAVSDVVGHFDDLADPSSSQDGSFSAQYGVQTLDMPVGMTHGLMEQGGGLLSGGLTMDLDHSIGTQYSANPPVTIDVPMTDMTSGLMGHSQLTTIDQSELSSQLGLSLGGGTILPPAQSPEDRLSTTPSPTSSLHEDGVEDFRR

SEQ ID NO: 89311 - protein, 621 aa, Homo sapiens; identical to SEQ ID NO: 89308
  Payload ID: 17883
  Gene Name: TOX high mobility group box family member 4
  Uniprot ID: O94842
  ENSP ID: ENSP00000477868

SEQ ID NO: 89312 - protein, 270 aa, Homo sapiens
  Payload ID: 17884
  Gene Name: TP53 induced glycolysis regulatory phosphatase
  Uniprot ID: Q9NQ88
  ENSP ID: ENSP00000179259
MARFALTVVRHGETRFNKEKIIQGQGVDEPLSETGFKQAAAAGIFLNNVKFTHAFSSDLMRTKQTMHGILERSKFCKDMTVKYDSRLRERKYGVVEGKALSELRAMAKAAREECPVFTPPGGETLDQVKMRGIDFFEFLCQLILKEADQKEQFSQGSPSNCLETSLAEIFPLGKNHSSKVNSDSGIPGLAASVLVVSHGAYMRSLFDYFLTDLKCSLPATLSRSELMSVTPNTGMSLFIINFEEGREVKPTVQCICMNLQDHLNGLTETR

SEQ ID NO: 89313 - protein, 211 aa, Homo sapiens
  Payload ID: 17884
  Gene Name: TP53 induced glycolysis regulatory phosphatase
  ENSP ID: ENSP00000488928
MRTKQTMHGILERSKFCKDMTVKYDSRLRERKYGVVEGKALSELRAMAKAAREECPVFTPPGGETLDQVKMRGIDFFEFLCQLILKEADQKEQFSQGSPSNCLETSLAEIFPLGKNHSSKVNSDSGIPGLAASVLVVSHGAYMRSLFDYFLTDLKCSLPATLSRSELMSVTPNTGMSLFIINFEEGREVKPTVQCICMNLQDHLNGLTETR

SEQ ID NO: 89314 - protein, 76 aa, Homo sapiens
  Payload ID: 17885
  Gene Name: TP53 regulated inhibitor of apoptosis 1
  Uniprot ID: O43715
  ENSP ID: ENSP00000449795
MNSVGEACTDMKREYDQCFNRWFAEKFLKGDSSGDPCTDLFKRYQQCVQKAIKEKEIPIEGLEFMGHGKEKPENSS

SEQ ID NO: 89315 - protein, 121 aa, Homo sapiens
  Payload ID: 17886
  Gene Name: TP53 regulating kinase
  ENSP ID: ENSP00000361174
MAAARATTPADGEEPAPEAEALAAARERSSRFLSGLELVKQGAEARVFRGRFQGRAAVIKHRFPKGYRHPALEARLGRRRTVQEARALLRCRRAGKEYLPQLSFLWTMLPTAYIWKKLKAQ

SEQ ID NO: 89316 - protein, 253 aa, Homo sapiens
  Payload ID: 17886
  Gene Name: TP53 regulating kinase
  Uniprot ID: Q96S44
  ENSP ID: ENSP00000361186
MAAARATTPADGEEPAPEAEALAAARERSSRFLSGLELVKQGAEARVFRGRFQGRAAVIKHRFPKGYRHPALEARLGRRRTVQEARALLRCRRAGISAPVVFFVDYASNCLYMEEIEGSVTVRDYIQSTMETEKTPQGLSNLAKTIGQVLARMHDEDLIHGDLTTSNMLLKPPLEQLNIVLIDFGLSFISALPEDKGVDLYVLEKAFLSTHPNTETVFEAFLKSYSTSSKKARPVLKKLDEVRLRGRKRSMVG

SEQ ID NO: 89317 - protein, 124 aa, Homo sapiens; identical to SEQ ID NO: 1166
  Payload ID: 17887
  Gene Name: TP53 target 3
  Uniprot ID: Q9ULZ0
  ENSP ID: ENSP00000381672

SEQ ID NO: 89318 - protein, 132 aa, Homo sapiens
  Payload ID: 17887
  Gene Name: TP53 target 3
  Uniprot ID: Q9ULZ0
  ENSP ID: ENSP00000455448
MRASPCISQPAASWHPRPSALRPTAGSGPDTRTPGTVEDGSAPCPAFRSPAVSPCGEEPCCFQISPAEETLELGRLVSPGNCDTLSPRAAGFYACHVRSLIPCRSTKGRWPLTASAAGLSRHAQCGPSLGLG

SEQ ID NO: 89319 - protein, 102 aa, Homo sapiens; identical to SEQ ID NO: 1162
  Payload ID: 17887
  Gene Name: TP53 target 3
  Uniprot ID: Q9ULZ0
  ENSP ID: ENSP00000457452

SEQ ID NO: 89320 - protein, 142 aa, Homo sapiens
  Payload ID: 17887
  Gene Name: TP53 target 3
  ENSP ID: ENSP00000459299
GSGPDTRTPGTVEDGSAPCPAFRSPAVSPCGEEPCCFQISPAEETLELGRLVSPGNCDTLSPRAAGFYACHVRSLIPCRSTKGRWPLTASAAGLSRLSQILCTPGAPLGPPGSLRGPYLGRASHGDFPTSVIKRRKRHSGRA

SEQ ID NO: 89321 - protein, 102 aa, Homo sapiens; identical to SEQ ID NO: 1162
  Payload ID: 17888
  Gene Name: TP53 target 3 family member E
  ENSP ID: ENSP00000482283

SEQ ID NO: 89322 - protein, 124 aa, Homo sapiens; identical to SEQ ID NO: 1166
  Payload ID: 17888
  Gene Name: TP53 target 3 family member E
  ENSP ID: ENSP00000485467

SEQ ID NO: 89323 - protein, 102 aa, Homo sapiens; identical to SEQ ID NO: 1162
  Payload ID: 17889
  Gene Name: TP53 target 3 family member F
  ENSP ID: ENSP00000481405

SEQ ID NO: 89324 - protein, 124 aa, Homo sapiens; identical to SEQ ID NO: 1166
  Payload ID: 17889
  Gene Name: TP53 target 3 family member F
  ENSP ID: ENSP00000485635

SEQ ID NO: 89325 - protein, 124 aa, Homo sapiens; identical to SEQ ID NO: 1166
  Payload ID: 17890
  Gene Name: TP53 target 3B
  Uniprot ID: Q9ULZ0
  ENSP ID: ENSP00000339405

SEQ ID NO: 89326 - protein, 102 aa, Homo sapiens; identical to SEQ ID NO: 1162
  Payload ID: 17890
  Gene Name: TP53 target 3B
  Uniprot ID: Q9ULZ0
  ENSP ID: ENSP00000456831

SEQ ID NO: 89327 - protein, 132 aa, Homo sapiens; identical to SEQ ID NO: 89318
  Payload ID: 17890
  Gene Name: TP53 target 3B
  Uniprot ID: Q9ULZ0
  ENSP ID: ENSP00000457303

SEQ ID NO: 89328 - protein, 7 aa, Homo sapiens
  Payload ID: 17890
  Gene Name: TP53 target 3B
  ENSP ID: ENSP00000458724
  MOD_RES (1)..(1): Any amino acid
XPSLGLG

SEQ ID NO: 89329 - protein, 102 aa, Homo sapiens; identical to SEQ ID NO: 1162
  Payload ID: 17891
  Gene Name: TP53 target 3C
  Uniprot ID: Q9ULZ0
  ENSP ID: ENSP00000353397

SEQ ID NO: 89330 - protein, 102 aa, Homo sapiens; identical to SEQ ID NO: 1162
  Payload ID: 17891
  Gene Name: TP53 target 3C
  Uniprot ID: Q9ULZ0
  ENSP ID: ENSP00000381659

SEQ ID NO: 89331 - protein, 102 aa, Homo sapiens; identical to SEQ ID NO: 1162
  Payload ID: 17891
  Gene Name: TP53 target 3C
  Uniprot ID: Q9ULZ0
  ENSP ID: ENSP00000454442

SEQ ID NO: 89332 - protein, 124 aa, Homo sapiens; identical to SEQ ID NO: 1166
  Payload ID: 17891
  Gene Name: TP53 target 3C
  Uniprot ID: Q9ULZ0
  ENSP ID: ENSP00000455132

SEQ ID NO: 89333 - protein, 132 aa, Homo sapiens; identical to SEQ ID NO: 89318
  Payload ID: 17891
  Gene Name: TP53 target 3C
  Uniprot ID: Q9ULZ0
  ENSP ID: ENSP00000457790

SEQ ID NO: 89334 - protein, 132 aa, Homo sapiens; identical to SEQ ID NO: 89318
  Payload ID: 17892
  Gene Name: TP53 target 3D
  Uniprot ID: Q9ULZ0
  ENSP ID: ENSP00000454398

SEQ ID NO: 89335 - protein, 124 aa, Homo sapiens; identical to SEQ ID NO: 1166
  Payload ID: 17892
  Gene Name: TP53 target 3D
  Uniprot ID: Q9ULZ0
  ENSP ID: ENSP00000455596

SEQ ID NO: 89336 - protein, 102 aa, Homo sapiens
  Payload ID: 17892
  Gene Name: TP53 target 3D
  ENSP ID: ENSP00000457079
MRASPCISQPAASWHPRPSALRPTAGSGPDTRTPGTVEDGSAPCPAFRSPAVSPCGEEPCCFQISPAEETLELGRLVSPGCHKFSAPQECRLDPRARCVVHI

SEQ ID NO: 89337 - protein, 102 aa, Homo sapiens; identical to SEQ ID NO: 89336
  Payload ID: 17892
  Gene Name: TP53 target 3D
  ENSP ID: ENSP00000458008

SEQ ID NO: 89338 - protein, 7 aa, Homo sapiens
  Payload ID: 17892
  Gene Name: TP53 target 3D
  ENSP ID: ENSP00000458552
  MOD_RES (1)..(1): Any amino acid
XPSLGLG

SEQ ID NO: 89339 - protein, 290 aa, Homo sapiens [sequence omitted]

SEQ ID NO: 89340 - protein, 175 aa, Homo sapiens
  Payload ID: 17894
  Gene Name: TP53RK binding protein
  Uniprot ID: Q9Y3C4
  ENSP ID: ENSP00000272424
MQLTHQLDLFPECRVTLLLFKDVKNAGDLRRKAMEGTIDGSLINPTVIVDPFQILVAANKAVHLYKLGKMKTRTLSTEIIFNLSPNNNISEALKKFGISANDTSILIVYIEEGEKQINQEYLISQVEGHQVSLKNLPEIMNITEVKKIYKLSSQEESIGTLLDAIICRMSTKDVL

SEQ ID NO: 89341 - protein, 214 aa, Homo sapiens
  Payload ID: 17894
  Gene Name: TP53RK binding protein
  Uniprot ID: Q9Y3C4
  ENSP ID: ENSP00000325398
MQLTHQLDLFPECRVTLLLFKDVKNAGDLRRKAMEGTIDGSLINPTVFHSCCPGWSAMARSWLTATSASRVQAIVLPQPPELLGLQIVDPFQILVAANKAVHLYKLGKMKTRTLSTEIIFNLSPNNNISEALKKFGISANDTSILIVYIEEGEKQINQEYLISQVEGHQVSLKNLPEIMNITEVKKIYKLSSQEESIGTLLDAIICRMSTKDVL

SEQ ID NO: 89342 - protein, 214 aa, Homo sapiens; identical to SEQ ID NO: 89341
  Payload ID: 17894
  Gene Name: TP53RK binding protein
  Uniprot ID: Q9Y3C4
  ENSP ID: ENSP00000386936

SEQ ID NO: 89343 - protein, 747 aa, Homo sapiens
  Payload ID: 17895
  Gene Name: TPX2, microtubule-associated
  Uniprot ID: Q9ULW0
  ENSP ID: ENSP00000300403
MSQVKSSYSYDAPSDFINFSSLDDEGDTQNIDSWFEEKANLENKLLGKNGTGGLFQGKTPLRKANLQQAIVTPLKPVDNTYYKEAEKENLVEQSIPSNACSSLEVEAAISRKTPAQPQRRSLRLSAQKDLEQKEKHHVKMKAKRCATPVIIDEILPSKKMKVSNNKKKPEEEGSAHQDTAEKNASSPEKAKGRHTVPCMPPAKQKFLKSTEEQELEKSMKMQQEVVEMRKKNEEFKKLALAGIGQPVKKSVSQVTKSVDFHFRTDERIKQHPKNQEEYKEVNFTSELRKHPSSPARVTKGCTIVKPFNLSQGKKRTFDETVSTYVPLAQQVEDFHKRTPNRYHLRSKKDDINLLPSKSSVTKICRDPQTPVLQTKHRARAVTCKSTAELEAEELEKLQQYKFKARELDPRILEGGPILPKKPPVKPPTEPIGFDLEIEKRIQERESKKKTEDEHFEFHSRPCPTKILEDVVGVPEKKVLPITVPKSPAFALKNRIRMPTKEDEEEDEPVVIKAQPVPHYGVPFKPQIPEARTVEICPFSFDSRDKERQLQKEKKIKELQKGEVPKFKALPLPHFDTINLPEKKVKNVTQIEPFCLETDRRGALKAQTWKHQLEEELRQQKEAACFKARPNTVISQEPFVPKKEKKSVAEGLSGSLVQEPFQLATEKRAKERQELEKRMAEVEAQKAQQLEEARLQEEEQKKEELARLRRELVHKANPIRKYQGLEIKSSDQPLTVPVSPKFSTRFHC

SEQ ID NO: 89344 - protein, 783 aa, Homo sapiens
  Payload ID: 17895
  Gene Name: TPX2, microtubule-associated
  Uniprot ID: Q9ULW0
  ENSP ID: ENSP00000341145
MSQVKSSYSYDAPSDFINFSSLDDEGDTQNIDSWFEEKANLENKLLGKNGTGGLFQGKTPLRKANLQQAIVTPLKPVDNTYYKEAEKENLVEQSIPSNACSSLEVEAAISRKTPAQPQRRSLRLSAQKDLEQKEKHHVKMKAKRCATPVIIDEILPSKKMKVSNNKKKPEEEGSAHQDTAEKNASSPEKAKGRHTVPCMPPAKQKFLKSTEEQELEKSMKMQQEVVEMRKKNEEFKKLALAGIGQPVKKSVSQVTKSVDFHFRTDERIKQHPKNQEEYKEVNFTSELRKHPSSPARVTKGCTIVKPFNLSQGKKRTFDETVSTYVPLAQQVEDFHKRTPNRYHLRSKKDDIKTGSCSVTQAGVQWRDHGSLQCPTPGLKQSSCLSLPNLLPSKSSVTKICRDPQTPVLQTKHRARAVTCKSTAELEAEELEKLQQYKFKARELDPRILEGGPILPKKPPVKPPTEPIGFDLEIEKRIQERESKKKTEDEHFEFHSRPCPTKILEDVVGVPEKKVLPITVPKSPAFALKNRIRMPTKEDEEEDEPVVIKAQPVPHYGVPFKPQIPEARTVEICPFSFDSRDKERQLQKEKKIKELQKGEVPKFKALPLPHFDTINLPEKKVKNVTQIEPFCLETDRRGALKAQTWKHQLEEELRQQKEAACFKARPNTVISQEPFVPKKEKKSVAEGLSGSLVQEPFQLATEKRAKERQELEKRMAEVEAQKAQQLEEARLQEEEQKKEELARLRRELVHKANPIRKYQGLEIKSSDQPLTVPVSPKFSTRFHC

SEQ ID NO: 89345 - protein, 376 aa, Homo sapiens
  Payload ID: 17896
  Gene Name: TraB domain containing
  Uniprot ID: Q9H4I3
  ENSP ID: ENSP00000305664
MDGEEQQPPHEANVEPVVPSEASEPVPRVLSGDPQNLSDVDAFNLLLEMKLKRRRQRPNLPRTVTQLVAEDGSRVYVVGTAHFSDDSKRDVVKTIREVQPDVVVVELCQYRVSMLKMDESTLLREAQELSLEKLQQAVRQNGLMSGLMQMLLLKVSAHITEQLGMAPGGEFREAFKEASKVPFCKFHLGDRPIPVTFKRAIAALSFWQKVRLAWGLCFLSDPISKDDVERCKQKDLLEQMMAEMIGEFPDLHRTIVSERDVYLTYMLRQAARRLELPRASDAEPRKCVPSVVVGVVGMGHVPGIEKNWSTDLNIQEIMTVPPPSVSGRVSRLAVKAAFFGLLGYSLYWMGRRTASLVLSLPAAQYCLQRVTEARHK

SEQ ID NO: 89346 - protein, 376 aa, Homo sapiens; identical to SEQ ID NO: 89345
  Payload ID: 17896
  Gene Name: TraB domain containing
  Uniprot ID: Q9H4I3
  ENSP ID: ENSP00000370295

SEQ ID NO: 89347 - protein, 376 aa, Homo sapiens; identical to SEQ ID NO: 89345
  Payload ID: 17896
  Gene Name: TraB domain containing
  Uniprot ID: Q9H4I3
  ENSP ID: ENSP00000379171

SEQ ID NO: 89348 - protein, 379 aa, Homo sapiens
  Payload ID: 17896
  Gene Name: TraB domain containing
  ENSP ID: ENSP00000379173
MDGEEQQPPHEANVEPVVPSEASEPVPRVLSGDPQNLSDVDAFNLLLEMKLKRRRQRPNLPRTVTQLVAEDGSRVYVVGTAHFSDDSKRDVVKTIREVQPDVVVVELCQYRVSMLKMDESTLLREAQELSLEKLQQAVRQNGLMSGLMQMLLLKVSAHITEQLGMAPGGEFREAFKEASKVPFCKFHLGDRPIPVTFKRAIAALSFWQKVRLAWGLCFLSDPISKDDVERCKQKDLLEQMMAEMIGEFPDLHRTIVSERDVYLTYMLRQAARRLELPRASDAEPRKCVPSVVVGVVGMGHVPGIEKNWSTDLNIQEIMTVPPPSVSGRVSRLAVKAAFFGLLGYSLYWMGRRTASLVLSLPAAQYCLQRVTEARHKEKN

SEQ ID NO: 89349 - protein, 456 aa, Homo sapiens
  Payload ID: 17897
  Gene Name: TraB domain containing 2A
  Uniprot ID: Q86V40
  ENSP ID: ENSP00000335004
MSPWSWFLLQTLCLLPTGAASRRGAPGTANCELKPQQSELNSFLWTIKRDPPSYFFGTIHVPYTRVWDFIPDNSKEAFLQSSIVYFELDLTDPYTISALTSCQMLPQGENLQDVLPRDIYCRLKRHLEYVKLMMPLWMTPDQRGKGLYADYLFNAIAGNWERKRPVWVMLMVNSLTEVDIKSRGVPVLDLFLAQEAERLRKQTGAVEKVEEQCHPLNGLNFSQVPNFINATLPPQERITAQEIDSYLRRELIYKRNERIGKRVKALLEEFPDKGFFFAFGAGHFMGNNTVLDVLRREGYEVEHAPAGRPIHKGKSKKTSTRPTLSTIFAPKVPTLEVPAPEAVSSGHSTLPPLVSRPGSADTPSEAEQRFRKKRRRSQRRPRLRQFSDLWVRLEESDIVPQLQVPVLDRHISTELRLPRRGHSHHSQMVASSACLSLWTPVFWVLVLAFQTETPLL

SEQ ID NO: 89350 - protein, 505 aa, Homo sapiens
  Payload ID: 17897
  Gene Name: TraB domain containing 2A
  Uniprot ID: Q86V40
  ENSP ID: ENSP00000387075
MSPWSWFLLQTLCLLPTGAASRRGAPGTANCELKPQQSELNSFLWTIKRDPPSYFFGTIHVPYTRVWDFIPDNSKEAFLQSSIVYFELDLTDPYTISALTSCQMLPQGENLQDVLPRDIYCRLKRHLEYVKLMMPLWMTPDQRGKGLYADYLFNAIAGNWERKRPVWVMLMVNSLTEVDIKSRGVPVLDLFLAQEAERLRKQTGAVEKVEEQCHPLNGLNFSQVIFALNQTLLQQESLRAGSLQIPYTTEDLIKHYNCGDLSSVILSHDSSQVPNFINATLPPQERITAQEIDSYLRRELIYKRNERIGKRVKALLEEFPDKGFFFAFGAGHFMGNNTVLDVLRREGYEVEHAPAGRPIHKGKSKKTSTRPTLSTIFAPKVPTLEVPAPEAVSSGHSTLPPLVSRPGSADTPSEAEQRFRKKRRRSQRRPRLRQFSDLWVRLEESDIVPQLQVPVLDRHISTELRLPRRGHSHHSQMVASSACLSLWTPVFWVLVLAFQTETPLL

SEQ ID NO: 89351 - protein, 333 aa, Homo sapiens
  Payload ID: 17897
  Gene Name: TraB domain containing 2A
  ENSP ID: ENSP00000387183
MSPWSWFLLQTLCLLPTGAASRRGAPGTANCELKPQQSELNSFLWTIKRDPPSYFFGTIHVPYTRVWDFIPDNSKEAFLQSSIVYFELDLTDPYTISALTSCQMLPQGENLQDVLPRDIYCRLKRHLEYVKLMMPLWMTPDQRGKGLYADYLFNAIAGNWERKRPVWVMLMVNSLTEVDIKSRGVPVLDLFLAQEAERLRKQTGAVEKVEEQCHPLNGLNFSQVIFALNQTLLQQESLRAGSLQIPYTTEDLIKHYNCGDLSSVILSHDSSQVPNFINATLPPQERITAQEIDSYLRRELIYKRNERIGKRVKALLEEFPDKGFFFAFGAASQ

SEQ ID NO: 89352 - protein, 517 aa, Homo sapiens
  Payload ID: 17898
  Gene Name: TraB domain containing 2B
  Uniprot ID: A6NFA1
  ENSP ID: ENSP00000476820
MHAALAGPLLAALLATARARPQPPDGGQCRPPGSQRDLNSFLWTIRRDPPAYLFGTIHVPYTRVWDFIPDNSKAAFQASTRVYFELDLTDPYTISALASCQLLPHGENLQDVLPHELYWRLKRHLDYVKLMMPSWMTPAQRGKGLYADYLFNAIAGNWERKRPVWVMLMVNSLTERDVRFRGVPVLDLYLAQQAEKMKKTTGAVEQVEEQCHPLNNGLNFSQVLFALNQTLLQQESVRAGSLQASYTTEDLIKHYNCGDLSAVIFNHDTSQLPNFINTTLPPHEQVTAQEIDSYFRQELIYKRNERMGKRVMALLRENEDKICFFAFGAGHFLGNNTVIDILRQAGLEVDHTPAGQAIHSPAPQSPAPSPEGTSTSPAPVTPAAAVPEAPSVTPTAPPEDEDPALSPHLLLPDSLSQLEEFGRQRKWHKRQSTHQRPRQFNDLWVRIEDSTTASPPPLPLQPTHSSGTAKPPFQLSDQLQQQDPPGPASSSAPTLGLLPAIATTIAVCFLLHSLGPS

SEQ ID NO: 89353 - protein, 339 aa, Homo sapiens
  Payload ID: 17899
  Gene Name: trace amine associated receptor 1
  Uniprot ID: Q96RJ0
  ENSP ID: ENSP00000275216
MMPFCHNIINISCVKNNWSNDVRASLYSLMVLIILTTLVGNLIVIVSISHFKQLHTPTNWLIHSMATVDFLLGCLVMPYSMVRSAEHCWYFGEVFCKIHTSTDIMLSSASIFHLSFISIDRYYAVCDPLRYKAKMNILVICVMIFISWSVPAVFAFGMIFLELNFKGAEEIYYKHVHCRGGCSVFFSKISGVLTFMTSFYIPGSIMLCVYYRIYLIAKEQARLISDANQKLQIGLEMKNGISQSKERKAVKTLGIVMGVFLICWCPFFICTVMDPFLHYIIPPTLNDVLIWFGYLNSTFNPMVYAFFYPWFRKALKMMLFGKIFQKDSSRCKLFLELSS

SEQ ID NO: 89354 - protein, 306 aa, Homo sapiens
  Payload ID: 17900
  Gene Name: trace amine associated receptor 2
  Uniprot ID: Q9P1P5
  ENSP ID: ENSP00000275191
MYSFMAGSIFITIFGNLAMIISISYFKQLHTPTNFLILSMAITDFLLGFTIMPYSMIRSVENCWYFGLTFCKIYYSFDLMLSITSIFHLCSVAIDRFYAICYPLLYSTKITIPVIKRLLLLCWSVPGAFAFGVVFSEAYADGIEGYDILVACSSSCPVMFNKLWGTTLFMAGFFTPGSMMVGIYGKIFAVSRKHAHAINNLRENQNNQVKKDKKAAKTLGIVIGVFLLCWFPCFFTILLDPFLNFSTPVVLFDALTWFGYFNSTCNPLIYGFFYPWFRRALKYILLGKIFSSCFHNTILCMQKESE

SEQ ID NO: 89355 - protein, 351 aa, Homo sapiens
  Payload ID: 17900
  Gene Name: trace amine associated receptor 2
  Uniprot ID: Q9P1P5
  ENSP ID: ENSP00000356908
MAVSSEQHELSHFKRTQTKKEKFNCSEYGNRSCPENERSLGVRVAMYSFMAGSIFITIFGNLAMIISISYFKQLHTPTNFLILSMAITDFLLGFTIMPYSMIRSVENCWYFGLTFCKIYYSFDLMLSITSIFHLCSVAIDRFYAICYPLLYSTKITIPVIKRLLLLCWSVPGAFAFGVVFSEAYADGIEGYDILVACSSSCPVMFNKLWGTTLFMAGFFTPGSMMVGIYGKIFAVSRKHAHAINNLRENQNNQVKKDKKAAKTLGIVIGVFLLCWFPCFFTILLDPFLNFSTPVVLFDALTWFGYFNSTCNPLIYGFFYPWFRRALKYILLGKIFSSCFHNTILCMQKESE

SEQ ID NO: 89356 - protein, 337 aa, Homo sapiens
  Payload ID: 17901
  Gene Name: trace amine associated receptor 5
  Uniprot ID: O14804
  ENSP ID: ENSP00000258034
MRAVFIQGAEEHPAAFCYQVNGSCPRTVHTLGIQLVIYLACAAGMLIIVLGNVFVAFAVSYFKALHTPTNFLLLSLALADMFLGLLVLPLSTIRSVESCWFFGDFLCRLHTYLDTLFCLTSIFHLCFISIDRHCAICDPLLYPSKFTVRVALRYILAGWGVPAAYTSLFLYTDVVETRLSQWLEEMPCVGSCQLLLNKFWGWLNFPLFFVPCLIMISLYVKIFVVATRQAQQITTLSKSLAGAAKHERKAAKTLGIAVGIYLLCWLPFTIDTMVDSLLHFITPPLVFDIFIWFAYFNSACNPIIYVFSYQWFRKALKLTLSQKVFSPQTRTVDLYQE

SEQ ID NO: 89357 - protein, 345 aa, Homo sapiens
  Payload ID: 17902
  Gene Name: trace amine associated receptor 6
  Uniprot ID: Q96RI8
  ENSP ID: ENSP00000275198
MSSNSSLLVAVQLCYANVNGSCVKIPFSPGSRVILYIVFGFGAVLAVFGNLLVMISILHFKQLHSPTNFLVASLACADFLVGVTVMPFSMVRTVESCWYFGRSFCTFHTCCDVAFCYSSLFHLCFISIDRYIAVTDPLVYPTKFTVSVSGICISVSWILPLMYSGAVFYTGVYDDGLEELSDALNCIGGCQTVVNQNWVLTDFLSFFIPTFIMIILYGNIFLVARRQAKKIENTGSKTESSSESYKARVARRERKAAKTLGVTVVAFMISWLPYSIDSLIDAFMGFITPACIYEICCWCAYYNSAMNPLIYALFYPWFRKAIKVIVTGQVLKNSSATMNLFSEHI

SEQ ID NO: 89358 - protein, 342 aa, Homo sapiens
  Payload ID: 17903
  Gene Name: trace amine associated receptor 8
  Uniprot ID: Q969N4
  ENSP ID: ENSP00000275200
MTSNFSQPVVQLCYEDVNGSCIETPYSPGSRVILYTAFSFGSLLAVFGNLLVMTSVLHFKQLHSPTNFLIASLACADFLVGVTVMLFSMVRTVESCWYFGAKFCTLHSCCDVAFCYSSVLHLCFICIDRYIVVTDPLVYATKFTVSVSGICISVSWILPLTYSGAVFYTGVNDDGLEELVSALNCVGGCQIIVSQGWVLIDFLLFFIPTLVMIILYSKIFLIAKQQAIKIETTSSKVESSSESYKIRVAKRERKAAKTLGVTVLAFVISWLPYTVDILIDAFMGFLTPAYIYEICCWSAYYNSAMNPLIYALFYPWFRKAIKLILSGDVLKASSSTISLFLE

SEQ ID NO: 89359 - protein, 348 aa, Homo sapiens
  Payload ID: 17904
  Gene Name: trace amine associated receptor 9 (gene/pseudogene)
  Uniprot ID: Q96RI9
  ENSP ID: ENSP00000424607
MVNNFSQAEAVELCYKNVNESCIKTPYSPGPRSILYAVLGFGAVLAAFGNLLVMIAILHFKQLHTPTNFLIASLACADFLVGVTVMPFSTVRSVESCWYFGDSYCKFHTCFDTSFCFASLFHLCCISVDRYIAVTDPLTYPTKFTVSVSGICIVLSWFFSVTYSFSIFYTGANEEGIEELVVALTCVGGCQAPLNQNWVLLCFLLFFIPNVAMVFIYSKIFLVAKHQARKIESTASQAQSSSESYKERVAKRERKAAKTLGIAMAAFLVSWLPYLVDAVIDAYMNFITPPYVYEILVWCVYYNSAMNPLIYAFFYQWFGKAIKLIVSGKVLRTDSSTTNLFSEEVETD

SEQ ID NO: 89360 - protein, 425 aa, Homo sapiens
  Payload ID: 17905
  Gene Name: TRAF family member-associated NFKB activator
  Uniprot ID: Q92844
  ENSP ID: ENSP00000259075
MDKNIGEQLNKAYEAFRQACMDRDSAVKELQQKTENYEQRIREQQEQLSLQQTIIDKLKSQLLLVNSTQDNNYGCVPLLEDSETRKNNLTLDQPQDKVISGIAREKLPKVRRQEVSSPRKETSARSLGSPLLHERGNIEKTFWDLKEEFHKICMLAKAQKDHLSKLNIPDTATETQCSVPIQCTDKTDKQEALFKPQAKDDINRGAPSITSVTPRGLCRDEEDTSFESLSKFNVKFPPMDNDSTFLHSTPERPGILSPATSEAVCQEKFNMEFRDNPGNFVKTEETLFEIQGIDPIASAIQNLKTTDKTKPSNLVNTCIRTTLDRAACLPPGDHNALYVNSFPLLDPSDAPFPSLDSPGKAIRGPQQPIWKPFPNQDSDSVVLSGTDSELHIPRVCEFCQAVFPPSITSRGDFLRHLNSHFNGET

SEQ ID NO: 89361 - protein, 425 aa, Homo sapiens; identical to SEQ ID NO: 89360
  Payload ID: 17905
  Gene Name: TRAF family member-associated NFKB activator
  Uniprot ID: Q92844
  ENSP ID: ENSP00000376505

SEQ ID NO: 89362 - protein, 239 aa, Homo sapiens
  Payload ID: 17905
  Gene Name: TRAF family member-associated NFKB activator
  ENSP ID: ENSP00000384235
MLLTSYNKGEMVVKEVKKRREIEGKENDLPSYRGWNTHPNERPVIYSILYSDATGRRGMDKNIGEQLNKAYEAFRQACMDRDSAVKELQQKQTENYEQRIREQQEQLSLQQTIIDKLKSQLLLVNSTQDNNYGCVPLLEDSETRKNNLTLDQPQDKVISGIAREKLPKVRRQEVSSPRKETSARSLGSPLLHERGNIEKTFWDLKEEFHKICMLAKAQKDHLSKLNIPDTATAHLEALS

SEQ ID NO: 89363 - protein, 238 aa, Homo sapiens
  Payload ID: 17905
  Gene Name: TRAF family member-associated NFKB activator
  ENSP ID: ENSP00000384492
MLLTSYNKGEMVVKEVKKRREIEGKENDLPSYRGWNTHPNERPVIYSILYSDATGRRGMDKNIGEQLNKAYEAFRQACMDRDSAVKELQQKTENYEQRIREQQEQLSLQQTIIDKLKSQLLLVNSTQDNNYGCVPLLEDSETRKNNLTLDQPQDKVISGIAREKLPKVRRQEVSSPRKETSARSLGSPLLHERGNIEKTFWDLKEEFHKICMLAKAQKDHLSKLNIPDTATAHLEALS

SEQ ID NO: 89364 - protein, 408 aa, Homo sapiens
  Payload ID: 17905
  Gene Name: TRAF family member-associated NFKB activator
  ENSP ID: ENSP00000385487
MDKNIGEQLNKAYEAFRQACMDRDSAVKELQQKTENYEQRIREQQEQLSLQQTIIDKLKSQLLLVNSTQDNNYGCVPLLEDSETRKNNLTLDQPQDKVISGIAREKLPKVRRQEVSSPRKETSARSLGSPLLHERGNIEKTFWDLKEEFHKICMLAKAQKDHLSKLNIPDTATETQCSVPIQCTDKTDKQEALFKPQAKDDINRGAPSITSVTPRGLCRDEEDTSFESLSKFNVKFPPMDNDSTFLHSTPERPGILSPATSEAVCQEKFNMEFRDNPGNFVKTEETLFEIQGIDPIASAIQNLKTTDKTKPSNLVNTCIRTTLDRAACLPPGDHNALYVNSFPLLDPSDAPFPSLDSPGKAIRGPQQSVHSCFSRWHPALYICFLYYSKGNSCPFGSPFLIKTVTRWY

SEQ ID NO: 89365 - protein, 119 aa, Homo sapiens
  Payload ID: 17905
  Gene Name: TRAF family member-associated NFKB activator
  Uniprot ID: Q92844
  ENSP ID: ENSP00000385983
MDKNIGEQLNKAYEAFRQACMDRDSAVKELQQKTENYEQRIREQQEQLSLQQTIIDKLKSQLLLVNSTQDNNYGCVPLLEDSETRKNNLTLDQPQDKVISGIAREKLPKVDIASAESSI

SEQ ID NO: 89366 - protein, 198 aa, Homo sapiens
  Payload ID: 17905
  Gene Name: TRAF family member-associated NFKB activator
  ENSP ID: ENSP00000387439
LHSTPERPGILSPATSEAVCQEKFNMEFRDNPGNFVKTEETLFEIQGIDPIASAIQNLKTTDKTKPSNLVNTCIRTTLDRAACLPPGDHNALYVNSFPLLDPSDAPFPSLDSPGKAIRGPQQMAPCIVHLLSILQQGKQLPIWKPFPNQDSDSVVLSGTDSELHIPRVCEFCQAVFPPSITSRGDFLRHLNSHFNGET

SEQ ID NO: 89367 - protein, 128 aa, Homo sapiens
  Payload ID: 17905
  Gene Name: TRAF family member-associated NFKB activator
  ENSP ID: ENSP00000388930
MDKNIGEQLNKAYEAFRQACMDRDSAVKELQQKTENYEQRIREQQEQLSLQQTIIDKLKSQLLLVNSTQDNNYGCVPLLEDSETRKNNLTLDQPQDKVISGIAREKLPKLYPVLDFTITSFVSVYVDW

SEQ ID NO: 89368 - protein, 165 aa, Homo sapiens
  Payload ID: 17905
  Gene Name: TRAF family member-associated NFKB activator
  ENSP ID: ENSP00000392776
MGVEGPAVSRPVIYSILYSDATGRRGMDKNIGEQLNKAYEAFRQACMDRDSAVKELQQKTENYEQRIREQQEQLSLQQTIIDKLKSQLLLVNSTQDNNYGCVPLLEDSETRKNNLTLDQPQDKVISGIAREKLPKVRRQEVSSPRKETSARSLGSPLLHERGNIE

SEQ ID NO: 89369 - protein, 138 aa, Homo sapiens
  Payload ID: 17905
  Gene Name: TRAF family member-associated NFKB activator
  ENSP ID: ENSP00000398157
MDKNIGEQLNKAYEAFRQACMDRDSAVKELQQKQTENYEQRIREQQEQLSLQQTIIDKLKSQLLLVNSTQDNNYGCVPLLEDSETRKNNLTLDQPQDKVISGIAREKLPKVRRQEVSSPRKETSARSLGSPLLHERGN

SEQ ID NO: 89370 - protein, 105 aa, Homo sapiens
  Payload ID: 17905
  Gene Name: TRAF family member-associated NFKB activator
  ENSP ID: ENSP00000399934
MDKNIGEQLNKAYEAFRQACMDRDSAVKELQQKTENYEQRIREQQEQLSLQQTIIDKLKSQLLLVNSTQDNNYGCVPLLEDSETRKNNLTLDQPQDKVISGIARE

SEQ ID NO: 89371 - protein, 36 aa, Homo sapiens
  Payload ID: 17905
  Gene Name: TRAF family member-associated NFKB activator
  ENSP ID: ENSP00000410259
MDKNIGEQLNKAYEAFRQACMDRDSAVKELQQKSLQ

SEQ ID NO: 89372 - protein, 190 aa, Homo sapiens
  Payload ID: 17905
  Gene Name: TRAF family member-associated NFKB activator
  ENSP ID: ENSP00000411041
MDKNIGEQLNKAYEAFRQACMDRDSAVKELQQKQTENYEQRIREQQEQLSLQQTIIDKLKSQLLLVNSTQDNNYGCVPLLEDSETRKNNLTLDQPQDKVISGIAREKLPKVRRQEVSSPRKETSARSLGSPLLHERGNIEKTFWDLKEEFHKICMLAKAQKDHLSKLNIPDTATETQCSVPIQCTDKTDK

SEQ ID NO: 89373 - protein, 275 aa, Homo sapiens
  Payload ID: 17905
  Gene Name: TRAF family member-associated NFKB activator
  ENSP ID: ENSP00000412556
VRRQEVSSPRKETSARSLGSPLLHERGNIEKTFWDLKEEFHKICMLAKAQKDHLSKLNIPDTATETQCSVPIQCTDKTDKQEALFKPQAKDDINRGAPSITSVTPRGLCRDEEDTSFESLSKFNVKFPPMDNDSTFLHSTPERPGILSPATSEAVCQEKFNMEFRDNPGNFVKTEETLFEIQGIDPIASAIQNLKTTDKTKPSNLVNTCIRTTLDRAACLPPGDHNALYVNSFPLLDPSDAPFPSLDSPGKAIRGPQQQGKQLVCDYNLMEKYSA

SEQ ID NO: 89374 - protein, 125 aa, Homo sapiens
  Payload ID: 17905
  Gene Name: TRAF family member-associated NFKB activator
  ENSP ID: ENSP00000412622
MDKNIGEQLNKAYEAFRQACMDRDSAVKELQQKTENYEQRIREQQEQLSLQQTIIDKLKSQLLLVNSTQDNNYGCVPLLEDSETRKNNLTLDQPQDKVISGIAREKLPKPETPHFCPQLLLLILS

SEQ ID NO: 89375 - protein, 469 aa, Homo sapiens
  Payload ID: 17906
  Gene Name: TRAF interacting protein
  Uniprot ID: Q9BWF2
  ENSP ID: ENSP00000328203
MPIRALCTICSDFFDHSRDVAAIHCGHTFHLQCLIQWFETAPSRTCPQCRIQVGKRTIINKLFFDLAQEEENVLDAEFLKNELDNVRAQLSQKDKEKRDSQVIIDTLRDTLEERNATVVSLQQALGKAEMLCSTLKKQMKYLEQQQDETKQAQEEARRLRSKMKTMEQIELLLQSQRPEVEEMIRDMGVGQSAVEQLAVYCVSLKKEYENLKEARKASGEVADKLRKDLFSSRSKLQTVYSELDQAKLELKSAQKDLQSADKEIMSLKKKLTMLQETLNLPPVASETVDRLVLESPAPVEVNLKLRRPSFRDDIDLNATFDVDTPPARPSSSQHGYYEKLCLEKSHSPIQDVPKKICKGPRKESQLSLGGQSCAGEPDEELVGAFPIFVRNAILGQKQPKRPRSESSCSKDVVRTGFDGLGGRTKFIQPTDTVMIRPLPVKPKTKVKQRVRVKTVPSLFQAKLDTFLWS

SEQ ID NO: 89376 - protein, 266 aa, Homo sapiens
  Payload ID: 17906
  Gene Name: TRAF interacting protein
  ENSP ID: ENSP00000418544
MPIRALCTICSDFFDHSRDVAAIHCGHTFHLQCLIQWFETAPSRTCPQCRIQEEENVLDAEFLKNELDNVRAQLSQKDKEKRDSQVIIDTLRDTLEERNATVVSLQQALGKAEMLCSTLKKQMKYLEQQQDETKQAQEEARRLRSKMKTMEQIELLLQSQRPEVEEMIRDMGVGQSAVEQLAVYCVSLKKEYENLKEARKASGEVADKLRKDLFSSRSKLQTVYSELDQAKLELKSAQKDLQSADKEIMSLKKKLTMLQETLNLPP

SEQ ID NO: 89377 - protein, 155 aa, Homo sapiens
  Payload ID: 17906
  Gene Name: TRAF interacting protein
  ENSP ID: ENSP00000419350
MPIRALCTICSDFFDHSRDVAAIHCGHTFHLQCLIQWFETAPSRTCPQCRIQVRVGKRTIINKLFFDLAQEEENVLDAEFLKNELDNVRAQLSQKDKEKRDSQVIIDTLRDTLEERNATVVSLQQALGKAEMLCSTLKKQMKYLEQQQDETKQAQ

SEQ ID NO: 89378 - protein, 99 aa, Homo sapiens
  Payload ID: 17906
  Gene Name: TRAF interacting protein
  ENSP ID: ENSP00000419556
MPIRALCTICSDFFDHSRDVAAIHCGHTFHLQCLIQWFETAPSRTCPQCRIQVGKRTIINKLFFDLAQEEENVLDAEFLKNELDNVRAQLSQKVADSLL

SEQ ID NO: 89379 - protein, 284 aa, Homo sapiens
  Payload ID: 17906
  Gene Name: TRAF interacting protein
  ENSP ID: ENSP00000420085
MPIRALCTICSDFFDHSRDVAAIHCGHTFHLQCLIQWFETAPSRTCPQCRIQVGKRTIINKLFFDLAQEEENVLDAEFLKLQTVYSELDQAKLELKSAQKDLQSADKEIMSLKKKLTMLQETLNLPPVASETVDRLVLESPAPVEVNLKLRRPSFRDDIDLNATFDVDTPPARPSSSQHGYYEKLCLEKSHSPIQDVPKKICKGPRKESQLSLGGQSCAGEPDEELVGAFPIFVRNAILGQKQPKRPRSESSCSKDVVRTGFDGLGGRTKFIQPVSFSCDVELS

SEQ ID NO: 89380 - protein, 1352 aa, Homo sapiens
  Payload ID: 17907
  Gene Name: TRAF2 and NCK interacting kinase
  Uniprot ID: Q9UKE5
  ENSP ID: ENSP00000284483
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYIRRQLEEEQRQLEILQQQLLHEQALLLEYKRKQLEEQRQAERLQRQLKQERDYLVSLQHQRQEQRPVEKKPLYHYKEGMSPSEKPAWAKEVEERSRLNRQSSPAMPHKVANRISDPNLPPRSESFSISGVQPARTPPMLRPVDPQIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPADLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 89381 - protein, 1276 aa, Homo sapiens
  Payload ID: 17907
  Gene Name: TRAF2 and NCK interacting kinase
  Uniprot ID: Q9UKE5
  ENSP ID: ENSP00000345352
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYKRKQLEEQRQAERLQRQLKQERDYLVSLQHQRQEQRPVEKKPLYHYKEGMSPSEKPAWAKEIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPASYKKAIDEDLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 89382 - protein, 1331 aa, Homo sapiens
  Payload ID: 17907
  Gene Name: TRAF2 and NCK interacting kinase
  Uniprot ID: Q9UKE5
  ENSP ID: ENSP00000349880
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYKRKQLEEQRQAERLQRQLKQERDYLVSLQHQRQEQRPVEKKPLYHYKEGMSPSEKPAWAKEVEERSRLNRQSSPAMPHKVANRISDPNLPPRSESFSISGVQPARTPPMLRPVDPQIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPASYKKAIDEDLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 89383 - protein, 1360 aa, Homo sapiens
  Payload ID: 17907
  Gene Name: TRAF2 and NCK interacting kinase
  Uniprot ID: Q9UKE5
  ENSP ID: ENSP00000399511
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYIRRQLEEEQRQLEILQQQLLHEQALLLEYKRKQLEEQRQAERLQRQLKQERDYLVSLQHQRQEQRPVEKKPLYHYKEGMSPSEKPAWAKEVEERSRLNRQSSPAMPHKVANRISDPNLPPRSESFSISGVQPARTPPMLRPVDPQIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPASYKKAIDEDLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 89384 - protein, 350 aa, Homo sapiens
  Payload ID: 17907
  Gene Name: TRAF2 and NCK interacting kinase
  ENSP ID: ENSP00000417338
MSVSLSKLGFIKHLSSTEDDLRDCLLSSSKEGTEDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQ

SEQ ID NO: 89385 - protein, 1268 aa, Homo sapiens
  Payload ID: 17907
  Gene Name: TRAF2 and NCK interacting kinase
  Uniprot ID: Q9UKE5
  ENSP ID: ENSP00000418156
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYKRKQLEEQRQAERLQRQLKQERDYLVSLQHQRQEQRPVEKKPLYHYKEGMSPSEKPAWAKEIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPADLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 89386 - protein, 1305 aa, Homo sapiens
  Payload ID: 17907
  Gene Name: TRAF2 and NCK interacting kinase
  Uniprot ID: Q9UKE5
  ENSP ID: ENSP00000418378
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYIRRQLEEEQRQLEILQQQLLHEQALLLEYKRKQLEEQRQAERLQRQLKQERDYLVSLQHQRQEQRPVEKKPLYHYKEGMSPSEKPAWAKEIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPASYKKAIDEDLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 89387 - protein, 1297 aa, Homo sapiens
  Payload ID: 17907
  Gene Name: TRAF2 and NCK interacting kinase
  Uniprot ID: Q9UKE5
  ENSP ID: ENSP00000418916
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYIRRQLEEEQRQLEILQQQLLHEQALLLEYKRKQLEEQRQAERLQRQLKQERDYLVSLQHQRQEQRPVEKKPLYHYKEGMSPSEKPAWAKEIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPADLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 89388 - protein, 45 aa, Homo sapiens
  Payload ID: 17907
  Gene Name: TRAF2 and NCK interacting kinase
  ENSP ID: ENSP00000419308
MASDSPARSLDEIDLSALRDPAGIFELVELVGNGTYGQVYKQMNQ

SEQ ID NO: 89389 - protein, 1323 aa, Homo sapiens
  Payload ID: 17907
  Gene Name: TRAF2 and NCK interacting kinase
  Uniprot ID: Q9UKE5
  ENSP ID: ENSP00000419990
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYKRKQLEEQRQAERLQRQLKQERDYLVSLQHQRQEQRPVEKKPLYHYKEGMSPSEKPAWAKEVEERSRLNRQSSPAMPHKVANRISDPNLPPRSESFSISGVQPARTPPMLRPVDPQIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPADLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 89390 - protein, 574 aa, Homo sapiens
  Payload ID: 17908
  Gene Name: TRAF3 interacting protein 2
  Uniprot ID: O43734
  ENSP ID: ENSP00000345984
MPPQLQETRMNRSIPVEVDESEPYPSQLLKPIPEYSPEEESEPPAPNIRNMAPNSLSAPTMLHNSSGDFSQAHSTLKLANHQRPVSRQVTCLRTQVLEDSEDSFCRRHPGLGKAFPSGCSAVSEPASESVVGALPAEHQFSFMEKRNQWLVSQLSAASPDTGHDSDKSDQSLPNASADSLGGSQEMVQRPQPHRNRAGLDLPTIDTGYDSQPQDVLGIRQLERPLPLTSVCYPQDLPRPLRSREFPQFEPQRYPACAQMLPPNLSPHAPWNYHYHCPGSPDHQVPYGHDYPRAAYQQVIQPALPGQPLPGASVRGLHPVQKVILNYPSPWDHEERPAQRDCSFPGLPRHQDQPHHQPPNRAGAPGESLECPAELRPQVPQPPSPAAVPRPPSNPPARGTLKTSNLPEELRKVFITYSMDTAMEVVKFVNFLLVNGFQTAIDIFEDRIRGIDIIKWMERYLRDKTVMIIVAISPKYKQDVEGAESQLDEDEHGLHTKYIHRMMQIEFIKQGSMNFRFIPVLFPNAKKEHVPTWLQNTHVYSWPKNKKNILLRLLREEEYVAPPRGPLPTLQVVPL

SEQ ID NO: 89391 - protein, 564 aa, Homo sapiens
  Payload ID: 17908
  Gene Name: TRAF3 interacting protein 2
  Uniprot ID: O43734
  ENSP ID: ENSP00000352889
MNRSIPVEVDESEPYPSQLLKPIPEYSPEEESEPPAPNIRNMAPNSLSAPTMLHNSSGDFSQAHSTLKLANHQRPVSRQVTCLRTQVLEDSEDSFCRRHPGLGKAFPSGCSAVSEPASESVVGALPAEHQFSFMEKRNQWLVSQLSAASPDTGHDSDKSDQSLPNASADSLGGSQEMVQRPQPHRNRAGLDLPTIDTGYDSQPQDVLGIRQLERPLPLTSVCYPQDLPRPLRSREFPQFEPQRYPACAQMLPPNLSPHAPWNYHYHCPGSPDHQVPYGHDYPRAAYQQVIQPALPGQPLPGASVRGLHPVQKVILNYPSPWDHEERPAQRDCSFPGLPRHQDQPHHQPPNRAGAPGESLECPAELRPQVPQPPSPAAVPRPPSNPPARGTLKTSNLPEELRKVFITYSMDTAMEVVKFVNFLLVNGFQTAIDIFEDRIRGIDIIKWMERYLRDTVMIIVAISPKYKQDVEGAESQLDEDEHGLHTKYIHRMMQIEFIKQGSMNFRFIPVLFPNAKKEHVPTWLQNTHVYSWPKNKKNILLRLLREEEYVAPPRGPLPTLQVVPL

SEQ ID NO: 89392 - protein, 109 aa, Homo sapiens
  Payload ID: 17908
  Gene Name: TRAF3 interacting protein 2
  Uniprot ID: O43734
  ENSP ID: ENSP00000357724
MIIVAISPKYKQDVEGAESQLDEDEHGLHTKYIHRMMQIEFIKQGSMNFRFIPVLFPNAKKEHVPTWLQNTHVYSWPKNKKNILLRLLREEEYVAPPRGPLPTLQVVPL

SEQ ID NO: 89393 - protein, 565 aa, Homo sapiens
  Payload ID: 17908
  Gene Name: TRAF3 interacting protein 2
  Uniprot ID: O43734
  ENSP ID: ENSP00000357750
MNRSIPVEVDESEPYPSQLLKPIPEYSPEEESEPPAPNIRNMAPNSLSAPTMLHNSSGDFSQAHSTLKLANHQRPVSRQVTCLRTQVLEDSEDSFCRRHPGLGKAFPSGCSAVSEPASESVVGALPAEHQFSFMEKRNQWLVSQLSAASPDTGHDSDKSDQSLPNASADSLGGSQEMVQRPQPHRNRAGLDLPTIDTGYDSQPQDVLGIRQLERPLPLTSVCYPQDLPRPLRSREFPQFEPQRYPACAQMLPPNLSPHAPWNYHYHCPGSPDHQVPYGHDYPRAAYQQVIQPALPGQPLPGASVRGLHPVQKVILNYPSPWDHEERPAQRDCSFPGLPRHQDQPHHQPPNRAGAPGESLECPAELRPQVPQPPSPAAVPRPPSNPPARGTLKTSNLPEELRKVFITYSMDTAMEVVKFVNFLLVNGFQTAIDIFEDRIRGIDIIKWMERYLRDKTVMIIVAISPKYKQDVEGAESQLDEDEHGLHTKYIHRMMQIEFIKQGSMNFRFIPVLFPNAKKEHVPTWLQNTHVYSWPKNKKNILLRLLREEEYVAPPRGPLPTLQVVPL

SEQ ID NO: 89394 - protein, 574 aa, Homo sapiens; identical to SEQ ID NO: 89390
  Payload ID: 17908
  Gene Name: TRAF3 interacting protein 2
  Uniprot ID: O43734
  ENSP ID: ENSP00000376339

SEQ ID NO: 89395 - protein, 182 aa, Homo sapiens
  Payload ID: 17909
  Gene Name: TRAF3 interacting protein 3
  ENSP ID: ENSP00000355990
MKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQALRFLENEHQQLQAKIECLQGDRDLCSLDTQDLQDQLKRSEAEKLTLVTRVQQLQGLLQNQSLQLQEQEKLLTKKGQQIYYHKF

SEQ ID NO: 89396 - protein, 551 aa, Homo sapiens
  Payload ID: 17909
  Gene Name: TRAF3 interacting protein 3
  Uniprot ID: Q9Y228
  ENSP ID: ENSP00000355991
MISPDPRPSPGLARWAESYEAKCERRQEIRESRRCRPNVTTCRQVGKTLRIQQREQLQRARLQQFFRRRNLELEEKGKAQHPQAREQGPSRRPGQVTVLKEPLSCARRISSPREQVTGTSSEVFPAQHPPPSGICRDLSDHLSSQAGGLPPQDTPIKKPPKHHRGTQTKAEGPTIKNDASQQTNYGVAVLDKEIIQLSDYLKEALQRELVLKQKMVILQDLLSTLIQASDSSWKGQLNEDKLKGKLRSLENQLYTCTQKYSPWGMKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQALRFLENEHQQLQAKIECLQGDRDLCSLDTQDLQDQLKRSEAEKLTLVTRVQQLQGLLQNQSLQLQEQEKLLTKKDQALPVWSPKSFPNEVEPEGTGKEKDWDLRDQLQKKTLQLQAKEKECRELHSELDNLSDEYLSCLRKLQHCREELNQSQQLPPRRQCGRWLPVLMVVIAAALAVFLANKDNLMI

SEQ ID NO: 89397 - protein, 551 aa, Homo sapiens; identical to SEQ ID NO: 89396
  Payload ID: 17909
  Gene Name: TRAF3 interacting protein 3
  Uniprot ID: Q9Y228
  ENSP ID: ENSP00000355992

SEQ ID NO: 89398 - protein, 531 aa, Homo sapiens
  Payload ID: 17909
  Gene Name: TRAF3 interacting protein 3
  Uniprot ID: Q9Y228
  ENSP ID: ENSP00000355993
MISPDPRPSPGLARWAESYEAKCERRQEIRESRRCRPNVTTCRQVGKTLRIQQREQLQRARLQQFFRRRNLELEEKGKAQHPQAREQGPSRRPGQVTGTSSEVFPAQHPPPSGICRDLSDHLSSQAGGLPPQDTPIKKPPKHHRGTQTKAEGPTIKNDASQQTNYGVAVLDKEIIQLSDYLKEALQRELVLKQKMVILQDLLSTLIQASDSSWKGQLNEDKLKGKLRSLENQLYTCTQKYSPWGMKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQALRFLENEHQQLQAKIECLQGDRDLCSLDTQDLQDQLKRSEAEKLTLVTRVQQLQGLLQNQSLQLQEQEKLLTKKDQALPVWSPKSFPNEVEPEGTGKEKDWDLRDQLQKKTLQLQAKEKECRELHSELDNLSDEYLSCLRKLQHCREELNQSQQLPPRRQCGRWLPVLMVVIAAALAVFLANKDNLMI

SEQ ID NO: 89399 - protein, 404 aa, Homo sapiens
  Payload ID: 17909
  Gene Name: TRAF3 interacting protein 3
  ENSP ID: ENSP00000383743
MISPDPRPSPGLARWAESYEAKCERRQEIRESRRCRPNVTTCRQVGKTLRIQQREQLQRARLQQFFRRRNLELEEKGKAQHPQAREQGPSRRPGQVTGTSSEVFPAQHPPPSGICRDLSDHLSSQAGGLPPQDTPIKKPPKHHRGTQTKAEGPTIKNDASQQTNYGVAVLDKEIIQLSDYLKEALQRELVLKQKMVILQDLLSTLIQASDSSWKGQLNEDKLKGKLRSLENQLYTCTQKYSPWGMKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQALRFLENEHQQLQAKIECLQGDRDLCSLDTQDLQDQLKRSEAEKLTLVTRVQQLQEAAGWTT

SEQ ID NO: 89400 - protein, 156 aa, Homo sapiens
  Payload ID: 17909
  Gene Name: TRAF3 interacting protein 3
  ENSP ID: ENSP00000417417
MKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQALRFLENEHQQLQAKIECLQGDRDLCSLDTQDLQEAMWAMAPSADGGDCCSTGSVPGQ

SEQ ID NO: 89401 - protein, 353 aa, Homo sapiens
  Payload ID: 17909
  Gene Name: TRAF3 interacting protein 3
  Uniprot ID: Q9Y228
  ENSP ID: ENSP00000417665
MISPDPRPSPGLARWAESYEAKCERRQEIRESRRCRPNVTTCRQVGKTLRIQQREQLQRARLQQFFRRRNLELEEKGKAQHPQAREQGPSRRPGQVTVLKEPLSCARRISSPREQVTGTSSEVFPAQHPPPSGICRDLSDHLSSQAGGLPPQDTPIKKPPKHHRGTQTKAEGPTIKNDASQQTNYGVAVLDKEIIQLSDYLKEALQRELVLKQKMVILQDLLSTLIQASDSSWKGQLNEDKLKGKLRSLENQLYTCTQKYSPWGMKKVLLEMEDQKNSYEQKAKESLQKVLEEKMNAEQQLQSTQRSLALAEQKCEEWRSQYEALKEDWRTLGTQHRELESQLHVLQSKLQIN

SEQ ID NO: 89402 - protein, 98 aa, Homo sapiens
  Payload ID: 17909
  Gene Name: TRAF3 interacting protein 3
  ENSP ID: ENSP00000418906
MKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQ

SEQ ID NO: 89403 - protein, 26 aa, Homo sapiens
  Payload ID: 17909
  Gene Name: TRAF3 interacting protein 3
  ENSP ID: ENSP00000419180
MISPDPRPSPGLARWAESYEAKCERR

SEQ ID NO: 89404 - protein, 69 aa, Homo sapiens
  Payload ID: 17909
  Gene Name: TRAF3 interacting protein 3
  ENSP ID: ENSP00000436982
LQGDRDLCSLDTQDLQDQLKRSEAEKLTLVTRVQQLQGLLQNQSLQLQEQEKLLTKKVQRTAFRIRQPQ

SEQ ID NO: 89405 - protein, 145 aa, Homo sapiens
  Payload ID: 17910
  Gene Name: trafficking protein particle complex 1
  Uniprot ID: Q9Y5R8
  ENSP ID: ENSP00000302783
MTVHNLYLFDRNGVCLHYSEWHRKKQAGIPKEEEYKLMYGMLFSIRSFVSKMSPLDMKDGFLAFQTSRYKLHYYETPTGIKVVMNTDLGVGPIRDVLHHIYSALYVELVVKNPLCPLGQTVQSELFRSRLDSYVRSLPFFSARAG

SEQ ID NO: 89406 - protein, 145 aa, Homo sapiens; identical to SEQ ID NO: 89405
  Payload ID: 17910
  Gene Name: trafficking protein particle complex 1
  Uniprot ID: Q9Y5R8
  ENSP ID: ENSP00000441130

SEQ ID NO: 89407 - protein, 42 aa, Homo sapiens
  Payload ID: 17910
  Gene Name: trafficking protein particle complex 1
  ENSP ID: ENSP00000459045
MTVHNLYLFDRNGVCLHYSEWHRKKQAGIPKEEEGWLPGLPN

SEQ ID NO: 89408 - protein, 95 aa, Homo sapiens
  Payload ID: 17910
  Gene Name: trafficking protein particle complex 1
  ENSP ID: ENSP00000460674
MTVHNLYLFDRNGVCLHYSEWHRKKQAGIPKEEEYKLMYGMLFSIRSFVSKMSPLDMKDGFLAFQTSRYKLHYYETPTGIKVVMNTDLGVGPIRD

SEQ ID NO: 89409 - protein, 42 aa, Homo sapiens; identical to SEQ ID NO: 89407
  Payload ID: 17910
  Gene Name: trafficking protein particle complex 1
  ENSP ID: ENSP00000460702

SEQ ID NO: 89410 - protein, 75 aa, Homo sapiens
  Payload ID: 17910
  Gene Name: trafficking protein particle complex 1
  ENSP ID: ENSP00000460761
MTVHNLYLFDRNGVCLHYSEWHRKKQAGIPKEEEYKLMYGMLFSIRSFVSKMSPLDMKDGFLAFQTSRYKLHYYE

SEQ ID NO: 89411 - protein, 1259 aa, Homo sapiens
  Payload ID: 17911
  Gene Name: trafficking protein particle complex 10
  Uniprot ID: P48553
  ENSP ID: ENSP00000291574
MDASEEPLPPVIYTMENKPIVTCAGDQNLFTSVYPTLSQQLPREPMEWRRSYGRAPKMIHLESNFVQFKEELLPKEGNKALLTFPFLHIYWTECCDTEVYKATVKDDLTKWQNVLKAHSSVDWLIVIVENDAKKKNKTNILPRTSIVDKIRNDFCNKQSDRCVVLSDPLKDSSRTQESWNAFLTKLRTLLLMSFTKNLGKFEDDMRTLREKRTEPGWSFCEYFMVQEELAFVFEMLQQFEDALVQYDELDALFSQYVVNFGAGDGANWLTFFCQPVKSWNGLILRKPIDMEKRESIQRREATLLDLRSYLFSRQCTLLLFLQRPWEVAQRALELLHNCVQELKLLEVSVPPGALDCWVFLSCLEVLQRIEGCCDRAQIDSNIAHTVGLWSYATEKLKSLGYLCGLVSEKGPNSEDLNRTVDLLAGLGAERPETANTAQSPYKKLKEALSSVEAFEKHYLDLSHATIEMYTSIGRIRSAKFVGKDLAEFYMRKKAPQKAEIYLQGALKNYLAEGWALPITHTRKQLAECQKHLGQIENYLQTSSLLASDHHLTEEERKHFCQEILDFASQPSDSPGHKIVLPMHSFAQLRDLHFDPSNAVVHVGGVLCVEITMYSQMPVPVHVEQIVVNVHFSIEKNSYRKTAEWLTKHKTSNGIINFPPETAPFPVSQNSLPALELYEMFERSPSDNSLNTTGIICRNVHMLLRRQESSSSLEMPSGVALEEGAHVLRCSHVTLEPGANQITFRTQAKEPGTYTLRQLCASVGSVWFVLPHIYPIVQYDVYSQEPQLHVEPLADSLLAGIPQRVKFTVTTGHYTIKNGDSLQLSNAEAMLILCQAESRAVVYSNTREQSSEAALRIQSSDKVTSISLPVAPAYHVIEFELEVLSLPSAPALGGESDMLGMAEPHRKHKDKQRTGRCMVTTDHKVSIDCPWSIYSTVIALTFSVPFRTTHSLLSSGTRKYVQVCVQNLSELDFQLSDSYLVDTGDSTDLQLVPLNTQSQQPIYSKQSVFFVWELKWTEEPPPSLHCRFSVGFSPASEEQLSISLKPYTYEFKVENFFTLYNVKAEIFPPSGMEYCRTGSLCSLEVLITRLSDLLEVDKDEALTESDEHFSTKLMYEVVDNSSNWAVCGKSCGVISMPVAARATHRVHMEVMPLFAGYLPLPDVRLFKYLPHHSAHSSQLDADSWIENDSLSVDKHGDDQPDSSSLKSRGSVHSACSSEHKGLPMPRLQALPAGQVFNSSSGTQVLVIPSQDDHVLEVSVT

SEQ ID NO: 89412 - protein, 276 aa, Homo sapiens
  Payload ID: 17911
  Gene Name: trafficking protein particle complex 10
  Uniprot ID: P48553
  ENSP ID: ENSP00000369570
MDASEEPLPPVIYTMENKPIVTCAGDQNLFTSVYPTLSQQLPREPMEWRRSYGRAPKMIHLESNFVQFKEELLPKEGNKALLTFPFLHIYWTECCDTEVYKATVKDDLTKWQNVLKAHSSVDWLIVIVENDAKKKNKTNILPRTSIVDKIRNDFCNKQSDRCVVLSDPLKDSSRTQESWNAFLTKLRTLLLMSFTKNLGKFEDDMRTLREKRTEPGWSFCEYFMVQEELAFVFEMLQQFEDALVQYDELDALFSQYVVNFGAGGIKCPFHNSVACW

SEQ ID NO: 89413 - protein, 265 aa, Homo sapiens
  Payload ID: 17911
  Gene Name: trafficking protein particle complex 10
  ENSP ID: ENSP00000402221
MDASEEPLPPVIYTMENKPIVTCAGDQNLFTSVYPTLSQQLPREPMEWRRSYGRAPKMIHLESNFVQFKEELLPKEGNKALLTFPFLHIYWTECCDTEVYKATVKDDLTKWQNVLKAHSSVDWLIVIVENDAKKKNKTNILPRTSIVDKIRNDFCNKQSDRCVVLSDPLKDSSRTQESWNAFLTKLRTLLLMSFTKNLGKFEDDMRTLREKRTEPGWSFCEYFMVQEELAFVFEMLQQFEDALVQYDELDALFSQYVVNFGAGGA

SEQ ID NO: 89414 - protein, 1133 aa, Homo sapiens
  Payload ID: 17912
  Gene Name: trafficking protein particle complex 11
  Uniprot ID: Q7Z392
  ENSP ID: ENSP00000335371
MSPTQWDFPVELCCRPMAFVTLTGLDVVYNAVHRAVWDAFCANRRADRVPISFKVLPGDHEYPKCRPKRTSYEWYIPKGILKTGWMNKHLNLVPALVVVFYELDWDEPQWKEKQSECATRVEIVRQSLQGRNTKVAVVLIQKKTPLPPGEDVIASERAAALCNACELSGKSLFVLPHTDHLVGYIIRLENAFYEHAQTYYYTEIRRVKSHKEFLNKTTHQLLFVRHQFKIAFFSELKQDTQNALKNYRTAYNLVHELRAHETNILEIKTMAGFINYKICRLCFQHNTPLDAIAQFRKHIDLCKKKIGSAELSFEHDAWMSKQFQAFGDLFDEAIKLGLTAIQTQNPGFYYQQAAYYAQERKQLAKTLCNHEASVMYPNPDPLETQTGVLDFYGQRSWRQGILSFDLSDPEKEKVGILAIQLKERNVVHSEIIITLLSNAVAQFKKYKCPRMKSHLMVQMGEEYYYAKDYTKALKLLDYVMCDYRSEGWWTLLTSVLTTALKCSYLMAQLKDYITYSLELLGRASTLKDDQKSRIEKNLINVLMNESPDPEPDCDILAVKTAQKLWADRISLAGSNIFTIGVQDFVPFVQCKAKFHAPSFHVDVPVQFDIYLKADCPHPIRFSKLCVSFNNQEYNQFCVIEEASKANEVLENLTQGKMCLVPGKTRKLLFKFVAKTEDVGKKIEITSVDLALGNETGRCVVLNWQGGGGDAASSQEALQAARSFKRRPKLPDNEVHWDSIIIQASTMIISRVPNISVHLLHEPPALTNEMYCLVVTVQSHEKTQIRDVKLTAGLKPGQDANLTQKTHVTLHGTELCDESYPALLTDIPVGDLHPGEQLEKMLYVRCGTVGSRMFLVYVSYLINTTVEEKEIVCKCHKDETVTIETVFPFDVAVKFVSTKFEHLERVYADIPFLLMTDLLSASPWALTIVSSELQLAPSMTTVDQLESQVDNVILQTGESASECFCLQCPSLGNIEGGVATGHYIISWKRTSAMENIPIITTVITLPHVIVENIPLHVNADLPSFGRVRESLPVKYHLQNKTDLVQDVEISVEPSDAFMFSGLKQIRLRILPGTEQEMLYNFYPLMAGYQQLPSLNINLLRFPNFTNQLLRRFIPTSIFVKPQGRLMDDTSIAAA

SEQ ID NO: 89415 - protein, 1086 aa, Homo sapiens
  Payload ID: 17912
  Gene Name: trafficking protein particle complex 11
  Uniprot ID: Q7Z392
  ENSP ID: ENSP00000349738
MSPTQWDFPVELCCRPMAFVTLTGLDVVYNAVHRAVWDAFCANRRADRVPISFKVLPGDHEYPKCRPKRTSYEWYIPKGILKTGWMNKHLNLVPALVVVFYELDWDEPQWKEKQSECATRVEIVRQSLQGRNTKVAVVLIQKKTPLPPGEDVIASERAAALCNACELSGKSLFVLPHTDHLVGYIIRLENAFYEHAQTYYYTEIRRVKSHKEFLNKTTHQLLFVRHQFKIAFFSELKQDTQNALKNYRTAYNLVHELRAHETNILEIKTMAGFINYKICRLCFQHNTPLDAIAQFRKHIDLCKKKIGSAELSFEHDAWMSKQFQAFGDLFDEAIKLGLTAIQTQNPGFYYQQAAYYAQERKQLAKTLCNHEASVMYPNPDPLETQTGVLDFYGQRSWRQGILSFDLSDPEKEKVGILAIQLKERNVVHSEIIITLLSNAVAQFKKYKCPRMKSHLMVQMGEEYYYAKDYTKALKLLDYVMCDYRSEGWWTLLTSVLTTALKCSYLMAQLKDYITYSLELLGRASTLKDDQKSRIEKNLINVLMNESPDPEPDCDILAVKTAQKLWADRISLAGSNIFTIGVQDFVPFVQCKAKFHAPSFHVDVPVQFDIYLKADCPHPIRFSKLCVSFNNQEYNQFCVIEEASKANEVLENLTQGKMCLVPGKTRKLLFKFVAKTEDVGKKIEITSVDLALGNETGRCVVLNWQGGGGDAASSQEALQAARSFKRRPKLPDNEVHWDSIIIQASTMIISRVPNISVHLLHEPPALTNEMYCLVVTVQSHEKTQIRDVKLTAGLKPGQDANLTQKTHVTLHGTELCDESYPALLTDIPVGDLHPGEQLEKMLYVRCGTVGSRMFLVYVSYLINTTVEEKEIVCKCHKDETVTIETVFPFDVAVKFVSTKFEHLERVYADIPFLLMTDLLSASPWALTIVSSELQLAPSMTTVDQLESQVDNVILQTGESASECFCLQCPSLGNIEGGVATGHYIISWKRTSAMENIPIITTVITLPHVIVENIPLHVNADLPSFGRVRESLPVKYHLQNKTDLVQDVEISVEPSDAFMFSGLKQIRLPAQAFYTYQYFCQATGSTHG

SEQ ID NO: 89416 - protein, 739 aa, Homo sapiens
  Payload ID: 17912
  Gene Name: trafficking protein particle complex 11
  ENSP ID: ENSP00000421004
MSCVSSYAGFDLSDPEKEKVGILAIQLKERNVVHSEIIITLLSNAVAQFKKYKCPRMKSHLMVQMGEEYYYAKDYTKALKLLDYVMCDYRSEGWWTLLTSVLTTALKCSYLMAQLKDYITYSLELLGRASTLKDDQKSRIEKNLINVLMNESPDPEPDCDILAVKTAQKLWADRISLAGSNIFTIGVQDFVPFVQCKAKFHAPSFHVDVPVQFDIYLKADCPHPIRFSKLCVSFNNQEYNQFCVIEEASKANEVLENLTQGKMCLVPGKTRKLLFKFVAKTEDVGKKIEITSVDLALGNETGRCVVLNWQGGGGDAASSQEALQAARSFKRRPKLPDNEVHWDSIIIQASTMIISRVPNISVHLLHEPPALTNEMYCLVVTVQSHEKTQIRDVKLTAGLKPGQDANLTQKTHVTLHGTELCDESYPALLTDIPVGDLHPGEQLEKMLYVRCGTVGSRMFLVYVSYLINTTVEEKEIVCKCHKDETVTIETVFPFDVAVKFVSTKFEHLERVYADIPFLLMTDLLSASPWALTIVSSELQLAPSMTTVDQLESQVDNVILQTGESASECFCLQCPSLGNIEGGVATGHYIISWKRTSAMENIPIITTVITLPHVIVENIPLHVNADLPSFGRVRESLPVKYHLQNKTDLVQDVEISVEPSDAFMFSGLKQIRLRILPGTEQEMLYNFYPLMAGYQQLPSLNINLLRFPNFTNQLLRRFIPTSIFVKPQGRLMDDTSIAAA

SEQ ID NO: 89417 - protein, 124 aa, Homo sapiens
  Payload ID: 17912
  Gene Name: trafficking protein particle complex 11
  ENSP ID: ENSP00000422915
MSPTQWDFPVELCCRPMAFVTLTGLDVVYNAVHRAVWDAFCANRRADRVPISFKQAAYYAQERKQLAKTLCNHEASVMYPNPDPLETQTGVLDFYGQRSWRQGILSFDLSDPEKEKVFQALCQL

SEQ ID NO: 89418 - protein, 735 aa, Homo sapiens
  Payload ID: 17913
  Gene Name: trafficking protein particle complex 12
  Uniprot ID: Q8WVT3
  ENSP ID: ENSP00000324318
MEDAGGGEETPAPEAPHPPQLAPPEEQGLLFQEETIDLGGDEFGSEENETASEGSSPLADKLNEHMMESVLISDSPNSEGDAGDLGRVRDEAEPGGEGDPGPEPAGTPSPSGEADGDCAPEDAAPSSGGAPRQDAAREVPGSEAARPEQEPPVAEPVPVCTIFSQRAPPASGDGFEPQMVKSPSFGGASEASARTPPQVVQPSPSLSTFFGDTAASHSLASDFFDSFTTSAFISVSNPGAGSPAPASPPPLAVPGTEGRPEPVAMRGPQAAAPPASPEPFAHIQAVFAGSDDPFATALSMSEMDRRNDAWLPGEATRGVLRAVATQQRGAVFVDKENLTMPGLRFDNIQGDAVKDLMLRFLGEKAAAKRQVLNADSVEQSFVGLKQLISCRNWRAAVDLCGRLLTAHGQGYGKSGLLTSHTTDSLQLWFVRLALLVKLGLFQNAEMEFEPFGNLDQPDLYYEYYPHVYPGRRGSMVPFSMRILHAELQQYLGNPQESLDRLHKVKTVCSKILANLEQGLAEDGGMSSVTQEGRQASIRLWRSRLGRVMYSMANCLLLMKDYVLAVEAYHSVIKYYPEQEPQLLSGIGRISLQIGDIKTAEKYFQDVEKVTQKLDGLQGKIMVLMNSAFLHLGQNNFAEAHRFFTEILRMDPRNAVANNNAAVCLLYLGKLKDSLRQLEAMVQQDPRHYLHESVLFNLTTMYELESSRSMQKKQALLEAVAGKEGDSFNTQCLKLA

SEQ ID NO: 89419 - protein, 735 aa, Homo sapiens; identical to SEQ ID NO: 89418
  Payload ID: 17913
  Gene Name: trafficking protein particle complex 12
  Uniprot ID: Q8WVT3
  ENSP ID: ENSP00000371544

SEQ ID NO: 89420 - protein, 122 aa, Homo sapiens
  Payload ID: 17913
  Gene Name: trafficking protein particle complex 12
  ENSP ID: ENSP00000395420
  MOD_RES (1)..(1): Any amino acid
XHRPDFPAGTCARAFLHLGQNNFAEAHRFFTEILRMDPRNAVANNNAAVCLLYLGKLKDSLRQLEAMVQQDPRHYLHESVLFNLTTMYELESSRSMQKKQALLEAVAGKEGDSFNTQCLKLA

SEQ ID NO: 89421 - protein, 109 aa, Homo sapiens
  Payload ID: 17913
  Gene Name: trafficking protein particle complex 12
  ENSP ID: ENSP00000396407
  MOD_RES (1)..(1): Any amino acid
XEKYFQDVEKVTQKLDGLQGKIMVLMNSAFLHLGQNNFAEAHRFFTEILRMDPRNAVQMLSASHPTGKEPSPKDAEEHPEGHRDSAEPGPARPMVPQRAPPGPALCAQP

SEQ ID NO: 89422 - protein, 234 aa, Homo sapiens
  Payload ID: 17913
  Gene Name: trafficking protein particle complex 12
  ENSP ID: ENSP00000396592
KVKTVCSKILANLEQGLAEDGGMSSVTQEGRQASIRLWRSRLGRVMYSMANCLLLMKDYVLAVEAYHSVIKYYPEQEPQLLSGIGRISLQQIGDIKTAEKYFQDVEKVTQKLDGLQGKIMVLMNSAFLHLGQNNFAEAHRFFTEILRMDPRNAVANNNAAVCLLYLGKLKDSLRQLEAMVQQDPRHYLHESVLFNLTTMYELESSRSMQKKQALLEAVAGKEGDSFNTQCLKLA

SEQ ID NO: 89423 - protein, 63 aa, Homo sapiens
  Payload ID: 17913
  Gene Name: trafficking protein particle complex 12
  ENSP ID: ENSP00000399010
  MOD_RES (1)..(1): Any amino acid
XLYYEYYPHVYPGRRGSMVPFSMRILHAELQQYLGNPQESLDRLHKVKTVCSKQHGYSWRPLS

SEQ ID NO: 89424 - protein, 212 aa, Homo sapiens
  Payload ID: 17913
  Gene Name: trafficking protein particle complex 12
  ENSP ID: ENSP00000399909
  MOD_RES (1)..(1): Any amino acid
XCRNWRAAVDLCGRLLTAHGQGYGKSGLLTSHTTDSLQLWFVRLALLVKLGLFQNAEMEFEPFGNLDQPDLYYEYYPHVYPGRRGSMVPFSMRILHAELQQYLGNPQESLDRLHKVKTVCSKILANLEQGLAEDGGMSSVTQEGRQASIRLWRSRLGRVMYSMANCLLLMKDYVLAVEAYHSVIKYYPEQEPQLLSGIGRISLQRVPSPRAE

SEQ ID NO: 89425 - protein, 36 aa, Homo sapiens
  Payload ID: 17913
  Gene Name: trafficking protein particle complex 12
  ENSP ID: ENSP00000401013
MEFEPFGNLDQPDLYYEYYPHVYPGRRGSMVPFSMR

SEQ ID NO: 89426 - protein, 222 aa, Homo sapiens
  Payload ID: 17913
  Gene Name: trafficking protein particle complex 12
  ENSP ID: ENSP00000405626
  MOD_RES (1)..(1): Any amino acid
XPASGDGFEPQMVKSPSFGGASEASARTPPQVVQPSPSLSTFFGDTAASHSLASDFFDSFTTSAFISVSNPGAGSPAPASPPPLAVPGTEGRPEPVAMRGPQAAAPPASPEPFAHIQAVFAGSDDPFATALSMSEMDRRNDAWLPGEATRGVLRAVATQQRGAVFVDKENLTMPGLRFDNIQGDAVKDLMLRFLGEKAAAKRQVLNADSVEQSFVGLKQLIR

SEQ ID NO: 89427 - protein, 55 aa, Homo sapiens
  Payload ID: 17913
  Gene Name: trafficking protein particle complex 12
  ENSP ID: ENSP00000406497
MYSMANCLLLMKLASMHIRTRRGSAHDGKEHAAASATFRLAEIRLQKSLLVAEWL

SEQ ID NO: 89428 - protein, 192 aa, Homo sapiens
  Payload ID: 17913
  Gene Name: trafficking protein particle complex 12
  ENSP ID: ENSP00000409960
MLRFLGEKAAAKRQVLNADSVEQSFVGLKQLISCRNWRAAVDLCGRLLTAHGQGYGKSGLLTSHTTDSLQLWFVRLALLVKLGLFQNAEMEFEPFGNLDQPDLYYEYYPHVYPGRRGSMVPFSMRILHAELQQYLGNPQESLDRLHKVKTVCSKILANLEQGLAEDGGMSSVTQEGRQASIRLWRSRLGRVM

SEQ ID NO: 89429 - protein, 386 aa, Homo sapiens
  Payload ID: 17913
  Gene Name: trafficking protein particle complex 12
  ENSP ID: ENSP00000481735
GDAVKDLMLRFLGEKAAAKRQVLNADSVEQSFVGLKQLISCRNWRAAVDLCGRLLTAHGQGYGKSGLLTSHTTDSLQLWFVRLALLVKLGLFQNAEMEFEPFGNLDQPDLYYEYYPHVYPGRRGSMVPFSMRILHAELQQYLGNPQESLDRLHKVKTVCSKILANLEQGLAEDGGMSSVTQEGRQASIRLWRSRLGRVMYSMANCLLLMKDYVLAVEAYHSVIKYYPEQEPQLLSGIGRISLQIGDIKTAEKYFQDVEKVTQKLDGLQGKIMVLMNSAFLHLGQNNFAEAHRFFTEILRMDPRNAVANNNAAVCLLYLGKLKDSLRQLEAMVQQDPRHYLHESVLFNLTTMYELESSRSMQKKQALLEAVAGKEGDSFNTQCLKLA

SEQ ID NO: 89430 - protein, 364 aa, Homo sapiens
  Payload ID: 17913
  Gene Name: trafficking protein particle complex 12
  ENSP ID: ENSP00000486221
GDAVKDLMLRFLGEKAAAKRQVLNADSVEQSFVGLKQLISCRNWRAAVDLCGRLLTAHGQGYGKSGLLTSHTTDSLQLWFVRLALLVKLGLFQNAEMEFEPFGNLDQPDLYYEYYPHVYPGRRGSMVPFSMRILHAELQQYLGNPQESLDRLHKVKTVCSKILANLEQGLAEDGGMSSVTQEGRQGCSYLVASIRLWRSRLGRVMYSMANCLLLMKDYVLAVEAYHSVIKYYPEQEPQLLSGIGRISLQIGDIKTAEKYFQDVEKVTQKLDGLQGKIMVLMNSAFLHLGQNNFAEAHRFFTEILRMDPRNAVQMLSASHPTGKEPSPKDAEEHPEGHRDSAEPGPARPMVPQRAPPGPALCAQP

SEQ ID NO: 89431 - protein, 379 aa, Homo sapiens
  Payload ID: 17913
  Gene Name: trafficking protein particle complex 12
  ENSP ID: ENSP00000488507
MLRFLGEKAAAKRQVLNADSVEQSFVGLKQLISCRNWRAAVDLCGRLLTAHGQGYGKSGLLTSHTTDSLQLWFVRLALLVKLGLFQNAEMEFEPFGNLDQPDLYYEYYPHVYPGRRGSMVPFSMRILHAELQQYLGNPQESLDRLHKVKTVCSKILANLEQGLAEDGGMSSVTQEGRQASIRLWRSRLGRVMYSMANCLLLMKDYVLAVEAYHSVIKYYPEQEPQLLSGIGRISLQIGDIKTAEKYFQDVEKVTQKLDGLQGKIMVLMNSAFLHLGQNNFAEAHRFFTEILRMDPRNAVANNNAAVCLLYLGKLKDSLRQLEAMVQQDPRHYLHESVLFNLTTMYELESSRSMQKKQALLEAVAGKEGDSFNTQCLKLA

SEQ ID NO: 89432 - protein, 411 aa, Homo sapiens
  Payload ID: 17914
  Gene Name: trafficking protein particle complex 13
  Uniprot ID: A5PLN9
  ENSP ID: ENSP00000231526
MEVNPPKQEHLLALKVMRLTKPTLFTNIPVTCEEKDLPGDLFNQLMRDDPSTVNGAEVLMLGEMLTLPQNFGNIFLGETFSSYISVHNDSNQVVKDILVKADLQTSSQRLNLSASNAAVAELKPDCCIDDVIHHEVKEIGTHILVCAVSYTTQAGEKMYFRKFFKFQVLKPLDVKTKFYNAETDEVFLEAQIQNMTTSPMFMEKVSLEPSIMYNVTELNSVSQAGECVSTFGSRAYLQPMDTRQYLYCLKPKNEFAEKAGIIKGVTVIGKLDIVWKTNLGERGRLQTSQLQRMAPGYGDVRLSLEAIPDTVNLEEPFHITCKITNCSERTMDLVLEMCNTNSIHWCGISGRQLGKLHPSSSLCLALTLLSSVQGLQSISGLRLTDTFLKRTYEYDDIAQVCVVSSAIKVES

SEQ ID NO: 89433 - protein, 417 aa, Homo sapiens
  Payload ID: 17914
  Gene Name: trafficking protein particle complex 13
  Uniprot ID: A5PLN9
  ENSP ID: ENSP00000382367
MEVNPPKQEHLLALKVMRLTKPTLFTNIPVTCEEKDLPGDLFNQLMRDDPSTVNGAEVLMLGEMLTLPQNFGNIFLGETFSSYISVHNDSNQVVKDILVKADLQTSSQRLNLSASNAAVAELKPDCCIDDVIHHEVKEIGTHILVCAVSYTTQAGEKMYFRKFFKFQVLKPLDVKTKFYNAESDLSSVTDEVFLEAQIQNMTTSPMFMEKVSLEPSIMYNVTELNSVSQAGECVSTFGSRAYLQPMDTRQYLYCLKPKNEFAEKAGIIKGVTVIGKLDIVWKTNLGERGRLQTSQLQRMAPGYGDVRLSLEAIPDTVNLEEPFHITCKITNCSERTMDLVLEMCNTNSIHWCGISGRQLGKLHPSSSLCLALTLLSSVQGLQSISGLRLTDTFLKRTYEYDDIAQVCVVSSAIKVES

SEQ ID NO: 89434 - protein, 418 aa, Homo sapiens
  Payload ID: 17914
  Gene Name: trafficking protein particle complex 13
  Uniprot ID: A5PLN9
  ENSP ID: ENSP00000409231
MEVNPPKQEHLLALKVMRLTKPTLFTNIPVTCEEKDLPGDLFNQLMRDDPSTVNGAEVLMLGEMLTLPQNFGNIFLGETFSSYISVHNDSNQVVKDILVKADLQTSSQRLNLSASNAAVAELKPDCCIDDVIHHEVKEIGTHILVCAVSYTTQAGEKMYFRKFFKFQVLKPLDVKTKFYNAESDLSSVTDEVFLEAQIQNMTTSPMFMEKVSLEPSIMYNVTELNSVSQAGECVSTFGSRAYLQPMDTRQYLYCLKPKNEFAEKAGIIKGVTVIGKLDIVWKTNLGERGRLQTSQLQRMAPGYGDVRLSLEAIPDTVNLEEPFHITCKITNCSSERTMDLVLEMCNTNSIHWCGISGRQLGKLHPSSSLCLALTLLSSVQGLQSISGLRLTDTFLKRTYEYDDIAQVCVVSSAIKVES

SEQ ID NO: 89435 - protein, 412 aa, Homo sapiens
  Payload ID: 17914
  Gene Name: trafficking protein particle complex 13
  Uniprot ID: A5PLN9
  ENSP ID: ENSP00000423405
MEVNPPKQEHLLALKVMRLTKPTLFTNIPVTCEEKDLPGDLFNQLMRDDPSTVNGAEVLMLGEMLTLPQNFGNIFLGETFSSYISVHNDSNQVVKDILVKADLQTSSQRLNLSASNAAVAELKPDCCIDDVIHHEVKEIGTHILVCAVSYTTQAGEKMYFRKFFKFQVLKPLDVKTKFYNAETDEVFLEAQIQNMTTSPMFMEKVSLEPSIMYNVTELNSVSQAGECVSTFGSRAYLQPMDTRQYLYCLKPKNEFAEKAGIIKGVTVIGKLDIVWKTNLGERGRLQTSQLQRMAPGYGDVRLSLEAIPDTVNLEEPFHITCKITNCSSERTMDLVLEMCNTNSIHWCGISGRQLGKLHPSSSLCLALTLLSSVQGLQSISGLRLTDTFLKRTYEYDDIAQVCVVSSAIKVES

SEQ ID NO: 89436 - protein, 81 aa, Homo sapiens
  Payload ID: 17914
  Gene Name: trafficking protein particle complex 13
  ENSP ID: ENSP00000424343
MEVNPPKQEHLLALKVMRLTKPTLFTNIPVTCEEKDLPGDLFNQLMRDDPSTVNGAEVLMLGEMLTLPQNFGLIFRQVLSV

SEQ ID NO: 89437 - protein, 53 aa, Homo sapiens
  Payload ID: 17914
  Gene Name: trafficking protein particle complex 13
  ENSP ID: ENSP00000429396
  MOD_RES (1)..(1): Any amino acid
XVTCEEKDLPGDLFNQLMRDDPSTVNGAEVLMLGEMLTLPQNFGLIFRQVLSV

SEQ ID NO: 89438 - protein, 140 aa, Homo sapiens [sequence omitted]

SEQ ID NO: 89439 - protein, 140 aa, Homo sapiens [sequence omitted]

SEQ ID NO: 89440 - protein, 174 aa, Homo sapiens
  Payload ID: 17915
  Gene Name: trafficking protein particle complex 2
  Uniprot ID: P0DI81
  ENSP ID: ENSP00000392495
MSSWKQDRSGLRSTELNVLEYQPLCAVRSHILKTMSGSFYFVIVGHHDNPVFEMEFLPAGKAESKDDHRHLNQFIAHAALDLVDENMWLSNNMYLKTVDKFNEWFVSAFVTAGHMRFIMLHDIRQEDGIKNFFTDVYDLYIKFSMNPFYEPNSPIRSSAFDRKVQFLGKKHLLS

SEQ ID NO: 89441 - protein, 74 aa, Homo sapiens
  Payload ID: 17915
  Gene Name: trafficking protein particle complex 2
  ENSP ID: ENSP00000428900
MSGSFYFVIVGHHDNPVFEMEFLPAGKAESKDDHRHLNQFIAHAALDLVDENMWLSNNMYLKTVDKFNEWFVSA

SEQ ID NO: 89442 - protein, 113 aa, Homo sapiens
  Payload ID: 17915
  Gene Name: trafficking protein particle complex 2
  ENSP ID: ENSP00000430725
MSGSFYFVIVGHHDNPVFEMEFLPAGKAESKDDHRHLNQFIAHAALDLVDENMWLSNNMYLKTVDKFNEWFVSAFVTAGHMRFIMLHDIRQEDGIKNFFTDVYDLYIKVWYVL

SEQ ID NO: 89443 - protein, 140 aa, Homo sapiens
  Payload ID: 17916
  Gene Name: trafficking protein particle complex 2-like
  Uniprot ID: Q9UL33
  ENSP ID: ENSP00000301021
MAVCIAVIAKENYPLYIRSTPTENELKFHYMVHTSLDVVDEKISAMGKALVDQRELYLGLLYPTEDYKVYGYVTNSKVKFVMVVDSSNTALRDNEIRSMFRKLHNSYTDVMCNPFYNPGDRIQSSRAFDNMVTSMMIQVC

SEQ ID NO: 89444 - protein, 75 aa, Homo sapiens
  Payload ID: 17916
  Gene Name: trafficking protein particle complex 2-like
  ENSP ID: ENSP00000454927
MAVCIAVIAKENYPLYIRSTPTENELKFHYMVHTSLDVVDEKISAMGKALVDQRELYLGLLYPTEDYKLTFRARH

SEQ ID NO: 89445 - protein, 241 aa, Homo sapiens
  Payload ID: 17916
  Gene Name: trafficking protein particle complex 2-like
  ENSP ID: ENSP00000455100
MAVCIAVIAKENYPLYIRSTPTENELKFHYMVHTSLDVVDEKISAMGKALVDQRELYLGLLYPTEDYKVYGYVTNSKVKFVMVVDSSNTALRDNEIRSMFRKLHNSYTDVMCNPFYNPGDRIQSRWALLSVSCHLLSVGHALPFWLPKCNHLENKGGKIFLSYEHHPPRAEVLKPQSPVSPHQLLHRSPAHKVDRVCVVWGVELAHLASQVCPVGTWGTCRTQGQAHGQWLSGITRPFVAT

SEQ ID NO: 89446 - protein, 109 aa, Homo sapiens
  Payload ID: 17916
  Gene Name: trafficking protein particle complex 2-like
  ENSP ID: ENSP00000455235
MAVCIAVIAKENYPLYIRSTPTENELKFHYMVHTSLDVVDEKISAMGKALVDQRELYLGLLYPTEDYKMFRKLHNSYTDVMCNPFYNPGDRIQSRAFDNMVTSMMIQVC

SEQ ID NO: 89447 - protein, 37 aa, Homo sapiens
  Payload ID: 17916
  Gene Name: trafficking protein particle complex 2-like
  ENSP ID: ENSP00000455273
MAVCIAVIAKEVRTRGVGRPGSHHPRLSAFFLLLPWA

SEQ ID NO: 89448 - protein, 75 aa, Homo sapiens; identical to SEQ ID NO: 89444
  Payload ID: 17916
  Gene Name: trafficking protein particle complex 2-like
  ENSP ID: ENSP00000455392

SEQ ID NO: 89449 - protein, 59 aa, Homo sapiens
  Payload ID: 17916
  Gene Name: trafficking protein particle complex 2-like
  ENSP ID: ENSP00000455447
MVVDSSNTALRDNEIRSMFRKLHNSYTDVMCNPFYNPGDRIQSSRAFDNMVTSMMIQVC

SEQ ID NO: 89450 - protein, 129 aa, Homo sapiens
  Payload ID: 17916
  Gene Name: trafficking protein particle complex 2-like
  ENSP ID: ENSP00000455892
MRRSPQWGRPWSTRGSCTWACSTPRRTTRLPHFSKVRAHRGPSTGSPCVTSAFPNQLCRYGYVTNSKVKFVMVVDSSNTALRDNEIRSMFRKLHNSYTDVMCNPFYNPGDRIQSRAFDNMVTSMMIQVC

SEQ ID NO: 89451 - protein, 109 aa, Homo sapiens
  Payload ID: 17916
  Gene Name: trafficking protein particle complex 2-like
  ENSP ID: ENSP00000457684
MVHTSLDVVDEKISAMGKALVDQRELYLGLLYPTEDYKVYGYVTNSKVKFVMVVDSSNTALRDNEIRSMFRKLHNSYTDVMCNPFYNPGDRIQSRAFDNMVTSMMIQVC

SEQ ID NO: 89452 - protein, 146 aa, Homo sapiens
  Payload ID: 17916
  Gene Name: trafficking protein particle complex 2-like
  ENSP ID: ENSP00000457728
MAVCIAVIAKENYPLYIRSTPTENELKFHYMVHTSLDVVDEKISAMGKALVDQRELYLGLLYPTEDYKVYGYVTNSKVKFVMVVDSSNTALRDNEIRSMFRKLHNSYTDVMCNPFYNPGDRIQSSGSVSLSRAFDNMVTSMMIQVC

SEQ ID NO: 89453 - protein, 75 aa, Homo sapiens; identical to SEQ ID NO: 89444
  Payload ID: 17916
  Gene Name: trafficking protein particle complex 2-like
  ENSP ID: ENSP00000487584

SEQ ID NO: 89454 - protein, 118 aa, Homo sapiens
  Payload ID: 17917
  Gene Name: trafficking protein particle complex 3
  ENSP ID: ENSP00000362253
MSRQANRGTESKKMSSELFTLTYGALVTQLCKDYENDEDVNKQLDKMGFNIGVRLIEDFLARSNVGRCHDFRETADVIAKERKMFLGKQNKTKRQAKLYDAVKERGAASCTDASPLLS

SEQ ID NO: 89455 - protein, 134 aa, Homo sapiens
  Payload ID: 17917
  Gene Name: trafficking protein particle complex 3
  Uniprot ID: O43617
  ENSP ID: ENSP00000362256
MGFNIGVRLIEDFLARSNVGRCHDFRETADVIAKVAFKMYLGITPSITNWSPAGDEFSLILENNPLVDFVELPDNHSSLIYSNLLCGVLRGALEMVQMAVEAKFVQDTLKGDGVTEIRMRFIRRIEDNLPAGEE

SEQ ID NO: 89456 - protein, 134 aa, Homo sapiens; identical to SEQ ID NO: 89455
  Payload ID: 17917
  Gene Name: trafficking protein particle complex 3
  Uniprot ID: O43617
  ENSP ID: ENSP00000362257

SEQ ID NO: 89457 - protein, 180 aa, Homo sapiens
  Payload ID: 17917
  Gene Name: trafficking protein particle complex 3
  Uniprot ID: O43617
  ENSP ID: ENSP00000362261
MSRQANRGTESKKMSSELFTLTYGALVTQLCKDYENDEDVNKQLDKMGFNIGVRLIEDFLARSNVGRCHDFRETADVIAKVAFKMYLGITPSITNWSPAGDEFSLILENNPLVDFVELPDNHSSLIYSNLLCGVLRGALEMVQMAVEAKFVQDTLKGDGVTEIRMRFIRRIEDNLPAGEE

SEQ ID NO: 89458 - protein, 188 aa, Homo sapiens
  Payload ID: 17917
  Gene Name: trafficking protein particle complex 3
  ENSP ID: ENSP00000480332
MSRQANRGTESKKMSSELFTLTYGALVTQLCKDYENDEDVNKQLDKILFSNFLPRGFNIGVRLIEDFLARSNVGRCHDFRETADVIAKVAFKMYLGITPSITNWSPAGDEFSLILENNPLVDFVELPDNHSSLIYSNLLCGVLRGALEMVQMAVEAKFVQDTLKGDGVTEIRMRFIRRIEDNLPAGEE

SEQ ID NO: 89459 - protein, 134 aa, Homo sapiens; identical to SEQ ID NO: 89455
  Payload ID: 17917
  Gene Name: trafficking protein particle complex 3
  Uniprot ID: O43617
  ENSP ID: ENSP00000480648

SEQ ID NO: 89460 - protein, 114 aa, Homo sapiens
  Payload ID: 17917
  Gene Name: trafficking protein particle complex 3
  ENSP ID: ENSP00000482052
MSRQANRGTESKKMVAFKMYLGITPSITNWSPAGDEFSLILENNPLVDFVELPDNHSSLIYSNLLCGVLRGALEMVQMAVEAKFVQDTLKGDGVTEIRMRFIRRIEDNLPAGEE

SEQ ID NO: 89461 - protein, 97 aa, Homo sapiens
  Payload ID: 17918
  Gene Name: trafficking protein particle complex 3-like
  Uniprot ID: Q5T215
  ENSP ID: ENSP00000348445
MYLGITPSVTCNNSSKNEFSLILEKNPLVEFVEELPAGRSSLCYCNLLCGIIRGALEMVHLAADVTFLQDRLKGDSVTEIGITFLKKRDEKKYRGKK

SEQ ID NO: 89462 - protein, 181 aa, Homo sapiens
  Payload ID: 17918
  Gene Name: trafficking protein particle complex 3-like
  Uniprot ID: Q5T215
  ENSP ID: ENSP00000357591
MSRPAHRRPEYHKINKDLFVLTYGALVAQLCKDYEKDEDVNQYLDKMGYGIGTRLVEDFLARSCVGRCHSYSEIIDIIAQVAFKMYLGITPSVTCNNSSKNEFSLILEKNPLVEFVEELPAGRSSLCYCNLLCGIIRGALEMVHLAADVTFLQDRLKGDSVTEIGITFLKKRDEKKYRGKK

SEQ ID NO: 89463 - protein, 167 aa, Homo sapiens
  Payload ID: 17918
  Gene Name: trafficking protein particle complex 3-like
  ENSP ID: ENSP00000395769
NKDLFVLTYGALVAQLCKDYEKDEDVNQYLDKMGYGIGTRLVEDFLARSCVGRCHSYSEIIDIIAQVAFKMYLGITPSVTCNNSSKNEFSLILEKNPLVEFVEELPAGRSSLCYCNLLCGIIRGALEMVHLAADVTFLQDRLKGDSVTEIGITFLKKRDEKKYRGKK

SEQ ID NO: 89464 - protein, 181 aa, Homo sapiens
  Payload ID: 17919
  Gene Name: trafficking protein particle complex 4
  ENSP ID: ENSP00000351896
MAIFSVYVVNKAGGLIYQLDSYAPRAEAEKTFSYPLDLLLKLHDERVLVAFGQRDGIRVGHAVLAINGMDVNGRYTADGKEVLEYLGNPANYPVSIRFGRPRLTSNEKLMLASMFHSLFAIGSQLSPEQGSSGIEMLETDTFKLHCYQTLTEMPIRCELFDQNLKLALEVAEKAGTFGPGS

SEQ ID NO: 89465 - protein, 165 aa, Homo sapiens
  Payload ID: 17919
  Gene Name: trafficking protein particle complex 4
  Uniprot ID: Q9Y296
  ENSP ID: ENSP00000405033
MAIFSVYVVNKAGGLIYQLDSYAPRAEAEKTFSYPLDLLLKLHDERVLVAFGQRDGIRVGHAVLAINGMDVNGRYTADGKEMLETDTFKLHCYQTLTGIKFVVLADPRQAGIDSLLRKIYEIYSDFALKNPFYSLEMPIRCELFDQNLKLALEVAEKAGTFGPGS

SEQ ID NO: 89466 - protein, 257 aa, Homo sapiens
  Payload ID: 17919
  Gene Name: trafficking protein particle complex 4
  ENSP ID: ENSP00000432920
MAIFSVYVVNKAGGLIYQLDSYAPRAEAEKTFSYPLDLLLKLHDERVLVAFGQRDGIRVGHAVLAINGMDVNGRYTADGKEVLEYLGNPANYPVSIRFGRPRLTSNEKLMLASMFHSLFAIGSQLSPEQGSSGIEMLETDTFKLHCYQTLTGIKFVVLADPRQAGIDSLLRKIYEIYSDFALKNPFYSLEMPIRACRGKATVGWCSGTWTLFTQPSWTLGPSWCGCFVGGRRQPCWPHKSLQPPRRLCSNCSAWQWC

SEQ ID NO: 89467 - protein, 117 aa, Homo sapiens
  Payload ID: 17919
  Gene Name: trafficking protein particle complex 4
  ENSP ID: ENSP00000433658
MAIFSVYVVNKAGGLIYQLDSYAPRAEAEKTFSYPLDLLLKLHDERVLVAFGQRDGIRVGHAVLAINGMDVNGRYTADGKEVLEYLGNPANYPVSIRFGRPRLTSNEKLMLASMFHS

SEQ ID NO: 89468 - protein, 126 aa, Homo sapiens
  Payload ID: 17919
  Gene Name: trafficking protein particle complex 4
  ENSP ID: ENSP00000435339
MAIFSVYVVNKAGGLIYQLDSYAPRAEAEKTFSYPLDLLLKLHDERVLVAFGQRDGIRGIKFVVLADPRQAGIDSLLRKIYEIYSDFALKNPFYSLEMPIRCELFDQNLKLALEVAEKAGTFGPGS

SEQ ID NO: 89469 - protein, 219 aa, Homo sapiens
  Payload ID: 17919
  Gene Name: trafficking protein particle complex 4
  Uniprot ID: Q9Y296
  ENSP ID: ENSP00000436005
MAIFSVYVVNKAGGLIYQLDSYAPRAEAEKTFSYPLDLLLKLHDERVLVAFGQRDGIRVGHAVLAINGMDVNGRYTADGKEVLEYLGNPANYPVSIRFGRPRLTSNEKLMLASMFHSLFAIGSQLSPEQGSSGIEMLETDTFKLHCYQTLTGIKFVVLADPRQAGIDSLLRKIYEIYSDFALKNPFYSLEMPIRCELFDQNLKLALEVAEKAGTFGPGS

SEQ ID NO: 89470 - protein, 126 aa, Homo sapiens
  Payload ID: 17919
  Gene Name: trafficking protein particle complex 4
  ENSP ID: ENSP00000436281
MAIFSVYVVNKAGGLIYQLDSYAPRAEAEKTFSYPLDLLLKLHDERVLVAFGQRDGIRVGHAVLAINGMDVNGRYTADGKEVLEYLGNPANYPVSIRFGRPRLTSNEKLMLASMFHSDQVCGSSRS

SEQ ID NO: 89471 - protein, 176 aa, Homo sapiens
  Payload ID: 17919
  Gene Name: trafficking protein particle complex 4
  ENSP ID: ENSP00000436827
MAIFSVYVVNKAGGLIYQLDSYAPRAEAEKTFSYPLDLLLKLHDERVLVAFGQRDGIRVGHAVLAINGMDVNGRLFAIGSQLSPEQGSSGIEMLETDTFKLHCYQTLTGIKFVVLADPRQAGIDSLLRKIYEIYSDFALKNPFYSLEMPIRCELFDQNLKLALEVAEKAGTFGPGS

SEQ ID NO: 89472 - protein, 181 aa, Homo sapiens; identical to SEQ ID NO: 89464
  Payload ID: 17919
  Gene Name: trafficking protein particle complex 4
  ENSP ID: ENSP00000485724

SEQ ID NO: 89473 - protein, 257 aa, Homo sapiens; identical to SEQ ID NO: 89466
  Payload ID: 17919
  Gene Name: trafficking protein particle complex 4
  ENSP ID: ENSP00000485730

SEQ ID NO: 89474 - protein, 126 aa, Homo sapiens; identical to SEQ ID NO: 89468
  Payload ID: 17919
  Gene Name: trafficking protein particle complex 4
  ENSP ID: ENSP00000486097

SEQ ID NO: 89475 - protein, 117 aa, Homo sapiens; identical to SEQ ID NO: 89467
  Payload ID: 17919
  Gene Name: trafficking protein particle complex 4
  ENSP ID: ENSP00000486303

SEQ ID NO: 89476 - protein, 165 aa, Homo sapiens; identical to SEQ ID NO: 89465
  Payload ID: 17919
  Gene Name: trafficking protein particle complex 4
  Uniprot ID: Q9Y296
  ENSP ID: ENSP00000486496

SEQ ID NO: 89477 - protein, 176 aa, Homo sapiens; identical to SEQ ID NO: 89471
  Payload ID: 17919
  Gene Name: trafficking protein particle complex 4
  ENSP ID: ENSP00000486853

SEQ ID NO: 89478 - protein, 219 aa, Homo sapiens; identical to SEQ ID NO: 89469
  Payload ID: 17919
  Gene Name: trafficking protein particle complex 4
  Uniprot ID: Q9Y296
  ENSP ID: ENSP00000487467

SEQ ID NO: 89479 - protein, 126 aa, Homo sapiens; identical to SEQ ID NO: 89470
  Payload ID: 17919
  Gene Name: trafficking protein particle complex 4
  ENSP ID: ENSP00000487585

SEQ ID NO: 89480 - protein, 188 aa, Homo sapiens
  Payload ID: 17920
  Gene Name: trafficking protein particle complex 5
  Uniprot ID: Q8IUR0
  ENSP ID: ENSP00000316990
MEARFTRGKSALLERALARPRTEVSLSAFALLFSELVQHCQSRVFSVAELQSRLAALGRQVGARVLDALVAREKGARRETKVLGALLFVKGAVWKALFGKEADKLEQANDDARTFYIIEREPLINTYISVPKENSTLNCASFTAGIVEAVLTHSGFPAKVTAHWHKGTTLMIKFEEAVIARDRALEGR

SEQ ID NO: 89481 - protein, 188 aa, Homo sapiens; identical to SEQ ID NO: 89480
  Payload ID: 17920
  Gene Name: trafficking protein particle complex 5
  Uniprot ID: Q8IUR0
  ENSP ID: ENSP00000399025

SEQ ID NO: 89482 - protein, 188 aa, Homo sapiens; identical to SEQ ID NO: 89480
  Payload ID: 17920
  Gene Name: trafficking protein particle complex 5
  Uniprot ID: Q8IUR0
  ENSP ID: ENSP00000470262

SEQ ID NO: 89483 - protein, 121 aa, Homo sapiens
  Payload ID: 17920
  Gene Name: trafficking protein particle complex 5
  ENSP ID: ENSP00000470703
MEARFTRGKSALLERALARPRTEGAVWKALFGKEADKLEQANDDARTFYIIEREPLINTYISVPKENSTLNCASFTAGIVEAVLTHSGFPAKVTAHWHKGTTLMIKFEEAVIARDRALEGR

SEQ ID NO: 89484 - protein, 173 aa, Homo sapiens
  Payload ID: 17921
  Gene Name: trafficking protein particle complex 6A
  Uniprot ID: O75865
  ENSP ID: ENSP00000006275
MADTVLFEFLHTEMVAELWAHDPDPGPGVSAGLRGEEAGATKGQKMSLSVLEGMGFRVGQALGERLPRETLAFREELDVLKFLCKDLWVAVFQKQMDSLRTNHQGTYVLQDNSFPLLLPMASGLQYLEEAPKFLAFTCGLLRGALYTLGIESVVTASVAALPVCKFQVVIPKS

SEQ ID NO: 89485 - protein, 127 aa, Homo sapiens
  Payload ID: 17921
  Gene Name: trafficking protein particle complex 6A
  Uniprot ID: O75865
  ENSP ID: ENSP00000468182
MADTVLFEFLHTEMVAELWAHDPDPGPGVSAGLRGEEAGATKAAPGDAGLQGGAGCPQVLVQRPVGGGVPEADGQPAHQSPGDLRPARQQLPPPPPDGLWPAVSGGSTQVPGLHLRPPARRPLYPGH

SEQ ID NO: 89486 - protein, 113 aa, Homo sapiens
  Payload ID: 17921
  Gene Name: trafficking protein particle complex 6A
  Uniprot ID: O75865
  ENSP ID: ENSP00000468363
MADTVLFEFLHTEMVAELWAHDPDPGPGAAPGDAGLQGGAGCPQVLVQRPVGGGVPEADGQPAHQSPGDLRPARQQLPPPPPDGLWPAVSGGSTQVPGLHLRPPARRPLYPGH

SEQ ID NO: 89487 - protein, 159 aa, Homo sapiens
  Payload ID: 17921
  Gene Name: trafficking protein particle complex 6A
  Uniprot ID: O75865
  ENSP ID: ENSP00000468612
MADTVLFEFLHTEMVAELWAHDPDPGPGGQKMSLSVLEGMGFRVGQALGERLPRETLAFREELDVLKFLCKDLWVAVFQKQMDSLRTNHQGTYVLQDNSFPLLLPMASGLQYLEEAPKFLAFTCGLLRGALYTLGIESVVTASVAALPVCKFQVVIPKS

SEQ ID NO: 89488 - protein, 158 aa, Homo sapiens
  Payload ID: 17922
  Gene Name: trafficking protein particle complex 6B
  Uniprot ID: Q86SZ2
  ENSP ID: ENSP00000330289
MADEALFLLLHNEMVSGVYKSAEQGEVENGRCITKLENMGFRVGQGLIERFTKDTARFKDELDIMKFICKDFWTTVFKKQIDNLRTNHQGIYVLQDNKFRLLTQMSAGKQYLEHASKYLAFTCGLIRGGLSNLGIKSIVTAEVSSMPACKFQVMIQKL

SEQ ID NO: 89489 - protein, 130 aa, Homo sapiens
  Payload ID: 17922
  Gene Name: trafficking protein particle complex 6B
  Uniprot ID: Q86SZ2
  ENSP ID: ENSP00000335171
MADEALFLLLHNEMVSGVYKSAEQGEVENGRCITKLENMGFRVGQGLIERFTKDTARFKDELDIMKFICKDFWTTVFKKQIDNLRTNHQYLAFTCGLIRGGLSNLGIKSIVTAEVSSMPACKFQVMIQKL

SEQ ID NO: 89490 - protein, 102 aa, Homo sapiens
  Payload ID: 17922
  Gene Name: trafficking protein particle complex 6B
  ENSP ID: ENSP00000450670
MADEALFLLLHNEMVSGVYKSAEQGEENGRCITKLENMGFRVGQGLIERFTKDTARFKDELDIMKFICKDFWTTVFKKQIDNLRTNHQYLAFTCGLIRGGLS

SEQ ID NO: 89491 - protein, 50 aa, Homo sapiens
  Payload ID: 17922
  Gene Name: trafficking protein particle complex 6B
  ENSP ID: ENSP00000451711
MADEALFLLLHNEMVSGVYKSAEQGEVENGRCITKLENMGFRVGQGLIER

SEQ ID NO: 89492 - protein, 50 aa, Homo sapiens; identical to SEQ ID NO: 89491
  Payload ID: 17922
  Gene Name: trafficking protein particle complex 6B
  ENSP ID: ENSP00000452236

SEQ ID NO: 89493 - protein, 1435 aa, Homo sapiens
  Payload ID: 17923
  Gene Name: trafficking protein particle complex 8
  Uniprot ID: Q9Y2L5
  ENSP ID: ENSP00000283351
MAQCVQSVQELIPDSFVPCVAALCSDEAERLTRLNHLSFAELLKPFSRLTSEVHMRDPNNQLHVIKNLKIAVSNIVTQPPQPGAIRKLLNDVVSGSQPAEGLVANVITAGDYDLNISATTPWFESYRETFLQSMPALDHEFLNHYLACMLVASSSEAEPVEQFSKLSQEQHRIQHNSDYSYPKWFIPNTLKYYVLLHDVSAGDEQRAESIYEEMKQKYGTQGCYLLKINSRTSNRASDEQIPDPWSQYLQKNSIQNQESYEDGPCTITSNKNSDNNLLSLDGLDNEVKDGLPNNFRAHPLQLEQSSDPSNSIDGPDHLRSASSLHETKKGNTGIIHGACLTLTDHDRIRQFIQEFTFRGLLPHIEKTIRQLNDQLISRKGLSRSLFSATKKWFSGSKVPEKSINDLKNTSGLLYPPEAPELQIRKMADLCFLVQHYDLAYSCYHTAKKDFLNDQAMLYAAGALEMAAVSAFLQPGAPRPYPAHYMDTAIQTYRDICKNMVLAERCVLLSAELLKSQSKYSEAAALLIRLTSEDSDLRSALLLEQAAHCFINMKSPMVRKYAFHMILAGHRFSKAGQKKHALRCYCQAMQVYKGKGWSLAEDHINFTIGRQSYTLRQLDNAVSAFRHILINESKQSAAQQGAFLREYLYVYKNVSQLSPDGPLPQLPLPYINSSATRVFFGHDRRPADGEKQAATHVSLDQEYDSESSQQWRELEEQVVSVVNKGVIPSNFHPTQYCLNSYSDNSRFPLAVVEEPITVEVAFRNPLKVLLLLTDLSLLWKFHPKDFSGKDNEEVKQLVTSEPEMIGAEVISEFLINGEESKVARLKLFPHHIGELHILGVVYNLGTIQGSMTVDGIGALPGCHTGKYSLSMSVRGKQDLEIQGPRLNNTKEEKTSVKYGPDRRLDPIITEEMPLLEVFFIHFPTGLLCGEIRKAYVEFVNVSKCPLTGLKVVSKRPEFFTFGGNTAVLTPLSPSASENCSAYKTVVTDATSVCTALISSASSVDFGIGTGSQPEVIPVPLPDTVLLPGASVQLPMWLRGPDEEGVHEINFLFYYESVKKQPKIRHRILRHTAIICTSRSLNVRATVCRSNSLENEEGRGGNMLVFVDVENTNTSEAGVKEFHIVQVSSSSKHWKLQKSVNLSENKDTKLASREKGKFCFKAIRCEKEEAATQSSEKYTFADIIFGNEQIISSASPCADFFYRSLSSELKKPQAHLPVHTEKQSTEDAVRLIQKCSEVDLNIVILWKAYVVEDSKQLILEGQHHVILRTIGKEAFSYPQKQEPPEMELLKFFRPENITVSSRPSVEQLSSLIKTSLHYPESFNHPFHQKSLCLVPVTLLLSNCSKADVDVIVDLRHKTTSPEALEIHGSFTWLGQTQYKLQLKSQEIHSLQLKACFVHTGVYNLGTPRVFAKLSDQVTVFETSQQNSMPALIIISNV

SEQ ID NO: 89494 - protein, 926 aa, Homo sapiens
  Payload ID: 17923
  Gene Name: trafficking protein particle complex 8
  ENSP ID: ENSP00000462550
MAQCVQSVQELIPDSFVPCVAALCSDEAERLTRLNHLSFAELLKPFSRLTSEVHMRDPNNQLHVIKNLKIAVSNIVTQPPQPGAIRKLLNDVVSGSQPAEGLVANVITAGDYDLNISATTPWFESYRETFLQSMPALDHEFLNHYLACMLVASSSEAEPVEQFSKLSQEQHRIQHNSDYSYPKWFIPNTLKYYVLLHDVSAGDEQRAESIYEEMKQKYGTQGCYLLKINSRTSNRASDEQIPDPWSQYLQKNSIQNQESYEDGPCTITSNKNSDNNLLSLDGLDNEVKDGLPNNFRAHPLQLEQSSDPSNSIDGPDHLRSASSLHETKKGNTGIIHGACLTLTDHDRIRQFIQEFTFRGLLPHIEKTIRQLNDQLISRKGLSRSLFSATKKWFSGSKVPEKSINDLKNTSGLLYPPEAPELQIRKMADLCFLVQHYDLAYSCYHTAKKDFLNDQAMLYAAGALEMAAVSAFLQPGAPRPYPAHYMDTAIQTYRDICKNMVLAERCVLLSAELLKSQSKYSEAAALLIRLTSEDSDLRSALLLEQAAHCFINMKSPMVRKYAFHMILAGHRFSKAGQKKHALRCYCQAMQVYKGKGWSLAEDHINFTIGRQSYTLRQLDNAVSAFRHILINESKQSAAQQGAFLREYLYVYKNVSQLSPDGPLPQLPLPYINSSATRVFFGHDRRPADGEKQAATHVSLDQEYDSESSQQWRELEEQVVSVVNKGVIPSNFHPTQYCLNSYSDNSRFPLAVVEEPITVEVAFRNPLKVLLLLTDLSLLWKFHPKDFSGKDNEEVKQLVTSEPEMIGAEVISEFLINGEESKVARLKLFPHHIGELHILGVVYNLGTIQGSMTVDGIGALPGCHTGKYSLSMSVRGKQDLEIQGPRLNNTKEEKTSVKYGPDRRLDPIITEEMPLLETLALAQEVNQR

SEQ ID NO: 89495 - protein, 1381 aa, Homo sapiens
  Payload ID: 17923
  Gene Name: trafficking protein particle complex 8
  ENSP ID: ENSP00000463764
MRDPNNQLHVIKNLKIAVSNIVTQPPQPGAIRKLLNDVVSGSQPAEGLVANVITAGDYDLNISATTPWFESYRETFLQSMPALDHEFLNHYLACMLVASSSEAEPVEQFSKLSQEQHRIQHNSDYSYPKWFIPNTLKYYVLLHDVSAGDEQRAESIYEEMKQKYGTQGCYLLKINSRTSNRASDEQIPDPWSQYLQKNSIQNQESYEDGPCTITSNKNSDNNLLSLDGLDNEVKDGLPNNFRAHPLQLEQSSDPSNSIDGPDHLRSASSLHETKKGNTGIIHGACLTLTDHDRIRQFIQEFTFRGLLPHIEKTIRQLNDQLISRKGLSRSLFSATKKWFSGSKVPEKSINDLKNTSGLLYPPEAPELQIRKMADLCFLVQHYDLAYSCYHTAKKDFLNDQAMLYAAGALEMAAVSAFLQPGAPRPYPAHYMDTAIQTYRDICKNMVLAERCVLLSAELLKSQSKYSEAAALLIRLTSEDSDLRSALLLEQAAHCFINMKSPMVRKYAFHMILAGHRFSKAGQKKHALRCYCQAMQVYKGKGWSLAEDHINFTIGRQSYTLRQLDNAVSAFRHILINESKQSAAQQGAFLREYLYVYKNVSQLSPDGPLPQLPLPYINSSATRVFFGHDRRPADGEKQAATHVSLDQEYDSESSQQWRELEEQVVSVVNKGVIPSNFHPTQYCLNSYSDNSRFPLAVVEEPITVEVAFRNPLKVLLLLTDLSLLWKFHPKDFSGKDNEEVKQLVTSEPEMIGAEVISEFLINGEESKVARLKLFPHHIGELHILGVVYNLGTIQGSMTVDGIGALPGCHTGKYSLSMSVRGKQDLEIQGPRLNNTKEEKTSVKYGPDRRLDPIITEEMPLLEVFFIHFPTGLLCGEIRKAYVEFVNVSKCPLTGLKVVSKRPEFFTFGGNTAVLTPLSPSASENCSAYKTVVTDATSVCTALISSASSVDFGIGTGSQPEVIPVPLPDTVLLPGASVQLPMWLRGPDEEGVHEINFLFYYESVKKQPKIRHRILRHTAIICTSRSLNVRATVCRSNSLENEEGRGGNMLVFVDVENTNTSEAGVKEFHIVQVSSSSKHWKLQKSVNLSENKDTKLASREKGKFCFKAIRCEKEEAATQSSEKYTFADIIFGNEQIISSASPCADFFYRSLSSELKKPQAHLPVHTEKQSTEDAVRLIQKCSEVDLNIVILWKAYVVEDSKQLILEGQHHVILRTIGKEAFSYPQKQEPPEMELLKFFRPENITVSSRPSVEQLSSLIKTSLHYPESFNHPFHQKSLCLVPVTLLLSNCSKADVDVIVDLRHKTTSPEALEIHGSFTWLGQTQYKLQLKSQEIHSLQLKACFVHTGVYNLGTPRVFAKLSDQVTVFETSQQNSMPALIIISNV

SEQ ID NO: 89496 - protein, 95 aa, Homo sapiens
  Payload ID: 17923
  Gene Name: trafficking protein particle complex 8
  ENSP ID: ENSP00000463876
EPPEMELLKFFRPENITVSSRPSVEQLSSLIKTSLHYPESFNHPFHQKSLCLVPVTLLLSNCSKADVDVIVDLRHKTTRSTGNPWIIHMAWTNTV

SEQ ID NO: 89497 - protein, 187 aa, Homo sapiens
  Payload ID: 17923
  Gene Name: trafficking protein particle complex 8
  ENSP ID: ENSP00000463973
RVVRGCLDKGRTLNSRKGICDFMSNGKFHMRDPNNQLHVIKNLKIAVSNIVTQPPQPGAIRKLLNDVVSGSQPAEGLVANVITAGDYDLNISATTPWFESYRETFLQSMPALDHEFLNHYLACMLVASSSEAEPVEQFSKLSQEQHRIQHNSDYSYPKWFIPNTLKYYVLLHDVSAGDEQRAESIYE

SEQ ID NO: 89498 - protein, 666 aa, Homo sapiens
  Payload ID: 17923
  Gene Name: trafficking protein particle complex 8
  ENSP ID: ENSP00000464591
MAQCVQSVQELIPDSFVPCVAALCSDEAERLTRLNHLSFAELLKPFSRLTSEVHMRDPNNQLHVIKNLKIAVSNIVTQPPQPGAIRKLLNDVVSGSQPAEGLVANVITAGDYDLNISATTPWFESYRETFLQSMPALDHEFLNHYLACMLVASSSEAEPVEQFSKLSQEQHRIQHNSDYSYPKWFIPNTLKYYVLLHDVSAGDEQRAESIYEEMKQKYGTQGCYLLKINSRTSNRASDEQIPDPWSQYLQKNSIQNQESYEDGPCTITSNKNSDNNLLSLDGLDNEVKDGLPNNFRAHPLQLEQSSDPSNSIDGPDHLRSASSLHETKKGNTGIIHGACLTLTDHDRIRQFIQEFTFRGLLPHIEKTIRQLNDQLISRKGLSRSLFSATKKWFSGSKVPEKSINDLKNTSGLLYPPEAPELQIRKMADLCFLVQHYDLAYSCYHTAKKDFLNDQAMLYAAGALEMAAVSAFLQPGAPRPYPAHYMDTAIQTYRDICKNMVLAERCVLLSAELLKSQSKYSEAAALLIRLTSEDSDLRSALLLEQAAHCFINMKSPMVRKYAFHMILAGHRFSKAGQKKHALRCYCQAMQVYKGKGWSLAEDHINFTIGRQSYTLRQLDNAVSAFRHILINESKQSAAQQGAFLREYLYVYKVTAYFHSGIDIKTVF

SEQ ID NO: 89499 - protein, 1246 aa, Homo sapiens
  Payload ID: 17924
  Gene Name: trafficking protein particle complex 9
  Uniprot ID: Q96Q05
  ENSP ID: ENSP00000373979
MVPAGDQDRAPHRGKPAQAGARTSRASRALRSWRRSQAARATVTHPRGGHDRGSHGGYREGHRGCRRDPQWASAGPPPLSFTEEVKFELRALKDWDFKMSVPDYMQCAEDHQTLLVVVQPVGIVSEENFFRIYKRICSVSQISVRDSQRVLYIRYRHHYPPENNEWGDFQTHRKVVGLITITDCFSAKDWPQTFEKFHVQKEIYGSTLYDSRLFVFGLQGEIVEQPRTDVAFYPNYEDCQTVEKRIEDFIESLFIVLESKRLDRATDKSGDKIPLLCVPFEKKDFVGLDTDSRHYKKRCQGRMRKHVGDLCLQAGMLQDSLVHYHMSVELLRSVNDFLWLGAALEGLCSASVIYHYPGGTGGKSGARRFQGSTLPAEAANRHRPGAQEVLIDPGALTTNGINPDTSTEIGRAKNCLSPEDIIDKYKEAISYYSKYKNAGVIELEACIKAVRVLAIQKRSMEASEFLQNAVYINLRQLSEEEKIQRYSILSELYELIGFHRKSAFFKRVAAMQCVAPSIAEPGWRACYKLLLETLPGYSLSLDPKDFSRGTHRGWAAVQMRLLHELVYASRRMGNPALSVRHLSFLLQTMLDFLSDQEKKDVAQSLENYTSKCPGTMEPIALPGGLTLPPVPFTKLPIVRHVKLLNLPASLRPHKMKSLLGQNVSTKSPFIYSPIIAHNRGEERNKKIDFQWVQGDVCEVQLMVYNPMPFELRVENMGLLTSGVEFESLPAALSLPAESGLYPVTLVGVPQTTGTITVNGYHTTVFGVFSDCLLDNLPGIKTSGSTVEVIPALPRLQISTSLPRSAHSLQPSSGDEISTNVSVQLYNGESQQLIIKLENIGMEPLEKLEVTSKVLTTKEKLYGDFLSWKLEETLAQFPLQPGKVATFTINIKVKLDFSCQENLLQDLSDDGISVSGFPLSSPFRQVVRPRVEGKPVNPPESNKAGDYSHVKTLEAVLNFKYSGGPGHTEGYYRNLSLGLHVEVEPSVFFTRVSTLPATSTRQCHLLLDVFNSTEHELTVSTRSSEALILHAGECQRMAIQVDKFNFESFPESPGEKGQFANPKQLEEERREARGLEIHSKLGICWRIPSLKRSGEASVEGLLNQLVLEHLQLAPLQWDVLVDGQPCDREAVAACQVGDPVRLEVRLTNRSPRSVGPFALTVVPFQDHQNGVHNYDLHDTVSFVGSSTFYLDAVQPSGQSACLGALLFLYTGDFFLHIRFHEDSTSKELPPSWFCLPSVHVCALEAQA

SEQ ID NO: 89500 - protein, 1148 aa, Homo sapiens
  Payload ID: 17924
  Gene Name: trafficking protein particle complex 9
  Uniprot ID: Q96Q05
  ENSP ID: ENSP00000405060
MSVPDYMQCAEDHQTLLVVVQPVGIVSEENFFRIYKRICSVSQISVRDSQRVLYIRYRHHYPPENNEWGDFQTHRKVVGLITITDCFSAKDWPQTFEKFHVQKEIYGSTLYDSRLFVFGLQGEIVEQPRTDVAFYPNYEDCQTVEKRIEDFIESLFIVLESKRLDRATDKSGDKIPLLCVPFEKKDFVGLDTDSRHYKKRCQGRMRKHVGDLCLQAGMLQDSLVHYHMSVELLRSVNDFLWLGAALEGLCSASVIYHYPGGTGGKSGARRFQGSTLPAEAANRHRPGAQEVLIDPGALTTNGINPDTSTEIGRAKNCLSPEDIIDKYKEAISYYSKYKNAGVIELEACIKAVRVLAIQKRSMEASEFLQNAVYINLRQLSEEEKIQRYSILSELYELIGFHRKSAFFKRVAAMQCVAPSIAEPGWRACYKLLLETLPGYSLSLDPKDFSRGTHRGWAAVQMRLLHELVYASRRMGNPALSVRHLSFLLQTMLDFLSDQEKKDVAQSLENYTSKCPGTMEPIALPGGLTLPPVPFTKLPIVRHVKLLNLPASLRPHKMKSLLGQNVSTKSPFIYSPIIAHNRGEERNKKIDFQWVQGDVCEVQLMVYNPMPFELRVENMGLLTSGVEFESLPAALSLPAESGLYPVTLVGVPQTTGTITVNGYHTTVFGVFSDCLLDNLPGIKTSGSTVEVIPALPRLQISTSLPRSAHSLQPSSGDEISTNVSVQLYNGESQQLIIKLENIGMEPLEKLEVTSKVLTTKEKLYGDFLSWKLEETLAQFPLQPGKVATFTINIKVKLDFSCQENLLQDLSDDGISVSGFPLSSPFRQVVRPRVEGKPVNPPESNKAGDYSHVKTLEAVLNFKYSGGPGHTEGYYRNLSLGLHVEVEPSVFFTRVSTLPATSTRQCHLLLDVFNSTEHELTVSTRSSEALILHAGECQRMAIQVDKFNFESFPESPGEKGQFANPKQLEEERREARGLEIHSKLGICWRIPSLKRSGEASVEGLLNQLVLEHLQLAPLQWDVLVDGQPCDREAVAACQVGDPVRLEVRLTNRSPRSVGPFALTVVPFQDHQNGVHNYDLHDTVSFVGSSTFYLDAVQPSGQSACLGALLFLYTGDFFLHIRFHEDSTSKELPPSWFCLPSVHVCALEAQA

SEQ ID NO: 89501 - protein, 992 aa, Homo sapiens
  Payload ID: 17924
  Gene Name: trafficking protein particle complex 9
  ENSP ID: ENSP00000430116
  MOD_RES (1)..(1): Any amino acid
XEDFIESLFIVLESKRLDRATDKSGDKIPLLCVPFEKKDFVGLDTDSRHYKKRCQGRMRKHVGDLCLQAGMLQDSLVHYHMSVELLRSVNDFLWLGAALEGLCSASVIYHYPGGTGGKSGARRFQGSTLPAEAANRHRPGALTTNGINPDTSTEIGRAKNCLSPEDIIDKYKEAISYYSKYKNAGVIELEACIKAVRVLAIQKRSMEASEFLQNAVYINLRQLSEEEKIQRYSILSELYELIGFHRKSAFFKRVAAMQCVAPSIAEPGWRACYKLLLETLPGYSLSLDPKDFSRGTHRGWAAVQMRLLHELVYASRRMGNPALSVRHLSFLLQTMLDFLSDQEKKDVAQSLENYTSKCPGTMEPIALPGGLTLPPVPFTKLPIVRHVKLLNLPASLRPHKMKSLLGQNVSTKSPFIYSPIIAHNRGEERNKKIDFQWVQGDVCEVQLMVYNPMPFELRVENMGLLTSGVEFESLPAALSLPAESGLYPVTLVGVPQTTGTITVNGYHTTVFGVFSDCLLDNLPGIKTSGSTVEVIPALPRLQISTSLPRSAHSLQPSSGDEISTNVSVQLYNGESQQLIIKLENIGMEPLEKLEVTSKVLTTKEKLYGDFLSWKLEETLAQFPLQPGKVATFTINIKVKLDFSCQENLLQDLSDDGISVSGFPLSSPFRQVVRPRVEGKPVNPPESNKAGDYSHVKTLEAVLNFKYSGGPGHTEGYYRNLSLGLHVEVEPSVFFTRVSTLPATSTRQCHLLLDVFNSTEHELTVSTRSSEALILHAGECQRMAIQVDKFNFESFPESPGEKGQFANPKQLEEERREARGLEIHSKLGICWRIPSLKRSGEASVEGLLNQLVLEHLQLAPLQWDVLVDGQPCDREAVAACQVGDPVRLEVRLTNRSPRSVGPFALTVVPFQDHQNGVHNYDLHDTVSFVGSSTFYLDAVQPSGQSACLGALLFLYTGDFFLHIRFHEDSTSKELPPSWFCLPSVHVCALEAQA

SEQ ID NO: 89502 - protein, 91 aa, Homo sapiens
  Payload ID: 17924
  Gene Name: trafficking protein particle complex 9
  ENSP ID: ENSP00000488007
  MOD_RES (1)..(1): Any amino acid
XGESQQLIIKLENIGMEPLEKLEVTSKVLTTKEKLYGDFLSWKLEETLAQFPLQPGKVATFTINIKVKLDFSCQENLLQDLSDGKRFPNFN

SEQ ID NO: 89503 - protein, 140 aa, Homo sapiens [sequence omitted]

SEQ ID NO: 89504 - protein, 140 aa, Homo sapiens [sequence omitted]

SEQ ID NO: 89505 - protein, 953 aa, Homo sapiens
  Payload ID: 17926
  Gene Name: trafficking protein, kinesin binding 1
  Uniprot ID: Q9UPV9
  ENSP ID: ENSP00000328998
MALVFQFGQPVRAQPLPGLCHGKLIRTNACDVCNSTDLPEVEIISLLEEQLPHYKLRADTIYGYDHDDWLHTPLISPDANIDLTTEQIEETLKYFLLCAERVGQMTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGSATLHHWQQLAQPHLGGILDPRPGVVTKGFRTLDVDLDEVYCLNDFEEDDTGDHISLPRLATSTPVQHPETSAHHPGKCMSQTNSTFTFTTCRILHPSDELTRVTPSLNSAPTPACGSTSHLKSTPVATPCTPRRLSLAESFTNTRESTTTMSTSLGLVWLLKERGISAAVYDPQSWDRAGRGSLLHSYTPKMAVIPSTPPNSPMQTPTSSPPSFEFKCTSPPYDNFLASKPASSILREVREKNVRSSESQTDVSVSNLNLVDKVRRFGVAKVVNSGRAHVPTLTEEQGPLLCGPPGPAPALVPRGLVPEGLPLRCPTVTSAIGGLQLNSGIRRNRSFPTMVGSSMQMKAPVTLTSGILMGAKLSKQTSLR

SEQ ID NO: 89506 - protein, 686 aa, Homo sapiens
  Payload ID: 17926
  Gene Name: trafficking protein, kinesin binding 1
  Uniprot ID: Q9UPV9
  ENSP ID: ENSP00000340702
MSLRDKGGEEECFEYDCQDEERKPTHRQHDTQDLLEEVLCAERVGQMTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGSATLHHWQQLAQPHLGGILDPRPGVVTKGFRTLDVDLDEVYCLNDFEEDDTGDHISLPRLATSTPVQHPETSGERSQARVTVSGSRSYPSRPQASPEEMQEPPAATEEEEEEEEEEGSGEGTTISPVNLAPFPEAEFWAILTSVPGTIRSGSLSVASARLCG

SEQ ID NO: 89507 - protein, 895 aa, Homo sapiens
  Payload ID: 17926
  Gene Name: trafficking protein, kinesin binding 1
  ENSP ID: ENSP00000379478
MSLRDKGGEEECFEYDCQDEERKPTHRQHDTQDLLEEVLCAERVGQMTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGSATLHHWQQLAQPHLGGILDPRPGVVTKGFRTLDVDLDEVYCLNDFEEDDTGDHISLPRLATSTPVQHPETSAHHPGKCMSQTNSTFTFTTCRILHPSDELTRVTPSLNSAPTPACGSTSHLKSTPVATPCTPRRLSLAESFTNTRESTTTMSTSLGLVWLLKERGISAAVYDPQSWDRAGRGSLLHSYTPKMAVIPSTPPNSPMQTPTSSPPSFEFKCTSPPYDNFLASKPASSILREVREKNVRSSESQTDVSVSNLNLVDKVRRFGVAKVVNSGRAHVPTLTEEQGPLLCGPPGPAPALVPRGLVPEGLPLRCPTVTSAIGGLQLNSGIRRNRSFPTMVGSSMQMKAPVTLTSGILMGAKLSKQTSLR

SEQ ID NO: 89508 - protein, 44 aa, Homo sapiens
  Payload ID: 17926
  Gene Name: trafficking protein, kinesin binding 1
  ENSP ID: ENSP00000409940
MQKFIEADYYELDWYYEECSDALPQLSLLALRDPDLSSSKSKGK

SEQ ID NO: 89509 - protein, 556 aa, Homo sapiens
  Payload ID: 17926
  Gene Name: trafficking protein, kinesin binding 1
  Uniprot ID: Q9UPV9
  ENSP ID: ENSP00000410717
MQKFIEADYYELDWYYEECSDVLCAERVGQMTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGDHAGPRPLSVLLGDSLWSLIHLRKAGHLCHAYSFFFRDSHPRCWFEFL

SEQ ID NO: 89510 - protein, 300 aa, Homo sapiens
  Payload ID: 17926
  Gene Name: trafficking protein, kinesin binding 1
  ENSP ID: ENSP00000413729
DANVQIASISEELAKKTEDAARQQEEITHLLSQIVDLQKKAKALRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEG

SEQ ID NO: 89511 - protein, 670 aa, Homo sapiens
  Payload ID: 17926
  Gene Name: trafficking protein, kinesin binding 1
  ENSP ID: ENSP00000483516
MQKFIEADYYELDWYYEECSDVLCAERVGQMTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGSATLHHWQQLAQPHLGGILDPRPGVVTKGFRTLDVDLDEVYCLNDFEEDDTGDHISLPRLATSTPVQHPETSGERSQARVTVSGSRSYPSRPQASPEEMQEPPAATEEEEEEEEEEGSGEGTTISPVNLAPFPEAEFWAILTSVPGTIRSGSLSVASARLCG

SEQ ID NO: 89512 - protein, 849 aa, Homo sapiens
  Payload ID: 17926
  Gene Name: trafficking protein, kinesin binding 1
  ENSP ID: ENSP00000486713
MTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGSATLHHWQQLAQPHLGGILDPRPGVVTKGFRTLDVDLDEVYCLNDFEEDDTGDHISLPRLATSTPVQHPETSAHHPGKCMSQTNSTFTFTTCRILHPSDELTRVTPSLNSAPTPACGSTSHLKSTPVATPCTPRRLSLAESFTNTRESTTTMSTSLGLVWLLKERGISAAVYDPQSWDRAGRGSLLHSYTPKMAVIPSTPPNSPMQTPTSSPPSFEFKCTSPPYDNFLASKPASSILREVREKNVRSSESQTDVSVSNLNLVDKVRRFGVAKVVNSGRAHVPTLTEEQGPLLCGPPGPAPALVPRGLVPEGLPLRCPTVTSAIGGLQLNSGIRRNRSFPTMVGSSMQMKAPVTLTSGILMGAKLSKQTSLR

SEQ ID NO: 89513 - protein, 526 aa, Homo sapiens
  Payload ID: 17926
  Gene Name: trafficking protein, kinesin binding 1
  ENSP ID: ENSP00000487488
MTKTYNDIDAVTRLLEEKERDLELAARIGQSLLKKNKTLTERNELLEEQVEHIREEVSQLRHELSMKDELLQFYTSAAEESEPESVCSTPLKRNESSSSVQNYFHLDSLQKKLKDLEEENVVLRSEASQLKTETITYEEKEQQLVNDCVKELRDANVQIASISEELAKKTEDAARQQEEITHLLSQIVDLQKKAKACAVENEELVQHLGAAKDAQRQLTAELRELEDKYAECMEMLHEAQEELKNLRNKTMPNTTSRRYHSLGLFPMDSLAAEIEGTMRKELQLEEAESPDITHQKRVFETVRNINQVVKQRSLTPSPMNIPGSNQSSAMNSLLSSCVSTPRSSFYGSDIGNVVLDNKTNSIILETEAADLGNDERSKKPGTPGTPGSHDLETALRRLSLRRENYLSERRFFEEEQERKLQELAEKGELRSGSLTPTESIMSLGTHSRFSEFTGFSGMSFSSRSYLPEKLQIVKPLEGDHAGPRPLSVLLGDSLWSLIHLRKAGHLCHAYSFFFRDSHPRCWFEFL

SEQ ID NO: 89514 - protein, 914 aa, Homo sapiens
  Payload ID: 17927
  Gene Name: trafficking protein, kinesin binding 2
  Uniprot ID: O60296
  ENSP ID: ENSP00000328875
MSQSQNAIFTSPTGEENLMNSNHRDSESITDVCSNEDLPEVELVSLLEEQLPQYRLKVDTLFLYENQDWTQSPHQRQHASDALSPVLAEETFRYMILGTDRVEQMTKTYNDIDMVTHLLAERDRDLELAARIGQALLKRNHVLSEQNESLEEQLGQAFDQVNQLQHELCKKDELLRIVSIASEESETDSSCSTPLRFNESFSLSQGLLQLEMLQEKLKELEEENMALRSKACHIKTETVTYEEKEQQLVSDCVKELRETNAQMSRMTEELSGKSDELIRYQEELSSLLSQIVDLQHKLKEHVIEKEELKLHLQASKDAQRQLTMELHELQDRNMECLGMLHESQEEIKELRSRSGPTAHLYFSQSYGAFTGESLAAEIEGTMRKKLSLDEESSLFKQKAQQKRVFDTVRIANDTRGRSISFPALLPIPGSNRSSVIMTAKPFESGLQQTEDKSLLNQGSSSEEVAGSSQKMGQPGPSGDSDLATALHRLSLRRQNYLSEKQFFAEEWQRKIQVLADQKEGVSGCVTPTESLASLCTTQSEITDLSSASCLRGFMPEKLQIVKPLEGSQTLYHWQQLAQPNLGTILDPRPGVITKGFTQLPGDAIYHISDLEEDEEEGITFQVQQPLEVEEKLSTSKPVTGIFLPPITSAGGPVTVATANPGKCLSCTNSTFTFTTCRILHPSDITQVTPSSGFPSLSCGSSGSSSSNTAVNSPALSYRLSIGESITNRRDSTTTFSSTMSLAKLLQERGISAKVYHSPISENPLQPLPKSLAIPSTPPNSPSHSPCPSPLPFEPRVHLSENFLASRPAETFLQEMYGLRPSRNPPDVGQLKMNLVDRLKRLGIARVVKNPGAQENGRCQEAEIGPQKPDSAVYLNSGSSLLGGLRRNQSLPVIMGSFAAPVCTSSPKMGVLKED

SEQ ID NO: 89515 - protein, 30 aa, Homo sapiens
  Payload ID: 17927
  Gene Name: trafficking protein, kinesin binding 2
  ENSP ID: ENSP00000388254
MSQSQNAIFTSPTGEENLMNSNHRDSESIT

SEQ ID NO: 89516 - protein, 311 aa, Homo sapiens
  Payload ID: 17927
  Gene Name: trafficking protein, kinesin binding 2
  Uniprot ID: O60296
  ENSP ID: ENSP00000409333
MSQSQNAIFTSPTGEENLMNSNHRDSESITDVCSNEDLPEVELVSLLEEQLPQYRLKVDTLFLYENQDWTQSPHQRQHASDALSPVLAEETFRYMILGTDRVEQMTKTYNDIDMVTHLLAERDRDLELAARIGQALLKRNHVLSEQNESLEEQLGQAFDQVNQLQHELCKKDELLRIVSIASEESETDSSCSTPLRFNESFSLSQGLLQLEMLQEKLKELEEENMALRSKACHIKTETVTYEEKEQQLVSDCVKELRETNAQMSRMTEELSGKSDELIRYQEELSSLLSQIVDLQHKLKEVGLFIHSTDIC

SEQ ID NO: 89517 - protein, 779 aa, Homo sapiens
  Payload ID: 17927
  Gene Name: trafficking protein, kinesin binding 2
  ENSP ID: ENSP00000482435
MILGTDRVEQMTKTYNDIDMVTHLLAERDRDLELAARIGQALLKRNHVLSEQNESLEEQLGQAFDQVNQLQHELCKKDELLRIVSIASEESETDSSCSTPLRFNESFSLSQGLLQLEMLQEKLKELEEENMALRSKACHIKTETVTYEEKEQQLVSDCVKELRETNAQMSRMTEELSGKSDELIRYQEELSSLLSQIVDLQHKLKEHVIEKEELKLHLQASKDAQRQLTMELHELQDRNMECLGMLHESQEEIKELRSRSGPTAHLYFSQSYGAFTGESLAAEIEGTMRKKLSLDEESSLFKQKAQQKRVFDTVRIANDTRGRSISFPALLPIPGSNRSSVIMTAKPFESGLQQTEDKSLLNQGSSSEEVAGSSQKMGQPGPSGDSDLATALHRLSLRRQNYLSEKQFFAEEWQRKIQVLADQKEGVSGCVTPTESLASLCTTQSEITDLSSASCLRGFMPEKLQIVKPLEGSQTLYHWQQLAQPNLGTILDPRPGVITKGFTQLPGDAIYHISDLEEDEEEGITFQVQQPLEVEEKLSTSKPVTGIFLPPITSAGGPVTVATANPGKCLSCTNSTFTFTTCRILHPSDITQVTPSSGFPSLSCGSSGSSSSNTAVNSPALSYRLSIGESITNRRDSTTTFSSTMSLAKLLQERGISAKVYHSPISENPLQPLPKSLAIPSTPPNSPSHSPCPSPLPFEPRVHLSENFLASRPAETFLQEMYGLRPSRNPPDVGQLKMNLVDRLKRLGIARVVKNPVPKRMEDARRQKLVLKNQILLFI

SEQ ID NO: 89518 - protein, 184 aa, Homo sapiens
  Payload ID: 17928
  Gene Name: TRAF-interacting protein with forkhead-associated domain
  Uniprot ID: Q96CG3
  ENSP ID: ENSP00000354911
MTSFEDADTEETVTCLQMTVYHPGQLQCGIFQSISFNREKLPSSEVVKFGRNSNICHYTFQDKQVSRVQFSLQLFKKFNSSVLSFEIKNMSKKTNLIVDSRELGYLNKMDLPYRCMVRFGEYQFLMEKEDGESLEFFETQFILSPRSLLQENNWPPHRPIPEYGTYSLCSSQSSSPTEMDENES

SEQ ID NO: 89519 - protein, 184 aa, Homo sapiens; identical to SEQ ID NO: 89518
  Payload ID: 17928
  Gene Name: TRAF-interacting protein with forkhead-associated domain
  Uniprot ID: Q96CG3
  ENSP ID: ENSP00000424231

SEQ ID NO: 89520 - protein, 161 aa, Homo sapiens
  Payload ID: 17929
  Gene Name: TRAF-interacting protein with forkhead-associated domain, family member B
  Uniprot ID: Q6ZNK6
  ENSP ID: ENSP00000440509
MEKPLTVLRVSLYHPTLGPSAFANVPPRLQHDTSPLLLGRGQDAHLQLQLPRLSRRHLSLEPYLEKGSALLAFCLKALSRKGCVWVNGLTLRYLEQVPLSTVNRVSFSGIQMLVRVEEGTSLEAFVCYFHVSPSPLIYRPEAEETDEWEGISQGQPPPGSG

SEQ ID NO: 89521 - protein, 582 aa, Homo sapiens
  Payload ID: 17930
  Gene Name: TRAF-type zinc finger domain containing 1
  Uniprot ID: O14545
  ENSP ID: ENSP00000257604
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQASSVAEQDFWRAVCEADQSHGGPRSLSDIKGAADEIMLPCEFCEELYPEELLIDHQTSCNPSRALPSLNTGSSSPRGVEEPDVIFQNFLQQAASNQLDSLMGLSNSHPVEESIIIPCEFCGVQLEEEVLFHHQDQCDQRPATATNHVTEGIPRLDSQPQETSPELPRRRVRHQGDLSSGYLDDTKQETANGPTSCLPPSRPINNMTATYNQLSRSTSGPRPGCQPSSPCVPKLSNSDSQDIQGRNRDSQNGAIAPGHVSVIRPPQNLYPENIVPSFSPGPSGRYGASGRSEGGRNSRVTPAAANYRSRTAKAKPSKQQGAGDAEEEEEE

SEQ ID NO: 89522 - protein, 582 aa, Homo sapiens; identical to SEQ ID NO: 89521
  Payload ID: 17930
  Gene Name: TRAF-type zinc finger domain containing 1
  Uniprot ID: O14545
  ENSP ID: ENSP00000396526

SEQ ID NO: 89523 - protein, 164 aa, Homo sapiens
  Payload ID: 17930
  Gene Name: TRAF-type zinc finger domain containing 1
  Uniprot ID: O14545
  ENSP ID: ENSP00000447340
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPELKNKRGRKGIEANSPPKRVVKRVQTWTSCWP

SEQ ID NO: 89524 - protein, 94 aa, Homo sapiens
  Payload ID: 17930
  Gene Name: TRAF-type zinc finger domain containing 1
  ENSP ID: ENSP00000449297
MAEFLDDQETRLCDNCKKEIPVFNFTIHEIHCQRNIGMCPTCKEPFPKSDMETHMAAEHCQVTCKCNKKLEKRLLKKHEVLKTELEAGRGGSSL

SEQ ID NO: 89525 - protein, 135 aa, Homo sapiens
  Payload ID: 17930
  Gene Name: TRAF-type zinc finger domain containing 1
  ENSP ID: ENSP00000449319
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVC

SEQ ID NO: 89526 - protein, 283 aa, Homo sapiens
  Payload ID: 17930
  Gene Name: TRAF-type zinc finger domain containing 1
  ENSP ID: ENSP00000450357
MAEFLDDQETRLCDNCKKEIPVFNFTIHEIHCQRNIGMCPTCKEPFPKSDMETHMAAEHCQVTCKCNKKLEKRLLKKHEETECPLRLAVCQHCDLELSILKLKEHEDYCGARTELCGNCGRNVLVKDLKTHPEVCGREGEEKRNEVAIPPNAYDESWGQDGIWIASQLLRQIEALDPPMRLPRRPLRAFESDVFHNRTTNQRNITAQVSIQNNLFEEQERQERNRGQQPPKEGGEESANLDFMLALSLQNEGQASSVAEQDFWRAVCEADQSHGGPRSLSDIK

SEQ ID NO: 89527 - protein, 72 aa, Homo sapiens
  Payload ID: 17930
  Gene Name: TRAF-type zinc finger domain containing 1
  ENSP ID: ENSP00000473800
MCPTCKEPFPKSDMETHMAAEHCQVTCKCNKKLEKRLLKKHEETECPLRLAVCQHCDLELSILKLKEHEDYC

SEQ ID NO: 89528 - protein, 308 aa, Homo sapiens [sequence omitted]

SEQ ID NO: 89529 - protein, 131 aa, Homo sapiens
  Payload ID: 17931
  Gene Name: trans-2,3-enoyl-CoA reductase
  ENSP ID: ENSP00000469263
MGHNAAGGDSGRKDKGEAVFLGQELTSLRLCFPQVEPHATIAEIKNLFTKTHPQWYPARQSLRLDPKGKSLKDEDVLQKLPVGTTATLYFRDLGAQISWVTVFLTEYAGPLFIYLLFYFRVPFIYGHKYDF

SEQ ID NO: 89530 - protein, 43 aa, Homo sapiens
  Payload ID: 17931
  Gene Name: trans-2,3-enoyl-CoA reductase
  ENSP ID: ENSP00000469343
MPLRNIFKNCTYYWGFAAWMAYYINHPLYTPPTYGAQQVKLAL

SEQ ID NO: 89531 - protein, 47 aa, Homo sapiens
  Payload ID: 17931
  Gene Name: trans-2,3-enoyl-CoA reductase
  ENSP ID: ENSP00000471341
MPLRNIFKNCTYYWGFAAWMAYYINHPLYTPPTYGAQQVKLALAIFV

SEQ ID NO: 89532 - protein, 153 aa, Homo sapiens
  Payload ID: 17931
  Gene Name: trans-2,3-enoyl-CoA reductase
  ENSP ID: ENSP00000472114
MPLRNIFKNCTYYWGFAAWMAYYINHPLYTPPTYGAQQVKLALAIFVICQLGNFSIHMALRDLRPAGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 89533 - protein, 59 aa, Homo sapiens
  Payload ID: 17931
  Gene Name: trans-2,3-enoyl-CoA reductase
  ENSP ID: ENSP00000472504
MKHYEQRDDSSRNQSSLWHSSDSSLLKGGDSGRKDKGEAVFLGQGGAPRHHCGDQEPLH

SEQ ID NO: 89534 - protein, 153 aa, Homo sapiens; identical to SEQ ID NO: 89532
  Payload ID: 17931
  Gene Name: trans-2,3-enoyl-CoA reductase
  ENSP ID: ENSP00000472697

SEQ ID NO: 89535 - protein, 150 aa, Homo sapiens
  Payload ID: 17931
  Gene Name: trans-2,3-enoyl-CoA reductase
  ENSP ID: ENSP00000472957
RRSSCTASPMALCLCATSSRTAPTTGASPRGWPITSITLSTLPLICQLGNFSIHMALRDLRPAGSKTRKIPYPTKNPFTWLFLLVSCPNYTYEVGSWIGFAIMTQCLPVALFSLVGFTQMTIWAKGKHRSYLKEFRDYPPLRMPIIPFLL

SEQ ID NO: 89536 - protein, 38 aa, Homo sapiens
  Payload ID: 17931
  Gene Name: trans-2,3-enoyl-CoA reductase
  ENSP ID: ENSP00000473033
MGHNAAGGDSGRKDKGEAVFLGQGGAPRHHCGDQEPLH

SEQ ID NO: 89537 - protein, 105 aa, Homo sapiens
  Payload ID: 17931
  Gene Name: trans-2,3-enoyl-CoA reductase
  ENSP ID: ENSP00000473129
MKHYEVEILDAKTREKLCFLDKVEPHATIAEIKNLFTKTHPQWYPARQSLRLDPKAARGHHGHTVLPGPGGPDQLGDGLPNRVRGAPFHLPALLLPSALHLWPQI

SEQ ID NO: 89538 - protein, 363 aa, Homo sapiens
  Payload ID: 17932
  Gene Name: trans-2,3-enoyl-CoA reductase-like
  Uniprot ID: Q5HYJ1
  ENSP ID: ENSP00000370607
MFKRHKSLASERKRALLSQRATRFILKDDMRNFHFLSKLVLSAGPLRPTPAVKHSKTTHFEIEIFDAQTRKQICILDKVTQSSTIHDVKQKFHKACPKWYPSRVGLQLECGGPFLKDYITIQSIAASSIVTLYATDLGQQVSWTTVFLAEYTGPLLIYLLFYLRIPCIYDGKESARRLRHPVVHLACFCHCIHYIRYLLETLFVHKVSAGHTPLKNLIMSCAFYWGFTSWIAYYINHPLYTPPSFGNRQITVSAINFLICEAGNHFINVMLSHPNHTGNNACFPSPNYNPFTWMFFLVSCPNYTYEIGSWISFTVMTQTLPVGIFTLLMSIQMSLWAQKKHKIYLRKFNSYIHRKSAMIPFIL

SEQ ID NO: 89539 - protein, 145 aa, Homo sapiens
  Payload ID: 17932
  Gene Name: trans-2,3-enoyl-CoA reductase-like
  ENSP ID: ENSP00000422497
MFKRHKSLASERKRALLSQRATRFILKDDMRNFHFLSKLVLSAGPLRPTPAVKHSKTTHFEIEIFDAQTRKQICILDKVTQSSTIHDVKQKFHKACPKWYPSRVGLQLECGGPFLKDYITIQSIAASSIVTLYATDLGQQVSWTT

SEQ ID NO: 89540 - protein, 27 aa, Homo sapiens
  Payload ID: 17932
  Gene Name: trans-2,3-enoyl-CoA reductase-like
  ENSP ID: ENSP00000423975
PNYNPFTWMFFLVSCPNYTYELEFLHF

SEQ ID NO: 89541 - protein, 326 aa, Homo sapiens
  Payload ID: 17932
  Gene Name: trans-2,3-enoyl-CoA reductase-like
  ENSP ID: ENSP00000426043
MFKRHKSLASERKRALLSQRATRFILKDDMRNFHFLSKLVLSAGPLRPTPAVKHSKTTHFEIEIFDAQTRKQICILDKVTQSSTIHDVKQKFHKACPKWYPSRVGLQLECGGPFLKDYITIQSIAASSIVTLYATDLGQQVSWTTVFLAEYTGPLLIYLLFYLRIPCIYDGKESARRLRHPVVHLACFCHCIHYIRYLLETLFVHKVSAGHTPLKNLIMSCAFYWGFTSWIAYYINHPLYTPPSFGNRQITVSAINFLICEAGNHFINVMLSHPNHTGNNACFPSPNYNPFTWMFFLVSCPNYTYEIGSWISFTVMTQTLPGGLTA

SEQ ID NO: 89542 - protein, 337 aa, Homo sapiens
  Payload ID: 17933
  Gene Name: transaldolase 1
  Uniprot ID: P37837
  ENSP ID: ENSP00000321259
MSSSPVKRQRMESALDQLKQFTTVVADTGDFHAIDEYKPQDATTNPSLILAAAQMPAYQELVEEAIAYGRKLGGSQEDQIKNAIDKLFVLFGAEILKKIPGRVSTEVDARLSFDKDAMVARARRLIELYKEAGISKDRILIKLSSTWEGIQAGKELEEQHGIHCNMTLLFSFAQAVACAEAGVTLISPFVGRILDWHVANTDKKSYEPLEDPGVKSVTKIYNYYKKFSYKTIVMGASFRNTGEIKALAGCDFLTISPKLLGELLQDNAKLVPVLSAKAAQASDLEKIHLDEKSFRWLHNEDQMAVEKLSDGIRKFAADAVKLERMLTERMFNAENGK

SEQ ID NO: 89543 - protein, 93 aa, Homo sapiens
  Payload ID: 17933
  Gene Name: transaldolase 1
  ENSP ID: ENSP00000433501
MSSSPVKRQRMESALDQLKQFTTVVADTGDFHAIDEYKPQDATTNPSLILAAAQMPAYQELVEEAIAYGRKLGGNTKEDSGPSIHRSRRKALL

SEQ ID NO: 89544 - protein, 50 aa, Homo sapiens
  Payload ID: 17933
  Gene Name: transaldolase 1
  ENSP ID: ENSP00000435042
MSSSPVKRQRMESALDQLKQFTTVVADTGDFHVEMGFHRVSQDGLDLLTS

SEQ ID NO: 89545 - protein, 318 aa, Homo sapiens
  Payload ID: 17933
  Gene Name: transaldolase 1
  ENSP ID: ENSP00000437098
MSSSPVKRQRMESALDQLKQFTTVVADTGDFHAIDEYKPQDATTNPSLILAAAQMPAYQELVEEAIAYGRKLGGSQEDQIKNAIDKLFVLFGAEILKKIPGRVSTEVDARLSFDKDAMVARARRLIELYKEAGISKDRILIKLSSTWEGIQAGKELEEQHGIHCNMTLLFSFAQAVACAEAGVTLISPFVGRILDWHVANTDKKSYEPLEDPGVKSVTKIYNYYKKFSYKTIVMGASFRNTGEIKALAGCDFLTISPKLLGELLQDNAKLVPVLSAKPKPVTWKKSTWMRSLSVGCTTRTRWLWRSSLTGSASLPLMQ

SEQ ID NO: 89546 - protein, 433 aa, Homo sapiens
  Payload ID: 17934
  Gene Name: transcobalamin I (vitamin B12 binding protein, R binder family)
  Uniprot ID: P20061
  ENSP ID: ENSP00000257264
MRQSHQLPLVGLLLFSFIPSQLCEICEVSEENYIRLKPLLNTMIQSNYNRGTSAVNVVLSLKLVGIQIQTLMQKMIQQIKYNVKSRLSDVSSGELALIILALGVCRNAEENLIYDYHLIDKLENKFQAEIENMEAHNGTPLTNYYQLSLDVLALCLFNGNYSTAEVVNHFTPENKNYYFGSQFSVDTGAMAVLALTCVKKSLINGQIKADEGSLKNISIYTKSLVEKILSEKKENGLIGNTFSTGEAMQALFVSSDYYNENDWNCQQTLNTVLTEISQGAFSNPNAAAQVLPALMGKTFLDINKDSSCVSASGNFNISADEPITVTPPDSQSYISVNYSVRINETYFTNVTVLNGSVFLSVMEKAQKMNDTIFGFTMEERSWGPYITCIQGLCANNNDRTYWELLSGGEPLSQGAGSYVVRNGENLEVRWSKY

SEQ ID NO: 89547 - protein, 427 aa, Homo sapiens
  Payload ID: 17935
  Gene Name: transcobalamin II
  Uniprot ID: P20062
  ENSP ID: ENSP00000215838
MRHLGAFLFLLGVLGALTEMCEIPEMDSHLVEKLGQHLLPWMDRLSLEHLNPSIYVGLRLSSLQAGTKEDLYLHSLKLGYQQCLLGSAFSEDDGDCQGKPSMGQLALYLLALRANCEFVRGHKGDRLVSQLKWFLEDEKRAIGHDHKGHPHTSYYQYGLGILALCLHQKRVHDSVVDKLLYAVEPFHQGHHSVDTAAMAGLAFTCLKRSNFNPGRRQRITMAIRTVREEILKAQTPEGHFGNVYSTPLALQFLMTSPMRGAELGTACLKARVALLASLQDGAFQNALMISQLLPVLNHKTYIDLIFPDCLAPRVMLEPAAETIPQTQEIISVTLQVLSLLPPYRQSISVLAGSTVEDVLKKAHELGGFTYETQASLSGPYLTSVMGKAAGEREFWQLLRDPNTPLLQGIADYRPKDGETIELRLVSW

SEQ ID NO: 89548 - protein, 400 aa, Homo sapiens
  Payload ID: 17935
  Gene Name: transcobalamin II
  Uniprot ID: P20062
  ENSP ID: ENSP00000384914
MRHLGAFLFLLGVLGALTEMCEIPEMDSHLVEKLGQHLLPWMDRLSLEHLNPSIYVGLRLSSLQAGTKEDLYLHSLKLGYQQCLLGSAFSEDDGDCQGKPSMGQLALYLLALRANWHDHKGHPHTSYYQYGLGILALCLHQKRVHDSVVDKLLYAVEPFHQGHHSVDTAAMAGLAFTCLKRSNFNPGRRQRITMAIRTVREEILKAQTPEGHFGNVYSTPLALQFLMTSPMRGAELGTACLKARVALLASLQDGAFQNALMISQLLPVLNHKTYIDLIFPDCLAPRVMLEPAAETIPQTQEIISVTLQVLSLLPPYRQSISVLAGSTVEDVLKKAHELGGFTYETQASLSGPYLTSVMGKAAGEREFWQLLRDPNTPLLQGIADYRPKDGETIELRLVSW

SEQ ID NO: 89549 - protein, 423 aa, Homo sapiens
  Payload ID: 17935
  Gene Name: transcobalamin II
  ENSP ID: ENSP00000385914
MRHLGAFLFLLGVLGALTEMCEIPEMDSHLVEKLGQHLLPWMDRLSLEHLNPSIYVGLRLSSLQAGTKEDLYLHSLKLGYQQCLLGEDDGDCQGKPSMGQLALYLLALRANCEFVRGHKGDRLVSQLKWFLEDEKRAIGHDHKGHPHTSYYQYGLGILALCLHQKRVHDSVVDKLLYAVEPFHQGHHSVDTAAMAGLAFTCLKRSNFNPGRRQRITMAIRTVREEILKAQTPEGHFGNVYSTPLALQFLMTSPMRGAELGTACLKARVALLASLQDGAFQNALMISQLLPVLNHKTYIDLIFPDCLAPRVMLEPAAETIPQTQEIISVTLQVLSLLPPYRQSISVLAGSTVEDVLKKAHELGGFTYETQASLSGPYLTSVMGKAAGEREFWQLLRDPNTPLLQGIADYRPKDGETIELRLVSW

SEQ ID NO: 89550 - protein, 402 aa, Homo sapiens
  Payload ID: 17935
  Gene Name: transcobalamin II
  ENSP ID: ENSP00000394184
MDSHLVEKLGQHLLPWMDRLSLEHLNPSIYVGLRLSSLQAGTKEDLYLHSLKLGYQQCLLGSAFSEDDGDCQGKPSMGQLALYLLALRANCEFVRGHKGDRLVSQLKWFLEDEKRAIGHDHKGHPHTSYYQYGLGILALCLHQKRVHDSVVDKLLYAVEPFHQGHHSVDTAAMAGLAFTCLKRSNFNPGRRQRITMAIRTVREEILKAQTPEGHFGNVYSTPLALQFLMTSPMRGAELGTACLKARVALLASLQDGAFQNALMISQLLPVLNHKTYIDLIFPDCLAPRVMLEPAAETIPQTQEIISVTLQVLSLLPPYRQSISVLAGSTVEDVLKKAHELGGFTYETQASLSGPYLTSVMGKAAGEREFWQLLRDPNTPLLQGIADYRPKDGETIELRLVSW

SEQ ID NO: 89551 - protein, 351 aa, Homo sapiens
  Payload ID: 17936
  Gene Name: transcription elongation factor A (SII) N-terminal and central domain containing
  Uniprot ID: Q8N8B7
  ENSP ID: ENSP00000369974
MSDKNQIAARASLIEQLMSKRNFEDLGNHLTELETIYVTKEHLQETDVVRAVYRVLKNCPSVALKKKAKCLLSKWKAVYKQTHSKARNSPKLFPVRGNKEENSGPSHDPSQNETLGICSSNSLSSQDVAKLSEMIVPENRAIQLKPKEEHFGDGDPESTGKRSSELLDPTTPMRTKCIELLYAALTSSSTDQPKADLWQNFAREIEEHVFTLYSKNIKKYKTCIRSKVANLKNPRNSHLQQNLLSGTTSPREFAEMTVMEMANKELKQLRASYTESCIQEHYLPQVIDGTQTNKIKCRRCEKYNCKVTVIDRGTLFLPSWVRNSNPDEQMMTYVICNECGEQWYHSKWVCW

SEQ ID NO: 89552 - protein, 272 aa, Homo sapiens
  Payload ID: 17936
  Gene Name: transcription elongation factor A (SII) N-terminal and central domain containing
  ENSP ID: ENSP00000437074
  MOD_RES (1)..(1): Any amino acid
XKQTHSKARNSPKLFPVRGNKEENSGPSHDPSQNETLGICSSNSLSSQDVAKLSEMIVPENRAIQLKPKEEHFGDGDPESTGKRSSELLDPTTPMRTKCIELLYAALTSSSTDQPKADLWQNFAREIEEHVFTLYSKNIKKYKTCIRSKVANLKNPRNSHLQQNLLSGTTSPREFAEMTVMEMANKELKQLRASYTESCIQEHYLPQVIDGTQTNKIKCRRCEKYNCKVTVIDRGTLFLPSWVRNSNPDEQMMTYVICNECGEQWYHSKWVC

SEQ ID NO: 89553 - protein, 381 aa, Homo sapiens
  Payload ID: 17936
  Gene Name: transcription elongation factor A (SII) N-terminal and central domain containing
  Uniprot ID: Q8N8B7
  ENSP ID: ENSP00000440038
MISAHRKLCLPGSSNSPASAFRVAGTTAVKMSDKNQIAARASLIEQLMSKRNFEDLGNHLTELETIYVTKEHLQETDVVRAVYRVLKNCPSVALKKKAKCLLSKWKAVYKQTHSKARNSPKLFPVRGNKEENSGPSHDPSQNETLGICSSNSLSSQDVAKLSEMIVPENRAIQLKPKEEHFGDGDPESTGKRSSELLDPTTPMRTKCIELLYAALTSSSTDQPKADLWQNFAREIEEHVFTLYSKNIKKYKTCIRSKVANLKNPRNSHLQQNLLSGTTSPREFAEMTVMEMANKELKQLRASYTESCIQEHYLPQVIDGTQTNKIKCRRCEKYNCKVTVIDRGTLFLPSWVRNSNPDEQMMTYVICNECGEQWYHSKWVCW

SEQ ID NO: 89554 - protein, 208 aa, Homo sapiens
  Payload ID: 17937
  Gene Name: transcription elongation factor A (SII) N-terminal and central domain containing 2
  Uniprot ID: Q96MN5
  ENSP ID: ENSP00000234827
MDKFVIRTPRIQNSPQKKDSGGKVYKQATIESLKRVVVVEDIKRWKTMLELPDQTKENLVEALQELKKKIPSREVLKSTRIGHTVNKMRKHSDSEVASLAREVYTEWKTFTEKHSNRPSIEVRSDPKTESLRKNAQKLLSEALELKMDHLLVENIERETFHLCSRLINGPYRRTVRALVFTLKHRAEIRAQVKSGSLPVGTFVQTHKK

SEQ ID NO: 89555 - protein, 238 aa, Homo sapiens
  Payload ID: 17937
  Gene Name: transcription elongation factor A (SII) N-terminal and central domain containing 2
  ENSP ID: ENSP00000360382
MAVFSGVLESALFLDQNTLQARQGSRSPLTMDKFVIRTPRIQNSPQKKDSGGKVYKQATIESLKRVVVVEDIKRWKTMLELPDQTKENLVEALQELKKKIPSREVLKSTRIGHTVNKMRKHSDSEVASLAREVYTEWKTFTEKHSNRPSIEVRSDPKTESLRKNAQKLLSEALELKMDHLLVENIERETFHLCSRLINGPYRRTVRALVFTLKHRAEIRAQVKSGSLPVGTFVQTHKK

SEQ ID NO: 89556 - protein, 130 aa, Homo sapiens
  Payload ID: 17937
  Gene Name: transcription elongation factor A (SII) N-terminal and central domain containing 2
  ENSP ID: ENSP00000486433
MEGREVYLWYSVDSRGDFLVFLCPIFFSFSFSEVESLSPRLECSGTISAHCNLCLLGSSYSPASASRVTGITGMCHHAQLIFVFLVEMEFRHVGQTSFELLASSSPPASASQSAGITGVSHCAWPLAQYL

SEQ ID NO: 89557 - protein, 280 aa, Homo sapiens
  Payload ID: 17938
  Gene Name: transcription elongation factor A (SII), 1
  Uniprot ID: P23193
  ENSP ID: ENSP00000395483
MEDEVVRFAKKMDKMVQKKNASTRIGMSVNAIRKQSTDEEVTSLAKSLIKSWKKLLDGPSTEKDLDEKKKEPAITSQNSPEAREESTSSGNVSNRKDETNARDTYVSSFPRAPSTSDSVRLKCREMLAAALRTGDDYIAIGADEEELGSQIEEAIYQEIRNTDMKYKNRVRSRISNLKDAKNPNLRKNVLCGNIPPDLFARMTAEEMASDELKEMRKNLTKEAIREHQMAKTGGTQTDLFTCGKCKKKNCTYTQVQTRSADEPMTTFVVCNECGNRWKFC

SEQ ID NO: 89558 - protein, 111 aa, Homo sapiens
  Payload ID: 17938
  Gene Name: transcription elongation factor A (SII), 1
  ENSP ID: ENSP00000428370
MEDEVVRFAKKMDKMVQKKNAAGALDLLKELKNIPMTLELLQSTRIGMSVNAIRKQSTDEEVTSLAKSLIKSWKKLLDGPSTEKDLDEKKKEPAITSQNSPEAREERYFTV

SEQ ID NO: 89559 - protein, 301 aa, Homo sapiens
  Payload ID: 17938
  Gene Name: transcription elongation factor A (SII), 1
  Uniprot ID: P23193
  ENSP ID: ENSP00000428426
MEDEVVRFAKKMDKMVQKKNAAGALDLLKELKNIPMTLELLQSTRIGMSVNAIRKQSTDEEVTSLAKSLIKSWKKLLDGPSTEKDLDEKKKEPAITSQNSPEAREESTSSGNVSNRKDETNARDTYVSSFPRAPSTSDSVRLKCREMLAAALRTGDDYIAIGADEEELGSQIEEAIYQEIRNTDMKYKNRVRSRISNLKDAKNPNLRKNVLCGNIPPDLFARMTAEEMASDELKEMRKNLTKEAIREHQMAKTGGTQTDLFTCGKCKKKNCTYTQVQTRSADEPMTTFVVCNECGNRWKFC

SEQ ID NO: 89560 - protein, 47 aa, Homo sapiens
  Payload ID: 17938
  Gene Name: transcription elongation factor A (SII), 1
  ENSP ID: ENSP00000428868
MEDEVVRFAKKMDKMVQKKNAAGALDLLKELKNIPMTLELLQCAADP

SEQ ID NO: 89561 - protein, 90 aa, Homo sapiens
  Payload ID: 17938
  Gene Name: transcription elongation factor A (SII), 1
  ENSP ID: ENSP00000429182
MEDEVVRFAKKMDKMVQKKNAAGALDLLKELKNIPMTLELLQSTRIGMSVNAIRKQSTDEEVTSLAKSLIKSWKKLLGIIDLPLHIFMML

SEQ ID NO: 89562 - protein, 117 aa, Homo sapiens
  Payload ID: 17938
  Gene Name: transcription elongation factor A (SII), 1
  ENSP ID: ENSP00000429192
MEDEVVRFAKKMDKMVQKKNAAGALDLLKELKNIPMTLELLQEMASDELKEMRKNLTKEAIREHQMAKTGGTQTDLFTCGKCKKKNCTYTQVQTRSADEPMTTFVVCNECGNRWKFC

SEQ ID NO: 89563 - protein, 45 aa, Homo sapiens
  Payload ID: 17938
  Gene Name: transcription elongation factor A (SII), 1
  ENSP ID: ENSP00000430450
MEDEVVRFAKKMDKMVQKKNAAGALDLLKELKNIPMTLELLQWLP

SEQ ID NO: 89564 - protein, 246 aa, Homo sapiens
  Payload ID: 17939
  Gene Name: transcription elongation factor A (SII), 2
  ENSP ID: ENSP00000339432
MDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEECIFRDVGNTDMKYKNRVRSRISNLKDAKNPDLRRNVLCGAITPQQIAVMTSEEMASDELKEIRKAMTKEAIREHQMARTGGTQTDLFTCGKCRKKNCTYTQ

SEQ ID NO: 89565 - protein, 299 aa, Homo sapiens
  Payload ID: 17939
  Gene Name: transcription elongation factor A (SII), 2
  Uniprot ID: Q15560
  ENSP ID: ENSP00000343515
MMGKEEEIARIARRLDKMVTKKSAEGAMDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEECIFRDVGNTDMKYKNRVRSRISNLKDAKNPDLRRNVLCGAITPQQIAVMTSEEMASDELKEIRKAMTKEAIREHQMARTGGTQTDLFTCGKCRKKNCTYTQVQTRSSDEPMTTFVVCNECGNRWKFC

SEQ ID NO: 89566 - protein, 272 aa, Homo sapiens
  Payload ID: 17939
  Gene Name: transcription elongation factor A (SII), 2
  Uniprot ID: Q15560
  ENSP ID: ENSP00000354552
MDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEECIFRDVGNTDMKYKNRVRSRISNLKDAKNPDLRRNVLCGAITPQQIAVMTSEEMASDELKEIRKAMTKEAIREHQMARTGGTQTDLFTCGKCRKKNCTYTQVQTRSSDEPMTTFVVCNECGNRWKFC

SEQ ID NO: 89567 - protein, 242 aa, Homo sapiens
  Payload ID: 17939
  Gene Name: transcription elongation factor A (SII), 2
  ENSP ID: ENSP00000378493
MMGKEEEIARIARRLDKMVTKKSAEGAMDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEEYILWVGAVGLGFWWSQEAAWPGALWWLLDATAQLSRGHLPGWSPAWVVRLSHLRRAPGPAEGLILSACGA

SEQ ID NO: 89568 - protein, 82 aa, Homo sapiens
  Payload ID: 17939
  Gene Name: transcription elongation factor A (SII), 2
  ENSP ID: ENSP00000391807
MDLLRELKAMPITLHLLQSTRVGMSVNALRKQSSDEEVIALAKSLIKSWKKLLDASDAKARERGRGMPLPTSSRDASEAPDP

SEQ ID NO: 89569 - protein, 246 aa, Homo sapiens; identical to SEQ ID NO: 89564
  Payload ID: 17939
  Gene Name: transcription elongation factor A (SII), 2
  ENSP ID: ENSP00000407085

SEQ ID NO: 89570 - protein, 270 aa, Homo sapiens
  Payload ID: 17939
  Gene Name: transcription elongation factor A (SII), 2
  ENSP ID: ENSP00000416026
MDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEECIFRDVGNTDMKYKNRVRSRISNLKDAKNPDLRRNVLCGAITPQQIAVMTSEEMASDELKEIRKAMTKEAIREHQMARTGGTQTDLFTCGKCRKKNCTYTQVQTRSSDEPMTTFVVCNECGNRWK

SEQ ID NO: 89571 - protein, 154 aa, Homo sapiens
  Payload ID: 17940
  Gene Name: transcription elongation factor A (SII), 3
  Uniprot ID: O75764
  ENSP ID: ENSP00000363729
MGQEEELLRIAKKLEKMVARKNTEGALDLLKKLHSCQMSIQLLQTTRIGVAVNGVRKHCSDKEVVSLAKVLIKNWKRLLDSPGPPKGEKGEEREKAKKKEKGLECSDWKPEAGLSPPRKKREDPKTRRDSVDSKSSASSSPKRPSVERACSLMQ

SEQ ID NO: 89572 - protein, 348 aa, Homo sapiens
  Payload ID: 17940
  Gene Name: transcription elongation factor A (SII), 3
  Uniprot ID: O75764
  ENSP ID: ENSP00000406293
MGQEEELLRIAKKLEKMVARKNTEGALDLLKKLHSCQMSIQLLQTTRIGVAVNGVRKHCSDKEVVSLAKVLIKNWKRLLDSPGPPKGEKGEEREKAKKKEKGLECSDWKPEAGLSPPRKKREDPKTRRDSVDSKSSASSSPKRPSVERSNSSKSKAESPKTPSSPLTPTFASSMCLLAPCYLTGDSVRDKCVEMLSAALKADDDYKDYGVNCDKMASEIEDHIYQELKSTDMKYRNRVRSRISNLKDPRNPGLRRNVLSGAISAGLIAKMTAEEMASDELRELRNAMTQEAIREHQMAKTGGTTTDLFQCSKCKKKNCTYNQVQTRSADEPMTTFVLCNECGNRWKFC

SEQ ID NO: 89573 - protein, 78 aa, Homo sapiens
  Payload ID: 17940
  Gene Name: transcription elongation factor A (SII), 3
  ENSP ID: ENSP00000474530
EMASDELRELRNAMTQEAIREHQMAKTGGTTTDLFQCSKCKKKNCTYNQVQTRSADEPMTTFVLCNECGNRWKMESAS

SEQ ID NO: 89574 - protein, 117 aa, Homo sapiens
  Payload ID: 17940
  Gene Name: transcription elongation factor A (SII), 3
  ENSP ID: ENSP00000474977
MSIQLLQTTRIGVAVNGVRKHCSDKEVVSLAKVLIKNWKRLLDSPGPPKGEKGEEREKAKKKEKGLECSDWKPEAGLSPPRKKREDPKTRRDSVDSKSSASSSPKRPSVERACSLMQ

SEQ ID NO: 89575 - protein, 154 aa, Homo sapiens; identical to SEQ ID NO: 89571
  Payload ID: 17940
  Gene Name: Transcription elongation factor A (SII), 3
  ENSP ID: ENSP00000488968

SEQ ID NO: 89576 - protein, 78 aa, Homo sapiens; identical to SEQ ID NO: 89573
  Payload ID: 17940
  Gene Name: Transcription elongation factor A (SII), 3
  ENSP ID: ENSP00000488976

SEQ ID NO: 89577 - protein, 117 aa, Homo sapiens; identical to SEQ ID NO: 89574
  Payload ID: 17940
  Gene Name: Transcription elongation factor A (SII), 3
  ENSP ID: ENSP00000489390

SEQ ID NO: 89578 - protein, 348 aa, Homo sapiens; identical to SEQ ID NO: 89572
  Payload ID: 17940
  Gene Name: Transcription elongation factor A (SII), 3
  ENSP ID: ENSP00000489592

SEQ ID NO: 89579 - protein, 159 aa, Homo sapiens
  Payload ID: 17941
  Gene Name: transcription elongation factor A (SII)-like 1
  Uniprot ID: Q15170
  ENSP ID: ENSP00000361707
MDKPRKENEEEPQSAPKTDEERPPVEHSPEKQSPEEQSSEEQSSEEEFFPEELLPELLPEMLLSEERPPQEGLSRKDLFEGRPPMEQPPCGVGKHKLEEGSFKERLARSRPQFRGDIHGRNLSNEEMIQAADELEEMKRVRNKLMIMHWKAKRSRPYPI

SEQ ID NO: 89580 - protein, 159 aa, Homo sapiens; identical to SEQ ID NO: 89579
  Payload ID: 17941
  Gene Name: transcription elongation factor A (SII)-like 1
  Uniprot ID: Q15170
  ENSP ID: ENSP00000361708

SEQ ID NO: 89581 - protein, 159 aa, Homo sapiens; identical to SEQ ID NO: 89579
  Payload ID: 17941
  Gene Name: transcription elongation factor A (SII)-like 1
  Uniprot ID: Q15170
  ENSP ID: ENSP00000361709

SEQ ID NO: 89582 - protein, 227 aa, Homo sapiens
  Payload ID: 17942
  Gene Name: transcription elongation factor A (SII)-like 2
  Uniprot ID: Q9H3H9
  ENSP ID: ENSP00000332359
MEKLFNENEGMPSNQGKIDNEEQPPHEGKPEVACILEDKKLENEGNTENTGKRVEEPLKDKEKPESAGKAKGEGKSERKGKSEMQGGSKTEGKPERGGRAEGEGEPDSEREPESEGEPESETRAAGKRPAEDDIPRKAKRKTNKGLAQYLKQYKEAIHDMNFSNEDMIREFDNMARVEDKRRKSKQKLGAFLWMQRNLQDPFYPRGPREFRGGCRAPRRDTEDIPYV

SEQ ID NO: 89583 - protein, 227 aa, Homo sapiens; identical to SEQ ID NO: 89582
  Payload ID: 17942
  Gene Name: transcription elongation factor A (SII)-like 2
  Uniprot ID: Q9H3H9
  ENSP ID: ENSP00000361866

SEQ ID NO: 89584 - protein, 200 aa, Homo sapiens
  Payload ID: 17943
  Gene Name: transcription elongation factor A (SII)-like 3
  Uniprot ID: Q969E4
  ENSP ID: ENSP00000243286
MEKPYNKNEGNLENEGKPEDEVEPDDEGKSDEEEKPDVEGKTECEGKREDEGEPGDEGQLEDEGSQEKQGRSEGEGKPQGEGKPASQAKPESQPRAAEKRPAEDYVPRKAKRKTDRGTDDSPKDSQEDLQERHLSSEEMMRECGDVSRAQEELRKKQKMGGFHWMQRDVQDPFAPRGQRGVRGVRGGGRGQRGLHDIPYL

SEQ ID NO: 89585 - protein, 200 aa, Homo sapiens; identical to SEQ ID NO: 89584
  Payload ID: 17943
  Gene Name: transcription elongation factor A (SII)-like 3
  Uniprot ID: Q969E4
  ENSP ID: ENSP00000361710

SEQ ID NO: 89586 - protein, 200 aa, Homo sapiens; identical to SEQ ID NO: 89584
  Payload ID: 17943
  Gene Name: transcription elongation factor A (SII)-like 3
  Uniprot ID: Q969E4
  ENSP ID: ENSP00000361711

SEQ ID NO: 89587 - protein, 358 aa, Homo sapiens
  Payload ID: 17944
  Gene Name: transcription elongation factor A (SII)-like 4
  Uniprot ID: Q96EI5
  ENSP ID: ENSP00000361712
MPAGGQAPQLTPVIPAFWEARGLPNSKGRDKVHICQCEEWKGHISYVERDITTSEIKSLPQVSVRAFHAASGTLEWRKGNGYGRGKGWGWGRVESREAGPSVDRDGGLRVCCSQRSAKPEKEEQPVQNPRRSVKDRKRRGNLDMEKLYSENEGMASNQGKMENEEQPQDERKPEVTCTLEDKKLENEGKTENKGKTGDEEMLKDKGKPESEGEAKEGKSEREGESEMEGGSEREGKPEIEGKPESEGEPGSETRAAGKRPAEDDVPRKAKRKTNKGLAHYLKEYKEAIHDMNFSNEDMIREFDNMAKVQDEKRKSKQKLGAFLWMQRNLQDPFYPRGPREFRGGCRAPRRDIEDIPYV

SEQ ID NO: 89588 - protein, 58 aa, Homo sapiens
  Payload ID: 17944
  Gene Name: transcription elongation factor A (SII)-like 4
  ENSP ID: ENSP00000394029
MEKLYSENEGMASNQGKMENEEQPQDERKPEVTCTLEDKKLENEGKTENKGKTGDEEM

SEQ ID NO: 89589 - protein, 50 aa, Homo sapiens
  Payload ID: 17944
  Gene Name: transcription elongation factor A (SII)-like 4
  ENSP ID: ENSP00000411320
MEKLYSENEGMASNQGKMENEEQPQDERKPEVTCTLEDKKLENEGKTENK

SEQ ID NO: 89590 - protein, 215 aa, Homo sapiens
  Payload ID: 17944
  Gene Name: transcription elongation factor A (SII)-like 4
  Uniprot ID: Q96EI5
  ENSP ID: ENSP00000415564
MEKLYSENEGMASNQGKMENEEQPQDERKPEVTCTLEDKKLENEGKTENKGKTGDEEMLKDKGKPESEGEAKEGKSEREGESEMEGGSEREGKPEIEGKPESEGEPGSETRAAGKRPAEDDVPRKAKRKTNKGLAHYLKEYKEAIHDMNFSNEDMIREFDNMAKVQDEKRKSKQKLGAFLWMQRNLQDPFYPRGPREFRGGCRAPRRDIEDIPYV

SEQ ID NO: 89591 - protein, 215 aa, Homo sapiens; identical to SEQ ID NO: 89590
  Payload ID: 17944
  Gene Name: transcription elongation factor A (SII)-like 4
  Uniprot ID: Q96EI5
  ENSP ID: ENSP00000421156

SEQ ID NO: 89592 - protein, 215 aa, Homo sapiens; identical to SEQ ID NO: 89590
  Payload ID: 17944
  Gene Name: transcription elongation factor A (SII)-like 4
  Uniprot ID: Q96EI5
  ENSP ID: ENSP00000421857

SEQ ID NO: 89593 - protein, 91 aa, Homo sapiens
  Payload ID: 17944
  Gene Name: transcription elongation factor A (SII)-like 4
  ENSP ID: ENSP00000423723
MEKLYSENEGMASNQGKMENEEQPQDERKPEVTCTLEDKKLENEGKTENKGKTGDEEMLKDKGKPESEGEAKEGKSEREGESEMEGGSERE

SEQ ID NO: 89594 - protein, 215 aa, Homo sapiens; identical to SEQ ID NO: 89590
  Payload ID: 17944
  Gene Name: transcription elongation factor A (SII)-like 4
  Uniprot ID: Q96EI5
  ENSP ID: ENSP00000424314

SEQ ID NO: 89595 - protein, 76 aa, Homo sapiens
  Payload ID: 17944
  Gene Name: transcription elongation factor A (SII)-like 4
  ENSP ID: ENSP00000425883
MEKLYSENEGMASNQGKMENEEQPQDERKPEVTCTLEDKKLENEGKTENKGKTGDEEMLKDKGKPESEGEAKEGKS

SEQ ID NO: 89596 - protein, 129 aa, Homo sapiens
  Payload ID: 17944
  Gene Name: transcription elongation factor A (SII)-like 4
  ENSP ID: ENSP00000427053
MEKLYSENEGMASNQGKMENEEQPQDERKPEVTCTLEDKKLENEGKTENKGKTGDEEMLKDKGKPESEGEAKEGKSEREGESEMEGGSEREGKPEIEGKPESEGEPGSETRAAGKRPAEDDVPRKAKRK

SEQ ID NO: 89597 - protein, 215 aa, Homo sapiens; identical to SEQ ID NO: 89590
  Payload ID: 17944
  Gene Name: transcription elongation factor A (SII)-like 4
  Uniprot ID: Q96EI5
  ENSP ID: ENSP00000427494

SEQ ID NO: 89598 - protein, 186 aa, Homo sapiens
  Payload ID: 17944
  Gene Name: transcription elongation factor A (SII)-like 4
  ENSP ID: ENSP00000480202
MEKLYSENEGMASNQGKMENEEQPQDERKPEVTCTLEDKKLENEGKTENKGKTGDEEMLKDKGKPEIEGKPESEGEPGSETRAAGKRPAEDDVPRKAKRKTNKGLAHYLKEYKEAIHDMNFSNEDMIREFDNMAKVQDEKRKSKQKLGAFLWMQRNLQDPFYPRGPREFRGGCRAPRRDIEDIPYV

SEQ ID NO: 89599 - protein, 206 aa, Homo sapiens
  Payload ID: 17945
  Gene Name: transcription elongation factor A (SII)-like 5
  Uniprot ID: Q5H9L2
  ENSP ID: ENSP00000361765
MEKLYKENEGKPENERNLESEGKPEDEGSTEDEGKSDEEEKPDMEGKTECEGKREDEGEPGDEGQLEDEGNQEKQGKSEGEDKPQSEGKPASQAKPESQPRAAEKRPAEDYVPRKAKRKTDRGTDDSPKDSQEDLQERHLSSEEMMRECGDVSRAQEELRKKQKMGGFHWMQRDVQDPFAPRGQRGVRGVRGGGRGQKDLEDVPYV

SEQ ID NO: 89600 - protein, 183 aa, Homo sapiens
  Payload ID: 17946
  Gene Name: transcription elongation factor A (SII)-like 6
  Uniprot ID: Q6IPX3
  ENSP ID: ENSP00000361859
MEKPYNKNEGNLENEGKPEDEVEPDDEGKSDEEEKPDAEGKTECEGKRKAEGEPGDEGQLEDKGSQEKQGKSEGEGKPQGEGKPASQAKPEGQPRAAEKRPAGDYVPRKAKRKTDRGTDDSPKDSQEDLQERHLSSEEMMRECGDVSRAQEELRKKQKMGGFHWMQRDVQDPFAQGDNGVSGE

SEQ ID NO: 89601 - protein, 183 aa, Homo sapiens; identical to SEQ ID NO: 89600
  Payload ID: 17946
  Gene Name: transcription elongation factor A (SII)-like 6
  Uniprot ID: Q6IPX3
  ENSP ID: ENSP00000361860

SEQ ID NO: 89602 - protein, 199 aa, Homo sapiens
  Payload ID: 17946
  Gene Name: transcription elongation factor A (SII)-like 6
  ENSP ID: ENSP00000482574
MEKPYNKNEGNLENEGKPEDEVEPDDEGKSDEEEKPDAEGKTECEGKRKAEGEPGDEGQLEDKGSQEKQGKSEGEGKPQGEGKPASQAKPEGQPRAAEKRPAGDYVPRKAKRKTDRGTDDSPKDSQEDLQERHLSSEEMMRECGDVSRAQEELRKKQKMGGFHWMQRDVQDPFAQGQRGVRGVRGGGRGQRGLHDIPYL

SEQ ID NO: 89603 - protein, 100 aa, Homo sapiens
  Payload ID: 17947
  Gene Name: transcription elongation factor A (SII)-like 7
  Uniprot ID: Q9BRU2
  ENSP ID: ENSP00000329794
MQKPCKENEGKPKCSVPKREEKRPYGEFERQQTEGNFRQRLLQSLEEFKEDIDYRHFKDEEMTREGDEMERCLEEIRGLRKKFRALHSNHRHSRDRPYPI

SEQ ID NO: 89604 - protein, 100 aa, Homo sapiens; identical to SEQ ID NO: 89603
  Payload ID: 17947
  Gene Name: transcription elongation factor A (SII)-like 7
  Uniprot ID: Q9BRU2
  ENSP ID: ENSP00000361751

SEQ ID NO: 89605 - protein, 117 aa, Homo sapiens
  Payload ID: 17948
  Gene Name: transcription elongation factor A (SII)-like 8
  Uniprot ID: Q8IYN2
  ENSP ID: ENSP00000353093
MQKSCEENEGKPQNMPKAEEDRPLEDVPQEAEGNPQPSEEGVSQEAEGNPRGGPNQPGQGFKEDTPVRHLDPEEMIRGVDELERLREEIRRVRNKFVMMHWKQRHSRSRPYPVCFRP

SEQ ID NO: 89606 - protein, 117 aa, Homo sapiens; identical to SEQ ID NO: 89605
  Payload ID: 17948
  Gene Name: transcription elongation factor A (SII)-like 8
  Uniprot ID: Q8IYN2
  ENSP ID: ENSP00000361770

SEQ ID NO: 89607 - protein, 74 aa, Homo sapiens
  Payload ID: 17948
  Gene Name: transcription elongation factor A (SII)-like 8
  ENSP ID: ENSP00000390880
MQKSCEENEGKPQNMPKAEEDRPLEDVPQEDTPVRHLDPEEMIRGVDELERLREEIRRVRNKFVMMHWKQRHSR

SEQ ID NO: 89608 - protein, 112 aa, Homo sapiens
  Payload ID: 17949
  Gene Name: transcription elongation factor B (SIII), polypeptide 1 (15kDa, elongin C)
  Uniprot ID: Q15369
  ENSP ID: ENSP00000284811
MDGEEKTYGGCEGPDAMYVKLISSDGHEFIVKREHALTSGTIKAMLSGPGQFAENETNEVNFREIPSHVLSKVCMYFTYKVRYTNSSTEIPEFPIAPEIALELLMAANFLDC

SEQ ID NO: 89609 - protein, 112 aa, Homo sapiens; identical to SEQ ID NO: 89608
  Payload ID: 17949
  Gene Name: transcription elongation factor B (SIII), polypeptide 1 (15kDa, elongin C)
  Uniprot ID: Q15369
  ENSP ID: ENSP00000428074

SEQ ID NO: 89610 - protein, 112 aa, Homo sapiens; identical to SEQ ID NO: 89608
  Payload ID: 17949
  Gene Name: transcription elongation factor B (SIII), polypeptide 1 (15kDa, elongin C)
  Uniprot ID: Q15369
  ENSP ID: ENSP00000428171

SEQ ID NO: 89611 - protein, 112 aa, Homo sapiens; identical to SEQ ID NO: 89608
  Payload ID: 17949
  Gene Name: transcription elongation factor B (SIII), polypeptide 1 (15kDa, elongin C)
  Uniprot ID: Q15369
  ENSP ID: ENSP00000428334

SEQ ID NO: 89612 - protein, 112 aa, Homo sapiens; identical to SEQ ID NO: 89608
  Payload ID: 17949
  Gene Name: transcription elongation factor B (SIII), polypeptide 1 (15kDa, elongin C)
  Uniprot ID: Q15369
  ENSP ID: ENSP00000429596

SEQ ID NO: 89613 - protein, 89 aa, Homo sapiens
  Payload ID: 17949
  Gene Name: transcription elongation factor B (SIII), polypeptide 1 (15kDa, elongin C)
  ENSP ID: ENSP00000429789
MDGEEKTYGGCEGPDAMYVKLISSDGHEFIVKREHALTSGTIKAMLSGPGQFAENETNEVNFREIPSHVLSKVCMYFTYKVRYTNSSTE

SEQ ID NO: 89614 - protein, 112 aa, Homo sapiens; identical to SEQ ID NO: 89608
  Payload ID: 17949
  Gene Name: transcription elongation factor B (SIII), polypeptide 1 (15kDa, elongin C)
  Uniprot ID: Q15369
  ENSP ID: ENSP00000429906

SEQ ID NO: 89615 - protein, 96 aa, Homo sapiens
  Payload ID: 17949
  Gene Name: transcription elongation factor B (SIII), polypeptide 1 (15kDa, elongin C)
  Uniprot ID: Q15369
  ENSP ID: ENSP00000430224
MYVKLISSDGHEFIVKREHALTSGTIKAMLSGPGQFAENETNEVNFREIPSHVLSKVCMYFTYKVRYTNSSTEIPEFPIAPEIALELLMAANFLDC

SEQ ID NO: 89616 - protein, 65 aa, Homo sapiens
  Payload ID: 17949
  Gene Name: transcription elongation factor B (SIII), polypeptide 1 (15kDa, elongin C)
  ENSP ID: ENSP00000473408
MDGEEKTYGGCEGPDAMYVKLISSDGHEFIVKREHALTSGTIKAMLSGPDMVSTMLPRLKCSGCS

SEQ ID NO: 89617 - protein, 112 aa, Homo sapiens; identical to SEQ ID NO: 89608
  Payload ID: 17949
  Gene Name: transcription elongation factor B (SIII), polypeptide 1 (15kDa, elongin C)
  Uniprot ID: Q15369
  ENSP ID: ENSP00000478121

SEQ ID NO: 89618 - protein, 161 aa, Homo sapiens
  Payload ID: 17950
  Gene Name: transcription elongation factor B (SIII), polypeptide 2 (18kDa, elongin B)
  Uniprot ID: Q15370
  ENSP ID: ENSP00000262306
MDVFLMIRRHKTTIFTDAKESSTVFELKRIVEGILKRPPDEQRLYKDDQLLDDGKTLGECGFTSQTARPQAPATVGLAFRADDTFEALCIEPFSSPPELPDVMKPQDSGSSANEQAVHLHVHSQTMAKSRNTSWSQCPGLTACSTREPQDGPTQVHPRWGL

SEQ ID NO: 89619 - protein, 118 aa, Homo sapiens
  Payload ID: 17950
  Gene Name: transcription elongation factor B (SIII), polypeptide 2 (18kDa, elongin B)
  Uniprot ID: Q15370
  ENSP ID: ENSP00000386652
MDVFLMIRRHKTTIFTDAKESSTVFELKRIVEGILKRPPDEQRLYKDDQLLDDGKTLGECGFTSQTARPQAPATVGLAFRADDTFEALCIEPFSSPPELPDVMKPQDSGSSANEQAVQ

SEQ ID NO: 89620 - protein, 113 aa, Homo sapiens
  Payload ID: 17950
  Gene Name: transcription elongation factor B (SIII), polypeptide 2 (18kDa, elongin B)
  ENSP ID: ENSP00000387189
MIRRHKTTIFTDAKESSTVFELKRIVEGILKRPPDEQRLYKDDQLLDDGKTLGECGFTSQTARPQAPATVGLAFRADDTFEALCIEPFSSPPELPDVMKPQDSGSSANEQAVQ

SEQ ID NO: 89621 - protein, 140 aa, Homo sapiens
  Payload ID: 17950
  Gene Name: transcription elongation factor B (SIII), polypeptide 2 (18kDa, elongin B)
  ENSP ID: ENSP00000458213
DVFLMIRRHKTTIFTDAKESSTVFELKRIVEGILKRPPDEQRLYKLLVRSLWDLPHVGPLPRSCFSPQDDQLLDDGKTLGECGFTSQTARPQAPATVGLAFRADDTFEALCIEPFSSPPELPDVMKPQDSGSSANEQAVQ

SEQ ID NO: 89622 - protein, 66 aa, Homo sapiens
  Payload ID: 17950
  Gene Name: transcription elongation factor B (SIII), polypeptide 2 (18kDa, elongin B)
  ENSP ID: ENSP00000458443
MDVFLMIRRHKTTIFTDAKESSTVFELKRIVEGILKRPPDEQRLYKMTPLRPCASSRFPARQSCPM

SEQ ID NO: 89623 - protein, 798 aa, Homo sapiens
  Payload ID: 17951
  Gene Name: transcription elongation factor B (SIII), polypeptide 3 (110kDa, elongin A)
  Uniprot ID: Q14241
  ENSP ID: ENSP00000395574
MHGGRSCGPRTRREPSSGEEAAPVTAMAAESALQVVEKLQARLAANPDPKKLLKYLKKLSTLPITVDILAETGVGKTVNSLRKHEHVGSFARDLVAQWKKLVPVERNAEPDEQDFEKSNSRKRPRDALQKEEEMEGDYQETWKATGSRSYSPDHRQKKHRKLSELERPHKVSHGHERRDERKRCHRMSPTYSSDPESSDYGHVQSPPSCTSPHQMYVDHYRSLEEDQEPIVSHQKPGKGHSNAFQDRLGASQERHLGEPHGKGVVSQNKEHKSSHKDKRPVDAKSDEKASVVSREKSHKALSKEENRRPPSGDNAREKPPSSGVKKEKDREGSSLKKKCLPPSEAASDNHLKKPKHRDPEKAKLDKSKQGLDSFDTGKGAGDLLPKVKEKGSNNLKTPEGKVKTNLDRKSLGSLPKVEETDMEDEFEQPTMSFESYLSYDQPRKKKKKIVKTSATALGDKGLKKNDSKSTGKNLDSVQKLPKVNKTKSEKPAGADLAKLRKVPDVLPVLPDLPLPAIQANYRPLPSLELISSFQPKRKAFSSPQEEEEAGFTGRRMNSKMQVYSGSKCAYLPKMMTLHQQCIRVLKNNIDSIFEVGGVPYSVLEPVLERCTPDQLYRIEEYNHVLIEETDQLWKVHCHRDFKEERPEEYESWREMYLRLQDAREQRLRVLTKNIQFAHANKPKGRQAKMAFVNSVAKPPRDVRRRQEKFGTGGAAVPEKIKIKPAPYPMGSSHASASSISFNPSPEEPAYDGPSTSSAHLAPVVSSTVSYDPRKPTVKKIAPMMAKTIKAFKNRFSRR

SEQ ID NO: 89624 - protein, 772 aa, Homo sapiens
  Payload ID: 17951
  Gene Name: transcription elongation factor B (SIII), polypeptide 3 (110kDa, elongin A)
  ENSP ID: ENSP00000476781
MAAESALQVVEKLQARLAANPDPKKLLKYLKKLSTLPITVDILAETGVGKTVNSLRKHEHVGSFARDLVAQWKKLVPVERNAEPDEQDFEKSNSRKRPRDALQKEEEMEGDYQETWKATGSRSYSPDHRQKKHRKLSELERPHKVSHGHERRDERKRCHRMSPTYSSDPESSDYGHVQSPPSCTSPHQMYVDHYRSLEEDQEPIVSHQKPGKGHSNAFQDRLGASQERHLGEPHGKGVVSQNKEHKSSHKDKRPVDAKSDEKASVVSREKSHKALSKEENRRPPSGDNAREKPPSSGVKKEKDREGSSLKKKCLPPSEAASDNHLKKPKHRDPEKAKLDKSKQGLDSFDTGKGAGDLLPKVKEKGSNNLKTPEGKVKTNLDRKSLGSLPKVEETDMEDEFEQPTMSFESYLSYDQPRKKKKKIVKTSATALGDKGLKKNDSKSTGKNLDSVQKLPKVNKTKSEKPAGADLAKLRKVPDVLPVLPDLPLPAIQANYRPLPSLELISSFQPKRKAFSSPQEEEEAGFTGRRMNSKMQVYSGSKCAYLPKMMTLHQQCIRVLKNNIDSIFEVGGVPYSVLEPVLERCTPDQLYRIEEYNHVLIEETDQLWKVHCHRDFKEERPEEYESWREMYLRLQDAREQRLRVLTKNIQFAHANKPKGRQAKMAFVNSVAKPPRDVRRRQEKFGTGGAAVPEKIKIKPAPYPMGSSHASASSISFNPSPEEPAYDGPSTSSAHLAPVVSSTVSYDPRKPTVKKIAPMMAKTIKAFKNRFSRR

SEQ ID NO: 89625 - protein, 798 aa, Homo sapiens; identical to SEQ ID NO: 89623
  Payload ID: 17951
  Gene Name: transcription elongation factor B (SIII), polypeptide 3 (110kDa, elongin A)
  Uniprot ID: Q14241
  ENSP ID: ENSP00000484196

SEQ ID NO: 89626 - protein, 753 aa, Homo sapiens
  Payload ID: 17952
  Gene Name: transcription elongation factor B polypeptide 3B (elongin A2)
  Uniprot ID: Q8IYF1
  ENSP ID: ENSP00000331302
MAAGSTTLHAVEKLQVRLATKTEPKKLEKYLQKLSALPMTADILAETGIRKTVKRLRKHQHVGDFARDLAARWKKLVLVDRNTRPGPQDPEESASRQRFGEALQDQEKAWGFPENATAPRSPSHSPEHRRTARRTPPGQQRPHPRSHSREPRAERKCPRIAPADSGRYRASPTRTAPLRMPEGPEPAAPGKQPGRGHTHAAQGGPLLCPGCQGQPQGKAVVSHSKGHKSSRQEKRPLCAQGDWHSPTLIREKSCGACLREETPRMPSWASARDRQPSDFKTDKEGGQAGSGQRVPALEEAPDSHQKRPQHSHSNKKRPSLDGRDPGNGTHGLSPEEKEQLSNDRETQEGKPPTAHLDRTSVSSLSEVEEVDMAEEFEQPTLSCEKYLTYDQLRKQKKKTGKSATTALGDKQRKANESKGTRESWDSAKKLPPVQESQSERLQAAGADSAGPKTVPSHVFSELWDLSEAWMQANYDPLSDSDSMTSQAKPEALSSPKFREEAAFPGRRVNAKMPVYSGSRPACQLQVPTLRQQCAQVLRNNPDALSDVGEVPYWVLEPVLEGWRPDQLYRRKKDNHALVRETDELRRNHCFQDFKEEKPQENKTWREQYLRLPDAPEQRLRVMTTNIRSARGNNPNGREAKMICFKSVAKTPYDTSRRQEKSAGDADPENGEIKPASKPAGSSHTPSSQSSSGGGRDSSSSILRWLPEKRANPCLSSSNEHAAPAAKTRKQAAKKVAPLMAKAIRDYKRRFSRR

SEQ ID NO: 89627 - protein, 546 aa, Homo sapiens
  Payload ID: 17952
  Gene Name: transcription elongation factor B polypeptide 3B (elongin A2)
  ENSP ID: ENSP00000479491
MAAGSTTLHAVEKLQVRLATKTEPKKLEKYLQKLSALPMTADILAETGIRKTVKRLRKHQHVGDFARDLAARWKKLVLVDRNTRPGPQDPEESASRQRFGEALQDQEKAWGFPENATAPRSPSHSPEHRRTARRTPPGQQRPHPRSHSREPRAERKCPRIAPADSGRYRASPTRTAPLRMPEGPEPAAPGKQPGRGHTHAAQGGPLLCPGCQGQPQGKAVVSHSKGHKSSRQDSAKKLPPVQESQSERLQAAGADSAGPKTVPSHVFSELWDLSEAWMQANYDPLSDSDSMTSQAKPEALSSPKFREEAAFPGRRVNAKMPVYSGSRPACQLQVPTLRQQCAQVLRNNPDALSDVGEVPYWVLEPVLEGWRPDQLYRRKKDNHALVRETDELRRNHCFQDFKEEKPQENKTWREQYLRLPDAPEQRLRVMTTNIRSARGNNPNGREAKMICFKSVAKTPYDTSRRQEKSAGDADPENGEIKPASKPAGSSHTPSSQSSSGGGRDSSSSSSNEHAAPAAKTRKQAAKKVAPLMAKAIRDYKRRFSRR

SEQ ID NO: 89628 - protein, 546 aa, Homo sapiens
  Payload ID: 17953
  Gene Name: transcription elongation factor B polypeptide 3C (elongin A3)
  Uniprot ID: Q8NG57
  ENSP ID: ENSP00000328232
MAAGSTTLRAVGKLQVRLATKTEPKKLEKYLQKLSALPMTADILAETGIRKTVKRLRKHQHVGDFARDLAARWKKLVLVDRNTGPDPQDPEESASRQRFGEALQEREKAWGFPENATAPRSPSHSPEHRRTARRTPPGQQRPHPRSPSREPRAERKRPRMAPADSGPHRDPPTRTAPLPMPEGPEPAVPGEQPGRGHAHAAQGGPLLGQGCQGQPQGEAVGSHSKGHKSSRGASAQKSPPVQESQSERLQAAGADSAGPKTVPSHVFSELWDPSEAWMQANYDLLSAFEAMTSQANPEALSAPALQEEAAFPGRRVNAKMPVYSGSRPACQLQVPTLRQQCLRVPRNNPDALGDVEGVPYSVLEPVLEGWTPDQLYRTEKDNAALARETDELWRIHCLQDFKEEKPQEHESWRELYLRLRDAREQRLRVVTTKIRSARENKPSGRQTKMICFNSVAKTPYDASRRQEKSAGAADPGNGEMEPAPKPAGSSQAPSGLGDGDGGSVSGGGSSNRHAAPADKTRKQAAKKVAPLMAKAIRDYKGRFSRR

SEQ ID NO: 89629 - protein, 546 aa, Homo sapiens
  Payload ID: 17954
  Gene Name: transcription elongation factor B polypeptide 3C-like
  Uniprot ID: Q3SY89
  ENSP ID: ENSP00000479206
MAAGSTTLRAVGKLQVRLATKTEPKKLEKYLQKLSALPMTADILAETGIRKTVKRLRKHQHVGDFARDLAARWKKLVLVDRNTGPDPQDPEESASRQRFGEALQEREKAWGFPENATAPRSPSHSPEHRRTARRTPPGQQRPHPRSPSREPRAERKRPRMAPADSGPHRDPPTRTAPLPMPEGPEPAVPGEQPGRGHAHAAQGGPLLGQGCQGQPQGEAVGSHSKGHKSSRGASAQKSPPVQESQSERLQAAGADSAGPKTVPSHVFSELWDPSEAWMQANYDLLSAFEAMTSQANPEALSAPTLQEEAAFPGRRVNAKMPVYSGSRPACQLQVPTLRQQCLRVPRNNPDALGDVEGVPYSVLEPVLEGWTPDQPYRTEKDNAALARETDELWRIHCLQDFKEEKPQEHESWRELYLRLRDAREQRLRVVTTKIRSARENKPSGRQTKMICFNSVAKTPYDASRRQEKSAGAADPGNGEMEPAPKPAGSSQAPSGLGDGDGGSVSGGGSSNRHAAPADKTRKQAAKKVAPLMAKAIRDYKGRFSRR

SEQ ID NO: 89630 - protein, 405 aa, Homo sapiens
  Payload ID: 17954
  Gene Name: transcription elongation factor B polypeptide 3C-like
  ENSP ID: ENSP00000480799
PHPRSPSREPRAERKRPRMAPADSGPHRDPPTRTAPLPMPEGPEPAVPGEQPGRGHAHAAQGGPLLGQGCQGQPQGEAVGSHSKGHKSSRGASAQKSPPVQESQSERLQAAGADSAGPKTVPSHVFSELWDPSEAWMQANYDLLSAFEAMTSQANPEALSAPTLQEEAAFPGRRVNAKMPVYSGSRPACQLQVPTLRQQCLRVPRNNPDALGDVEGVPYSVLEPVLEGWTPDQPYRTEKDNAALARETDELWRIHCLQDFKEEKPQEHESWRELYLRLRDAREQRLRVVTTKIRSARENKPSGRQTKMICFNSVAKTPYDASRRQEKSAGAADPGNGEMEPAPKPAGSSQAPSGLGDGDGGSVSGGGSSNRHAAPADKTRKQAAKKVAPLMAKAIRDYKGRFSRR

SEQ ID NO: 89631 - protein, 546 aa, Homo sapiens
  Payload ID: 17955
  Gene Name: transcription elongation factor B polypeptide 3C-like 2
  Uniprot ID: A6NLF2
  ENSP ID: ENSP00000483981
MAAGSTTLRAVGKLQVRLATKTEPKKLEKYLQKLSALPMTADILAETGIRKTVKRLRKHQHVGDFARDLAARWKKLVLVDRNTGPDPQDPEESASRQRFGEALQEREKAWGFPENATAPRSPSHSPEHRRTARRTPPGQQRPHPRSPSREPRAERKRPRMAPADSGPHRDPPTRTAPLPMPEGPEPAVPGEQPGRGHAHAAQGGPLLGQGCQGQPQGEAVGSHSKGHKSSRGASAQKSPPVQESQSERLQAAVADSAGPKTVPSHVFSELWDPSEAWMQANYDLLSAFEAMTSQANPEALSAPTLQEEAAFPGRRVNAKMPVYSGSRPACQLQVPTLRQQCLRVPRNNPDALGDVEGVPYSALEPVLEGWTPDQPYRTEKDNAALARETDELWRIHCLQDFKEEKPQEHESWRELYLRLRDAREQRLRVVTTKIRSARENKPSGRQTKMICFNSVAKTPYDASRRQEKSAGAADPGNGEMEPAPKPAGSSQAPSGLGDGDGGSVSGGGSSNRHAAPADKTRKQAAKKVAPLMAKAIRDYKGRFSRR

SEQ ID NO: 89632 - protein, 171 aa, Homo sapiens
  Payload ID: 17956
  Gene Name: transcription elongation factor, mitochondrial
  Uniprot ID: Q96QE5
  ENSP ID: ENSP00000306574
MSGSVLFTAGERWRCFLTPSRSSLYWALHNFCCRKKSTTPKKITPNVTFCDENAKEPENALDKLFSSEQQASILHVLNTASTKELEAFRLLRGRRSINIVEHRENFGPFQNLESLMNVPLFKYKSTVQVCNSILCPKTGREKRKSPENRFLRKLLKPDIERERLKNCLGSP

SEQ ID NO: 89633 - protein, 360 aa, Homo sapiens
  Payload ID: 17956
  Gene Name: transcription elongation factor, mitochondrial
  Uniprot ID: Q96QE5
  ENSP ID: ENSP00000462963
MSGSVLFTAGERWRCFLTPSRSSLYWALHNFCCRKKSTTPKKITPNVTFCDENAKEPENALDKLFSSEQQASILHVLNTASTKELEAFRLLRGRRSINIVEHRENFGPFQNLESLMNVPLFKYKSTVQVCNSILCPKTGREKRKSPENRFLRKLLKPDIERERLKAVNSIISIVFGTRRIAWAHLDRKLTVLDWQQSDRWSLMRGIYSSSVYLEEISSIISKMPKADFYVLEKTGLSIQNSSLFPILLHFHIMEAMLYALLNKTFAQDGQHQVLSMNRNAVGKHFELMIGDSRTSGKELVKQFLFDSILKADPRVFFPSDKIVHYRQMFLSTELQRVEELYDSLLQAIAFYELAVFDSQP

SEQ ID NO: 89634 - protein, 226 aa, Homo sapiens
  Payload ID: 17956
  Gene Name: transcription elongation factor, mitochondrial
  ENSP ID: ENSP00000462973
MSGSVLFTAGERWRCFLTPSRSSLYWALHNFCCRKKSTTPKKITPNVTFCDENAKEPENALDKLFSSEQQASILHVLNTASTKELEAFRLLRGRRSINIVEHRENFGPFQNLESLMNVPLFKYKSTVQVCNSILCPKTGREKRKSPENRFLRKLLKPDIERERLKAVNSIISIVFGTRRIAWAHLDRKLTVLDWQQSDRWSLMRGIYSSSVYLEEVRQLHLQIPTC

SEQ ID NO: 89635 - protein, 1098 aa, Homo sapiens
  Payload ID: 17957
  Gene Name: transcription elongation regulator 1
  Uniprot ID: O14776
  ENSP ID: ENSP00000296702
MAERGGDGGESERFNPGELRMAQQQALRFRGPAPPPNAVMRGPPPLMRPPPPFGMMRGPPPPPRPPFGRPPFDPNMPPMPPPGGIPPPMGPPHLQRPPFMPPPMSSMPPPPGMMFPPGMPPVTAPGTPALPPTEEIWVENKTPDGKVYYYNARTRESAWTKPDGVKVIQQSELTPMLAAQAQVQAQAQAQAQAQAQAQAQAQAQAQAQAQAQAQAQAQAQAQAQAQAQAQAQAQAQAQAQAQVQAQVQAQVQAQAVGASTPTTSSPAPAVSTSTSSSTPSSTTSTTTTATSVAQTVSTPTTQDQTPSSAVSVATPTVSVSTPAPTATPVQTVPQPHPQTLPPAVPHSVPQPTTAIPAFPPVMVPPFRVPLPGMPIPLPGVAMMQIVSCPYVKTVATTKTGVLPGMAPPIVPMIHPQVAIAASPATLAGATAVSEWTEYKTADGKTYYYNNRTLESTWEKPQELKEKEKLEEKIKEPIKEPSEEPLPMETEEEDPKEEPIKEIKEEPKEEEMTEEEKAAQKAKPVATAPIPGTPWCVVWTGDERVFFYNPTTRLSMWDRPDDLIGRADVDKIIQEPPHKKGMEELKKLRHPTPTMLSIQKWQFSMSAIKEEQELMEEINEDEPVKAKKRKRDDNKDIDSEKEAAMEAEIKAARERAIVPLEARMKQFKDMLLERGVSAFSTWEKELHKIVFDPRYLLLNPKERKQVFDQYVKTRAEEERREKKNKIMQAKEDFKKMMEEAKFNPRATFSEFAAKHAKDSRFKAIEKMKDREALFNEFVAAARKKEKEDSKTRGEKIKSDFFELLSNHHLDSQSRWSKVKDKVESDPRYKAVDSSSMREDLFKQYIEKIAKNLDSEKEKELERQARIEASLREREREVQKARSEQTKEIDREREQHKREEAIQNFKALLSDMVRSSDVSWSDTRRTLRKDHRWESGSLLEREEKEKLFNEHIEALTKKKREHFRQLLDETSAITLTSTWKEVKKIIKEDPRCIKFSSSDRKKQREFEEYIRDKYITAKADFRTLLKETKFITYRSKKLIQESDQHLKDVEKILQNDKRYLVLDCVPEERRKLIVAYVDDLDRRGPPPPPTASEPTRRSTK

SEQ ID NO: 89636 - protein, 1077 aa, Homo sapiens
  Payload ID: 17957
  Gene Name: transcription elongation regulator 1
  Uniprot ID: O14776
  ENSP ID: ENSP00000377943
MAERGGDGGESERFNPGELRMAQQQALRFRGPAPPPNAVMRGPPPLMRPPPPFGMMRGPPPPPRPPFGRPPFDPNMPPMPPPGGIPPPMGPPHLQRPPFMPPPMSSMPPPPGMMFPPGMPPVTAPGTPALPPTEEIWVENKTPDGKVYYYNARTRESAWTKPDGVKVIQQSELTPMLAAQAQVQAQAQAQAQAQAQAQAQAQAQAQAQAQAQAQAQAQAQAQAQAQAQAQAQAQAQAQAQAQVQAQVQAQVQAQAVGASTPTTSSPAPAVSTSTSSSTPSSTTSTTTTATSVAQTVSTPTTQDQTPSSAVSVATPTVSVSTPAPTATPVQTVPQPHPQTLPPAVPHSVPQPTTAIPAFPPVMVPPFRVPLPGMPIPLPGVLPGMAPPIVPMIHPQVAIAASPATLAGATAVSEWTEYKTADGKTYYYNNRTLESTWEKPQELKEKEKLEEKIKEPIKEPSEEPLPMETEEEDPKEEPIKEIKEEPKEEEMTEEEKAAQKAKPVATAPIPGTPWCVVWTGDERVFFYNPTTRLSMWDRPDDLIGRADVDKIIQEPPHKKGMEELKKLRHPTPTMLSIQKWQFSMSAIKEEQELMEEINEDEPVKAKKRKRDDNKDIDSEKEAAMEAEIKAARERAIVPLEARMKQFKDMLLERGVSAFSTWEKELHKIVFDPRYLLLNPKERKQVFDQYVKTRAEEERREKKNKIMQAKEDFKKMMEEAKFNPRATFSEFAAKHAKDSRFKAIEKMKDREALFNEFVAAARKKEKEDSKTRGEKIKSDFFELLSNHHLDSQSRWSKVKDKVESDPRYKAVDSSSMREDLFKQYIEKIAKNLDSEKEKELERQARIEASLREREREVQKARSEQTKEIDREREQHKREEAIQNFKALLSDMVRSSDVSWSDTRRTLRKDHRWESGSLLEREEKEKLFNEHIEALTKKKREHFRQLLDETSAITLTSTWKEVKKIIKEDPRCIKFSSSDRKKQREFEEYIRDKYITAKADFRTLLKETKFITYRSKKLIQESDQHLKDVEKILQNDKRYLVLDCVPEERRKLIVAYVDDLDRRGPPPPPTASEPTRRSTK

SEQ ID NO: 89637 - protein, 1032 aa, Homo sapiens
  Payload ID: 17957
  Gene Name: transcription elongation regulator 1
  ENSP ID: ENSP00000450414
MAERGGDGGESERFNPGELRMAQQQALRFRGPAPPPNAVMRGPPPLMRPPPPFGMMRGPPPPPRPPFGRPPFDPNMPPMPPPGGIPPPMGPPHLQRPPFMPPPMSSMPPPPGMMFPPGMPPVTAPGTPALPPTEEIWVENKTPDGKVYYYNARTRESAWTKPDGVKVIQQSELTPMLAAQAQVQAQAQAQAQAQAQAQAQAQAQAQAQAQAQAQAQAQAQAQAQAQAQAQAQAQAQAQAQAQVQAQVQAQVQAQAVGASTPTTSSPAPAVSTSTSSSTPSSTTSTTTTATSVAQTVSTPTTQDQTPSSAVSVATPTVSVSTPAPTATPVQTVPQPHPQTLPPAVPHSVPQPTTAIPAFPPVMVPPFRVPLPGMPIPLPGVAMMQIVSCPYVKTVATTKTGVLPGMAPPIVPMIHPQVAIAASPATLAGATAVSEWTEYKTADGKTYYYNNRTLESTWEKPQELKEKEKLEEKIKEPIKEPSEEPLPMETEEEDPKEEPIKEIKEEPKEEEMTEEEKAAQKAKPVATAPIPGTPWCVVWTGDERVFFYNPTTRLSMWDRPDDLIGRADVDKIIQEPPHKKGMEELKKLRHPTPTMLSIQKWQFSMSAIKEEQELMEEINEDEPVKAKKRKRDDNKDIDSEKEAAMEAEIKAARERAIVPLEARMKQFKDMLLERGVSAFSTWEKELHKIVFDPRYLLLNPKERKQVFDQYVKTRAEEERREKKNKIMQAKEDFKKMMEEAKFNPRATFSEFAAKHAKDSRFKAIEKMKDREALFNEFVAAARKKEKEDSKTRGEKIKSDFFELLSNHHLDSQSRWSKVKDKVESDPRYKAVDSSSMREDLFKQYIEKIAKNLDSEKEKELERQARIEASLREREREVQKARSEQTKEIDREREQHKREEAIQNFKALLSDMVRSSDVSWSDTRRTLRKDHRWESGSLLEREEKEKLFNEHIEALTKKKREHFRQLLDETSAITLTSTWKEVKKIIKEDPRCIKFSSSDRKKQREFEEYIRDKYITAKADFRTLLKETKFITYS

SEQ ID NO: 89638 - protein, 586 aa, Homo sapiens
  Payload ID: 17958
  Gene Name: transcription elongation regulator 1-like
  Uniprot ID: Q5VWI1
  ENSP ID: ENSP00000357631
MQAGARFQRRRRQLQQQQPRRRQPLLWPMDAEPPPPPPWVWMVPGSAGLLRLSAGVVVPPVLLASAPPPAAPLLPGLPGWPAPSEPVLPLLPLPSAPDSAAAAAAHPFPALHGQWLFGGHSPSLGLPPSSTVELVPVFPHLCPSALATPIGKSWIDKRIPNCKIFFNNSFALDSTWIHPEESRFFHGHEKPRLLANQVAVSLSRPAPASRPLPTVVLAPQPIPGGCHNSLKVTSSPAIAIATAAAAAMVSVDPENLRGPSPSSVQPRHFLTLAPIKIPLRTSPVSDTRTERGRVARPPALMLRAQKSRDGDKEDKEPPPMLGGGEDSTARGNRPVASTPVPGSPWCVVWTGDDRVFFFNPTMHLSVWEKPMDLKDRGDLNRIIEDPPHKRKLEAPATDNSDGSSSEDNREDQDVKTKRNRTEGCGSPKPEEAKREDKGTRTPPPQILLPLEERVTHFRDMLLERGVSAFSTWEKELHKIVFDPRYLLLNSEERKQIFEQFVKTRIKEEYKEKKSKLLLAKEEFKKLLEESKVSPRTTFKEFAEKYGRDQRFRLVQKRKDQEHFFNQFILILKKRDKENRLRLRKMR

SEQ ID NO: 89639 - protein, 682 aa, Homo sapiens
  Payload ID: 17959
  Gene Name: transcription factor 12
  Uniprot ID: Q99081
  ENSP ID: ENSP00000267811
MNPQQQRMAAIGTDKELSDLLDFSAMFSPPVNSGKTRPTTLGSSQFSGSGIDERGGTTSWGTSGQPSPSYDSSRGFTDSPHYSDHLNDSRLGAHEGLSPTPFMNSNLMGKTSERGSFSLYSRDTGLPGCQSSLLRQDLGLGSPAQLSSSGKPGTAYYSFSATSSRRRPLHDSAALDPLQAKKVRKVPPGLPSSVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 89640 - protein, 706 aa, Homo sapiens
  Payload ID: 17959
  Gene Name: transcription factor 12
  Uniprot ID: Q99081
  ENSP ID: ENSP00000331057
MNPQQQRMAAIGTDKELSDLLDFSAMFSPPVNSGKTRPTTLGSSQFSGSGIDERGGTTSWGTSGQPSPSYDSSRGFTDSPHYSDHLNDSRLGAHEGLSPTPFMNSNLMGKTSERGSFSLYSRDTGLPGCQSSLLRQDLGLGSPAQLSSSGKPGTAYYSFSATSSRRRPLHDSAALDPLQAKKVRKVPPGLPSSVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLKNRVEQQLHEHLQDAMSFLKDVCEQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 89641 - protein, 512 aa, Homo sapiens
  Payload ID: 17959
  Gene Name: transcription factor 12
  Uniprot ID: Q99081
  ENSP ID: ENSP00000342459
MYCAYPVPGMGSNSLMYYYNGKTVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 89642 - protein, 706 aa, Homo sapiens; identical to SEQ ID NO: 89640
  Payload ID: 17959
  Gene Name: transcription factor 12
  Uniprot ID: Q99081
  ENSP ID: ENSP00000388940

SEQ ID NO: 89643 - protein, 536 aa, Homo sapiens
  Payload ID: 17959
  Gene Name: transcription factor 12
  ENSP ID: ENSP00000440017
MYCAYPVPGMGSNSLMYYYNGKTVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLKNRVEQQLHEHLQDAMSFLKDVCEQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 89644 - protein, 446 aa, Homo sapiens
  Payload ID: 17959
  Gene Name: transcription factor 12
  Uniprot ID: Q99081
  ENSP ID: ENSP00000444696
MGKRYMHHPQIQMISTVNLLVIHLLSHQPVCSLALSLCKSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 89645 - protein, 316 aa, Homo sapiens
  Payload ID: 17959
  Gene Name: transcription factor 12
  ENSP ID: ENSP00000453264
MSSNSSTSQWPRPGGQAPSSPSYENSLHSLQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 89646 - protein, 58 aa, Homo sapiens
  Payload ID: 17959
  Gene Name: transcription factor 12
  ENSP ID: ENSP00000453653
MNPQQQRMAAIGTDKELSDLLDFSAMFSPPVNSGKTRPTTLGSSQFSGSGFYRQPSLQ

SEQ ID NO: 89647 - protein, 682 aa, Homo sapiens; identical to SEQ ID NO: 89639
  Payload ID: 17959
  Gene Name: transcription factor 12
  Uniprot ID: Q99081
  ENSP ID: ENSP00000453737

SEQ ID NO: 89648 - protein, 666 aa, Homo sapiens
  Payload ID: 17959
  Gene Name: transcription factor 12
  ENSP ID: ENSP00000453876
MNPQQQRMAAIGTDKELSDLLDFSAMFSPPVNSGKTRPTTLGSSQFSGSGTIHEMKQLNSKARQKGQRIKGFTDSPHYSDHLNDSRLGAHEGLSPTPFMNSNLMGKTSERGSFSLYSRDTGLPGCQSSLLRQDLGLGSPAQLSSSGKPGTAYYSFSATSSRRRPLHDSAALDPLQAKKVRKVPPGLPSSVYAPSPNSDDFNRESPSYPSPKPPTSMFASTFFMQDGTHNSSDLWSSSNGMSQPGFGGILGTSTSHMSQSSSYGNLHSHDRLSYPPHSVSPTDINTSLPPMSSFHRGSTSSSPYVAASHTPPINGSDSILGTRGNAAGSSQTGDALGKALASIYSPDHTSSSFPSNPSTPVGSPSPLTGTSQWPRPGGQAPSSPSYENSLHSLKNRVEQQLHEHLQDAMSFLKDVCEQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSSTNEDEDLNPEQKIEREKERRMANNARERLRVRDINEAFKELGRMCQLHLKSEKPQTKLLILHQAVAVILSLEQQVRERNLNPKAACL

SEQ ID NO: 89649 - protein, 339 aa, Homo sapiens
  Payload ID: 17959
  Gene Name: transcription factor 12
  ENSP ID: ENSP00000454102
MSSNSSTSQWPRPGGQAPSSPSYENSLHSLKNRVEQQLHEHLQDAMSFLKDVCEQSRMEDRLDRLDDAIHVLRNHAVGPSTSLPAGHSDIHSLLGPSHNAPIGSLNSNYGGSSLVASSRSASMVGTHREDSVSLNGNHSVLSSTVTTSSTDLNHKTQENYRGGLQSQSGTVVTTEIKTENKEKDENLHEPPSSDDMKSDDESSQKDIKVSSRGRTSTNEDEDLNPEQKIEREKERRMANNARERLRVRDINEAFKELGRMCQLHLKSEKPQTKLLILHQAVAVILSLEQQVRERNLNPKAACLKRREEEKVSAVSAEPPTTLPGTHPGLSETTNPMGHM

SEQ ID NO: 89650 - protein, 157 aa, Homo sapiens
  Payload ID: 17959
  Gene Name: transcription factor 12
  ENSP ID: ENSP00000454109
MNPQQQRMAAIGTDKELSDLLDFSAMFSPPVNSGKTRPTTLGSSQFSGSGIDERGGTTSWGTSGQPSPSYDSSRGFTDSPHYSDHLNDSRLGAHEGLSPTPFMNSNLMGKTSERGSFSLYSRDTGLPGCQSSLLRQDLGLGSPAQLSSSGKPGTAYY

SEQ ID NO: 89651 - protein, 48 aa, Homo sapiens
  Payload ID: 17959
  Gene Name: transcription factor 12
  ENSP ID: ENSP00000454823
  MOD_RES (1)..(1): Any amino acid
XERNLNPKAACLKRREEEKVSAVSAEPPTTLPGTHPGLSETTNPMGHM

SEQ ID NO: 89652 - protein, 44 aa, Homo sapiens
  Payload ID: 17959
  Gene Name: transcription factor 12
  ENSP ID: ENSP00000456280
  MOD_RES (1)..(1): Any amino acid
XNPKAACLKRREEEKVSAVSAEPPTTLPGTHPGLSETTNPMGHM

SEQ ID NO: 89653 - protein, 199 aa, Homo sapiens
  Payload ID: 17960
  Gene Name: transcription factor 15 (basic helix-loop-helix)
  Uniprot ID: Q12870
  ENSP ID: ENSP00000246080
MAFALLRPVGAHVLYPDVRLLSEDEENRSESDASDQSFGCCEGPEAARRGPGPGGGRRAGGGGGAGPVVVVRQRQAANARERDRTQSVNTAFTALRTLIPTEPVDRKLSKIETVRLASSYIAHLANVLLLGDSADDGQPCFRAAGSAKGAVPAAADGGRQPRSICTFCLSNQRKGGGRRDLGGSCLKVRGVAPLRGPRR

SEQ ID NO: 89654 - protein, 198 aa, Homo sapiens
  Payload ID: 17960
  Gene Name: transcription factor 15 (basic helix-loop-helix)
  ENSP ID: ENSP00000483116
MAFALLRPVGAHVLYPDVRLLSEDEENRSESDASDQSFGCCEGPEAARRGPGPGGGRRAGGGGGAGPVVVVRQRQAANARERDRTQSVNTAFTALRTLIPTEPVDRKLSKIETVRLASSYIAHLANVLLLGDSADDGQPCFRAAGSAKGAVPAAPTGRQPRSICTFCLSNQRKGGGRRDLGGSCLKVRGVAPLRGPRR

SEQ ID NO: 89655 - protein, 345 aa, Homo sapiens
  Payload ID: 17961
  Gene Name: transcription factor 19
  Uniprot ID: Q9Y242
  ENSP ID: ENSP00000365431
MLPCFQLLRIGGGRGGDLYTFHPPAGAGCTYRLGHRADLCDVALRPQQEPGLISGIHAELHAEPRGDDWRVSLEDHSSQGTLVNNVRLPRGHRLELSDGDLLTFGPEGPPGTSPSEFYFMFQQVRVKPQDFAAITIPRSRGEARVGAGFRPMLPSQGAPQRPLSTFSPAPKATLILNSIGSLSKLRPQPLTFSPSWGGPKSLPVPAPPGEMGTTPSAPPQRNRRKSVHRVLAELDDESEPPENPPPVLMEPRKKLRVDKAPLTPTGNRRGRPRKYPVSAPMAPPAVGGGEPCAAPCCCLPQEETVAWVQCDGCDVWFHVACVGCSIQAAREADFRCPGCRAGIQT

SEQ ID NO: 89656 - protein, 345 aa, Homo sapiens; identical to SEQ ID NO: 89655
  Payload ID: 17961
  Gene Name: transcription factor 19
  Uniprot ID: Q9Y242
  ENSP ID: ENSP00000365433

SEQ ID NO: 89657 - protein, 345 aa, Homo sapiens
  Payload ID: 17961
  Gene Name: transcription factor 19
  ENSP ID: ENSP00000373018
MLPCFQLLRIGGGRGGDLYTFHPPAGAGCTYRLGHRADLCDVALRPQQEPGLISGIHAELHAEPRGDDWRVSLEDHSSQGTLVNNVRLPRGHRLELSDGDLLTFGPEGPPGTSPSEFYFMFQQVRVKPQDFAAITIPRSRGEARVGAGFRPMLPSQGAPQRPLSTFSPAPKATLILNSIGSLSKLRPQPLTFSPSWGGPKSLPVPAPPGEVGTTPSAPPQRNRRKSVHRVLAELDDESEPPENPPPVLMEPRKKLRVDKAPLTPTGNRRGRPRKYPVSAPMAPPAVGGGEPCAAPCCCLPQEETVAWVQCDGCDVWFHVACVGCSIQAAREADFRCPGCRAGIQT

SEQ ID NO: 89658 - protein, 345 aa, Homo sapiens; identical to SEQ ID NO: 89657
  Payload ID: 17961
  Gene Name: transcription factor 19
  ENSP ID: ENSP00000383252

SEQ ID NO: 89659 - protein, 345 aa, Homo sapiens; identical to SEQ ID NO: 89657
  Payload ID: 17961
  Gene Name: transcription factor 19
  ENSP ID: ENSP00000393007

SEQ ID NO: 89660 - protein, 345 aa, Homo sapiens; identical to SEQ ID NO: 89657
  Payload ID: 17961
  Gene Name: transcription factor 19
  ENSP ID: ENSP00000393300

SEQ ID NO: 89661 - protein, 345 aa, Homo sapiens
  Payload ID: 17961
  Gene Name: transcription factor 19
  ENSP ID: ENSP00000393875
MLPCFQLLRIGGGRGGDLYTFHPPAGAGCTYRLGHRADLCDVALRPQQEPGLISGIHAELHAEPRGDDWRVSLEDHSSQGTLVNNVRLPRGHRLELSDGDLLTFGPEGSPGTSPSEFYFMFQQVRVKPQDFAAITIPRSRGEARVGAGFRPMLPSQGAPQRPLSTFSPAPKATLILNSIGSLSKLRPQPLTFSPSWGGPKSLPVPAPPGEVGTTPSAPPQRNRRKSVHRVLAELDDESEPPENPPPVLMEPRKKLRVDKAPLTPTGNRRGRPRKYPVSAPMAPPAVGGGEPCAAPCCCLPQEETVAWVQCDGCDVWFHVACVGCSIQAAREADFRCPGCRAGIQT

SEQ ID NO: 89662 - protein, 345 aa, Homo sapiens; identical to SEQ ID NO: 89657
  Payload ID: 17961
  Gene Name: transcription factor 19
  ENSP ID: ENSP00000397160

SEQ ID NO: 89663 - protein, 345 aa, Homo sapiens; identical to SEQ ID NO: 89661
  Payload ID: 17961
  Gene Name: transcription factor 19
  ENSP ID: ENSP00000399189

SEQ ID NO: 89664 - protein, 345 aa, Homo sapiens; identical to SEQ ID NO: 89657
  Payload ID: 17961
  Gene Name: transcription factor 19
  ENSP ID: ENSP00000399388

SEQ ID NO: 89665 - protein, 345 aa, Homo sapiens; identical to SEQ ID NO: 89657
  Payload ID: 17961
  Gene Name: transcription factor 19
  ENSP ID: ENSP00000401548

SEQ ID NO: 89666 - protein, 345 aa, Homo sapiens; identical to SEQ ID NO: 89657
  Payload ID: 17961
  Gene Name: transcription factor 19
  ENSP ID: ENSP00000414076

SEQ ID NO: 89667 - protein, 345 aa, Homo sapiens; identical to SEQ ID NO: 89657
  Payload ID: 17961
  Gene Name: transcription factor 19
  ENSP ID: ENSP00000414466

SEQ ID NO: 89668 - protein, 345 aa, Homo sapiens; identical to SEQ ID NO: 89657
  Payload ID: 17961
  Gene Name: transcription factor 19
  ENSP ID: ENSP00000414980

SEQ ID NO: 89669 - protein, 217 aa, Homo sapiens
  Payload ID: 17961
  Gene Name: transcription factor 19
  ENSP ID: ENSP00000439397
TLVNNVRLPRGHRLELSDGDLLTFGPEGPPGTSPSEFYFMFQQVRVKPQDFAAITIPRSRGEARVGAGFRPMLPSQGAPQRPLSTFSPAPKATLILNSIGSLSKLRPQPLTFSPSWGGPKSLPVPAPPGEMGTTPSAPPQRNRRKSVHRVLAELDDESEPPENPPPVLMEPRKKLRVDKAPLTPTGNWHIQGMQSIVKGQKERPWPREHLSGYEEAS

SEQ ID NO: 89670 - protein, 1938 aa, Homo sapiens
  Payload ID: 17962
  Gene Name: transcription factor 20 (AR1)
  Uniprot ID: Q9UGU0
  ENSP ID: ENSP00000335561
MQSFREQSSYHGNQQSYPQEVHGSSRLEEFSPRQAQMFQNFGGTGGSSGSSGSGSGGGRRGAAAAAAAMASETSGHQGYQGFRKEAGDFYYMAGNKDPVTTGTPQPPQRRPSGPVQSYGPPQGSSFGNQYGSEGHVGQFQAQHSGLGGVSHYQQDYTGPFSPGSAQYQQQASSQQQQQQVQQLRQQLYQSHQPLPQATGQPASSSSHLQPMQRPSTLPSSAAGYQLRVGQFGQHYQSSASSSSSSSFPSPQRFSQSGQSYDGSYNVNAGSQYEGHNVGSNAQAYGTQSNYSYQPQSMKNFEQAKIPQGTQQGQQQQQPQQQQHPSQHVMQYTNAATKLPLQSQVGQYNQPEVPVRSPMQFHQNFSPISNPSPAASVVQSPSCSSTPSPLMQTGENLQCGQGSVPMGSRNRILQLMPQLSPTPSMMPSPNSHAAGFKGFGLEGVPEKRLTDPGLSSLSALSTQVANLPNTVQHMLLSDALTPQKKTSKRPSSSKKADSCTNSEGSSQPEEQLKSPMAESLDGGCSSSSEDQGERVRQLSGQSTSSDTTYKGGASEKAGSSPAQGAQNEPPRLNASPAAREEATSPGAKDMPLSSDGNPKVNEKTVGVIVSREAMTGRVEKPGGQDKGSQEDDPAATQRPPSNGGAKETSHASLPQPEPPGGGGSKGNKNGDNNSNHNGEGNGQSGHSAAGPGFTSRTEPSKSPGSLRYSYKDSFGSAVPRNVSGFPQYPTGQEKGDFTGHGERKGRNEKFPSLLQEVLQGYHHHPDRRYSRSTQEHQGMAGSLEGTTRPNVLVSQTNELASRGLLNKSIGSLLENPHWGPWERKSSSTAPEMKQINLTDYPIPRKFEIEPQSSAHEPGGSLSERRSVICDISPLRQIVRDPGAHSLGHMSADTRIGRNDRLNPTLSQSVILPGGLVSMETKLKSQSGQIKEEDFEQSKSQASFNNKKSGDHCHPPSIKHESYRGNASPGAATHDSLSDYGPQDSRPTPMRRVPGRVGGREGMRGRSPSQYHDFAEKLKMSPGRSRGPGGDPHHMNPHMTFSERANRSSLHTPFSPNSETLASAYHANTRAHAYGDPNAGLNSQLHYKRQMYQQQPEEYKDWSSGSAQGVIAAAQHRQEGPRKSPRQQQFLDRVRSPLKNDKDGMMYGPPVGTYHDPSAQEAGRCLMSSDGLPNKGMELKHGSQKLQESCWDLSRQTSPAKSSGPPGMSSQKRYGPPHETDGHGLAEATQSSKPGSVMLRLPGQEDHSSQNPLIMRRRVRSFISPIPSKRQSQDVKNSSTEDKGRLLHSSKEGADKAFNSYAHLSHSQDIKSIPKRDSSKDLPSPDSRNCPAVTLTSPAKTKILPPRKGRGLKLEAIVQKITSPNIRRSASSNSAEAGGDTVTLDDILSLKSGPPEGGSVAVQDADIEKRKGEVASDLVSPANQELHVEKPLPRSSEEWRGSVDDKVKTETHAETVTAGKEPPGAMTSTTSQKPGSNQGRPDGSLGGTAPLIFPDSKNVPPVGILAPEANPKAEEKENDTVTISPKQEGFPPKGYFPSGKKKGRPIGSVNKQKKQQQPPPPPPQPPQIPEGSADGEPKPKKQRQRRERRKPGAQPRKRKTKQAVPIVEPQEPEIKLKYATQPLDKTDAKNKSFYPYIHVVNKCELGAVCTIINAEEEEQTKLVRGRKGQRSLTPPPSSTESKALPASSFMLQGPVVTESSVMGHLVCCLCGKWASYRNMGDLFGPFYPQDYAATLPKNPPPKRATEMQSKVKVRHKSASNGSKTDTEEEEEQQQQQKEQRSLAAHPRFKRRHRSEDCGGGPRSLSRGLPCKKAATEGSSEKTVLDSKPSVPTTSEGGPELELQIPELPLDSNEFWVHEGCILWANGIYLVCGRLYGLQEALEIAREMKCSHCQEAGATLGCYNKGCSFRYHYPCAIDADCLLHEENFSVRCPKHKVRLWR

SEQ ID NO: 89671 - protein, 1960 aa, Homo sapiens [sequence omitted]

SEQ ID NO: 89672 - protein, 250 aa, Homo sapiens
  Payload ID: 17962
  Gene Name: transcription factor 20 (AR1)
  ENSP ID: ENSP00000385531
MGHLVCCLCGKWASYRNMGDLFGPFYPQDYAATLPKNPPPKRATEMQSKVKVRHKSASNGSKTDTEEEEEQQQQQKEQRSLAAHPRFKRRHRSEDCGGGPRSLSRGLPCKKAATEGSSEKTVLDSKPSVPTTSEGGPELELQIPELPLDSNEFWVHEGCILWANGIYLVCGRLYGLQEALEIAREMKCSHCQEAGATLGCYNKGCSFRYHYPCAIDADCLLHEENFSVRCPKHKNKTAKGSLSTEQSERG

SEQ ID NO: 89673 - protein, 153 aa, Homo sapiens
  Payload ID: 17962
  Gene Name: transcription factor 20 (AR1)
  ENSP ID: ENSP00000458948
MQSFREQSSYHGNQQSYPQEVHGSSRLEEFSPRQAQMFQNFGGTGGSSGSSGSGSGGGRRGAAAAAAAMASETSGHQGYQGFRKEAGDFYYMAGNKDPVTTGTPQPPQRRPSGPVQSYGPPQGSSFGNQYGSEGHVGQFQAQHSGLGGVSHYQ

SEQ ID NO: 89674 - protein, 250 aa, Homo sapiens; identical to SEQ ID NO: 89672
  Payload ID: 17962
  Gene Name: transcription factor 20 (AR1)
  ENSP ID: ENSP00000459947

SEQ ID NO: 89675 - protein, 1960 aa, Homo sapiens [sequence omitted]

SEQ ID NO: 89676 - protein, 1938 aa, Homo sapiens; identical to SEQ ID NO: 89670
  Payload ID: 17962
  Gene Name: transcription factor 20 (AR1)
  Uniprot ID: Q9UGU0
  ENSP ID: ENSP00000460587

SEQ ID NO: 89677 - protein, 153 aa, Homo sapiens; identical to SEQ ID NO: 89673
  Payload ID: 17962
  Gene Name: transcription factor 20 (AR1)
  ENSP ID: ENSP00000475040

SEQ ID NO: 89678 - protein, 1938 aa, Homo sapiens; identical to SEQ ID NO: 89670
  Payload ID: 17962
  Gene Name: transcription factor 20 (AR1)
  Uniprot ID: Q9UGU0
  ENSP ID: ENSP00000478503

SEQ ID NO: 89679 - protein, 1960 aa, Homo sapiens [sequence omitted]

SEQ ID NO: 89680 - protein, 250 aa, Homo sapiens; identical to SEQ ID NO: 89672
  Payload ID: 17962
  Gene Name: transcription factor 20 (AR1)
  ENSP ID: ENSP00000485846

SEQ ID NO: 89681 - protein, 153 aa, Homo sapiens; identical to SEQ ID NO: 89673
  Payload ID: 17962
  Gene Name: transcription factor 20 (AR1)
  ENSP ID: ENSP00000486508

SEQ ID NO: 89682 - protein, 1938 aa, Homo sapiens; identical to SEQ ID NO: 89670
  Payload ID: 17962
  Gene Name: transcription factor 20 (AR1)
  Uniprot ID: Q9UGU0
  ENSP ID: ENSP00000486940

SEQ ID NO: 89683 - protein, 250 aa, Homo sapiens; identical to SEQ ID NO: 89672
  Payload ID: 17962
  Gene Name: transcription factor 20 (AR1)
  ENSP ID: ENSP00000487152

SEQ ID NO: 89684 - protein, 153 aa, Homo sapiens; identical to SEQ ID NO: 89673
  Payload ID: 17962
  Gene Name: transcription factor 20 (AR1)
  ENSP ID: ENSP00000487254

SEQ ID NO: 89685 - protein, 153 aa, Homo sapiens; identical to SEQ ID NO: 89673
  Payload ID: 17962
  Gene Name: transcription factor 20 (AR1)
  ENSP ID: ENSP00000487259

SEQ ID NO: 89686 - protein, 1960 aa, Homo sapiens [sequence omitted]

SEQ ID NO: 89687 - protein, 1960 aa, Homo sapiens [sequence omitted]

SEQ ID NO: 89688 - protein, 1938 aa, Homo sapiens; identical to SEQ ID NO: 89670
  Payload ID: 17962
  Gene Name: transcription factor 20 (AR1)
  Uniprot ID: Q9UGU0
  ENSP ID: ENSP00000487465

SEQ ID NO: 89689 - protein, 250 aa, Homo sapiens; identical to SEQ ID NO: 89672
  Payload ID: 17962
  Gene Name: transcription factor 20 (AR1)
  ENSP ID: ENSP00000487576

SEQ ID NO: 89690 - protein, 153 aa, Homo sapiens; identical to SEQ ID NO: 89673
  Payload ID: 17962
  Gene Name: transcription factor 20 (AR1)
  ENSP ID: ENSP00000488932

SEQ ID NO: 89691 - protein, 250 aa, Homo sapiens; identical to SEQ ID NO: 89672
  Payload ID: 17962
  Gene Name: transcription factor 20 (AR1)
  ENSP ID: ENSP00000488943

SEQ ID NO: 89692 - protein, 1938 aa, Homo sapiens; identical to SEQ ID NO: 89670
  Payload ID: 17962
  Gene Name: transcription factor 20 (AR1)
  ENSP ID: ENSP00000489006

SEQ ID NO: 89693 - protein, 1938 aa, Homo sapiens; identical to SEQ ID NO: 89670
  Payload ID: 17962
  Gene Name: transcription factor 20 (AR1)
  ENSP ID: ENSP00000489099

SEQ ID NO: 89694 - protein, 1960 aa, Homo sapiens [sequence omitted]

SEQ ID NO: 89695 - protein, 250 aa, Homo sapiens; identical to SEQ ID NO: 89672
  Payload ID: 17962
  Gene Name: transcription factor 20 (AR1)
  ENSP ID: ENSP00000489383

SEQ ID NO: 89696 - protein, 153 aa, Homo sapiens; identical to SEQ ID NO: 89673
  Payload ID: 17962
  Gene Name: transcription factor 20 (AR1)
  ENSP ID: ENSP00000489477

SEQ ID NO: 89697 - protein, 1960 aa, Homo sapiens [sequence omitted]

SEQ ID NO: 89698 - protein, 179 aa, Homo sapiens
  Payload ID: 17963
  Gene Name: transcription factor 21
  Uniprot ID: O43680
  ENSP ID: ENSP00000237316
MSTGSLSDVEDLQEVEMLECDGLKMDSNKEFVTSNESTEESSNCENGSPQKGRGGLGKRRKAPTKKSPLSGVSQEGKQVQRNAANARERARMRVLSKAFSRLKTTLPWVPPDTKLSKLDTLRLASSYIAHLRQILANDKYENGYIHPVNLTWPFMVAGKPESDLKEVVTASRLCGTTAS

SEQ ID NO: 89699 - protein, 179 aa, Homo sapiens; identical to SEQ ID NO: 89698
  Payload ID: 17963
  Gene Name: transcription factor 21
  Uniprot ID: O43680
  ENSP ID: ENSP00000356857

SEQ ID NO: 89700 - protein, 214 aa, Homo sapiens
  Payload ID: 17964
  Gene Name: transcription factor 23
  Uniprot ID: Q7RTU1
  ENSP ID: ENSP00000296096
MSQRKARGPPAMPGVGHSQTQAKARLLPGADRKRSRLSRTRQDPWEERSWSNQRWSRATPGPRGTRAGGLALGRSEASPENAARERSRVRTLRQAFLALQAALPAVPPDTKLSKLDVLVLAASYIAHLTRTLGHELPGPAWPPFLRGLRYLHPLKKWPMRSRLYAGGLGYSDLDSTTASTPSQRTRDAEVGSQVPGEADALLSTTPLSPALGDK

SEQ ID NO: 89701 - protein, 167 aa, Homo sapiens
  Payload ID: 17965
  Gene Name: transcription factor 24
  Uniprot ID: Q7RTU0
  ENSP ID: ENSP00000455444
MDRGRPAGSPLSASAEPAPLAAAIRDSRPGRTGPGPAGPGGGSRSGSGRPAAANAARERSRVQTLRHAFLELQRTLPSVPPDTKLSKLDVLLLATTYIAHLTRSLQDDAEAPADAGLGALRGDGYLHPVKKWPMRSRLYIGATGQFLKHSVSGEKTNHDNTPTDSQP

SEQ ID NO: 89702 - protein, 676 aa, Homo sapiens
  Payload ID: 17966
  Gene Name: transcription factor 25 (basic helix-loop-helix)
  Uniprot ID: Q9BQ70
  ENSP ID: ENSP00000263346
MSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 89703 - protein, 473 aa, Homo sapiens
  Payload ID: 17966
  Gene Name: transcription factor 25 (basic helix-loop-helix)
  ENSP ID: ENSP00000263347
MRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERKGEEERNSVIWGSQLCVCRPRSFPSPPNVQALACRPLWQAKSYQPWKHHCSLLPVTVAKLYHGGGEARGRSGWGSEPQPGPEQADAGCARHDGQLPPQRPGGAARGRR

SEQ ID NO: 89704 - protein, 210 aa, Homo sapiens
  Payload ID: 17966
  Gene Name: transcription factor 25 (basic helix-loop-helix)
  ENSP ID: ENSP00000454414
MSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRPRQRQRVYPKCTWLTTPKSTWPRYSKP

SEQ ID NO: 89705 - protein, 117 aa, Homo sapiens
  Payload ID: 17966
  Gene Name: transcription factor 25 (basic helix-loop-helix)
  ENSP ID: ENSP00000455471
  MOD_RES (1)..(1): Any amino acid
XKGEEERNSVIWGSQLCVCRPRSFPSPPNVQALACRPLWQVRVTQWKQAKSYQPWKHHCSLLPVTVAKLYHGGGEARGRSGWGSEPQPGPEQADAGCARHDGQLPPQRPGGAARGRR

SEQ ID NO: 89706 - protein, 570 aa, Homo sapiens
  Payload ID: 17966
  Gene Name: transcription factor 25 (basic helix-loop-helix)
  ENSP ID: ENSP00000455611
  MOD_RES (1)..(1): Any amino acid
XGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERKGEEERNSVIWGSQLCVCRPRSFPSPPNVQALACRPLWQAKSYQPWKHHCSLLPVTVAKLYHGGGEARGRSGWGSEPQPGPEQADAGCARHDGQLPPQRPGGAARGRR

SEQ ID NO: 89707 - protein, 76 aa, Homo sapiens
  Payload ID: 17966
  Gene Name: transcription factor 25 (basic helix-loop-helix)
  ENSP ID: ENSP00000456080
MSRRALRRLRGEQRGQEPLGPGALHFDLRDDDDAEEEGPKRELGVRRPGGAGKEGVRVNNRFELEKWTFSSPPKKR

SEQ ID NO: 89708 - protein, 209 aa, Homo sapiens
  Payload ID: 17966
  Gene Name: transcription factor 25 (basic helix-loop-helix)
  ENSP ID: ENSP00000456344
  MOD_RES (1)..(1): Any amino acid
XRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEIRLTAHTCVPQPHALRPAAQGPPFTPGHRALPGPPVCPSMGLCQPRGRLWSEEGFCSEPLLSPSQPPALSQLVNLY

SEQ ID NO: 89709 - protein, 146 aa, Homo sapiens
  Payload ID: 17966
  Gene Name: transcription factor 25 (basic helix-loop-helix)
  ENSP ID: ENSP00000456592
  MOD_RES (1)..(1): Any amino acid
XRSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRCGPRPSLRLPFSAAALLCGCPSLRLPFSVAATETSWEEKVL

SEQ ID NO: 89710 - protein, 233 aa, Homo sapiens
  Payload ID: 17966
  Gene Name: transcription factor 25 (basic helix-loop-helix)
  ENSP ID: ENSP00000456803
MSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRPRQRQRVYPKCTWLTTPKSTWPRYSKPGLSMRLLESKKGL

SEQ ID NO: 89711 - protein, 286 aa, Homo sapiens
  Payload ID: 17966
  Gene Name: transcription factor 25 (basic helix-loop-helix)
  ENSP ID: ENSP00000456840
  MOD_RES (1)..(1): Any amino acid
XRHLNPDTELKRYFGARAILGEQRPRQRQRVYPKCTWLTTPKSTWPRYSKPGLSMRLLESKKGLSFFAFEHSEEYQQAQHKFLVAVESMEPNNIVLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRF

SEQ ID NO: 89712 - protein, 265 aa, Homo sapiens
  Payload ID: 17966
  Gene Name: transcription factor 25 (basic helix-loop-helix)
  ENSP ID: ENSP00000457329
MSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKSEEYQQAQHKFLVAVESMEPNNIVLSDACRFQEDQEMARDLVERALYSMECAFHPLFSLTSGACRLDYRRPEN

SEQ ID NO: 89713 - protein, 216 aa, Homo sapiens
  Payload ID: 17966
  Gene Name: transcription factor 25 (basic helix-loop-helix)
  ENSP ID: ENSP00000484773
MSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRDRVLLGCPVWF

SEQ ID NO: 89714 - protein, 654 aa, Homo sapiens
  Payload ID: 17967
  Gene Name: transcription factor 3
  Uniprot ID: P15923
  ENSP ID: ENSP00000262965
MNQPQRMAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTSPDEDEDDLLPPEQKAEREKERRVANNARERLRVRDINEAFKELGRMCQLHLNSEKPQTKLLILHQAVSVILNLEQQVRERNLNPKAACLKRREEEKVSGVVGDPQMVLSAPHPGLSEAHNPAGHM

SEQ ID NO: 89715 - protein, 600 aa, Homo sapiens
  Payload ID: 17967
  Gene Name: transcription factor 3
  ENSP ID: ENSP00000344375
MNQPQRMAPVGTDKELSDLLDFSMMFPLPVTNGKGRPASLAGAQFGGSGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTSSTDEVLSLEEKDLRDRERRMANNARERVRVRDINEAFRELGRMCQMHLKSDKAQTKLLILQQAVQVILGLEQQVRERNLNPKAACLKRREEEKVSGVVGDPQMVLSAPHPGLSEAHNPAGHM

SEQ ID NO: 89716 - protein, 658 aa, Homo sapiens
  Payload ID: 17967
  Gene Name: transcription factor 3
  Uniprot ID: P15923
  ENSP ID: ENSP00000378813
MNQPQRMAPVGTDKELSDLLDFSMMFPLPVTNGKGRPASLAGAQFGGSGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTRCQPTPRHSPPSPHQDAHVHRPHAHRTHTGRPSAGPTLFPQPHCLPLAPSRRPPHSPDEDEDDLLPPEQKAEREKERRVANNARERLRVRDINEAFKELGRMCQLHLNSEKPQTKLLILHQAVSVILNLEQQVRERNLNPKAACLKRREEEKVSGVVGDPQMVLSAPHPGLSEAHNPAGHM

SEQ ID NO: 89717 - protein, 679 aa, Homo sapiens
  Payload ID: 17967
  Gene Name: transcription factor 3
  ENSP ID: ENSP00000396363
MNQPQRMAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGECLAWCGPSAVHRCADVGLGMVSARTAPGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTSTDEVLSLEEKDLRDRERRMANNARERVRVRDINEAFRELGRMCQMHLKSDKAQTKLLILQQAVQVILGLEQQVRERNLNPKAACLKRREEEKVSGVVGDPQMVLSAPHPGLSEAHNPAGHM

SEQ ID NO: 89718 - protein, 51 aa, Homo sapiens
  Payload ID: 17967
  Gene Name: transcription factor 3
  ENSP ID: ENSP00000465251
AAASEIKREEKEDEENTSAADHSEEEKKELKAPRARTRAEGRAGEGAPGGQ

SEQ ID NO: 89719 - protein, 82 aa, Homo sapiens
  Payload ID: 17967
  Gene Name: transcription factor 3
  ENSP ID: ENSP00000465481
TLPDLSRPPDSYSGLGRAGATAAASEIKREEKEDEENTSAADHSEEEKKELKAPRARTRRGRGRPSPPRAEGRAGEGAPGGQ

SEQ ID NO: 89720 - protein, 159 aa, Homo sapiens
  Payload ID: 17967
  Gene Name: transcription factor 3
  ENSP ID: ENSP00000465510
AAASEIKREEKEDEENTSAADHSEEEKKELKAPRARTSTDEVLSLEEKDLRDRERRMANNARERVRVRDINEAFRELGRMCQMHLKSDKAQTKLLILQQAVQVILGLEQQVRERNLNPKAACLKRREEEKVSGVVGDPQMVLSAPHPGLSEAHNPAGHM

SEQ ID NO: 89721 - protein, 179 aa, Homo sapiens
  Payload ID: 17967
  Gene Name: transcription factor 3
  ENSP ID: ENSP00000465549
SRPPDSYSGLGRAGATAAASEIKREEKEDEENTSAADHSEEEKKELKAPRARTSPDEDEDDLLPPEQKAEREKERRVANNARERLRVRDINEAFKELGRMCQLHLNSEKPQTKLLILHQAVSVILNLEQQVRERNLNPKAACLKRREEEKVSGVVGDPQMVLSAPHPGLSEAHNPAGHM

SEQ ID NO: 89722 - protein, 213 aa, Homo sapiens
  Payload ID: 17967
  Gene Name: transcription factor 3
  ENSP ID: ENSP00000466052
MNQPQRMAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAP

SEQ ID NO: 89723 - protein, 220 aa, Homo sapiens
  Payload ID: 17967
  Gene Name: transcription factor 3
  ENSP ID: ENSP00000466565
  MOD_RES (1)..(1): Any amino acid
XMSLGGRHAGLVGGSHPEDGLAGSTSLMHNHAALPSQPGTLPDLSRPPDSYSGLGRAGATAAASEIKREEKEDEENTSAADHSEEEKKELKAPRARTSSTDEVLSLEEKDLRDRERRMANNARERVRVRDINEAFRELGRMCQMHLKSDKAQTKLLILQQAVQVILGLEQQVRERNLNPKAACLKRREEEKVSGVVGDPQMVLSAPHPGLSEAHNPAGHM

SEQ ID NO: 89724 - protein, 314 aa, Homo sapiens
  Payload ID: 17967
  Gene Name: transcription factor 3
  ENSP ID: ENSP00000466952
  MOD_RES (1)..(1): Any amino acid
XTSQWPRAGAPGALSPSYDGGLHGLQSKIEDHLDEAIHVLRSHAVGTAGDMHTLLPGHGALASGFTGPMSLGGRHAGLVSAGRGWSWAVGGDPAPPDAPVSPRLQVGGSHPEDGLAGSTSLMHNHAALPSQPGTLPDLSRPPDSYSGLGRAGATAAASEIKREEKEDEENTSAADHSEEEKKELKAPRARTSSTDEVLSLEEKDLRDRERRMANNARERVRVRDINEAFRELGRMCQMHLKSDKAQTKLLILQQAVQVILGLEQQVRERNLNPKAACLKRREEEKVSGVVGDPQMVLSAPHPGLSEAHNPAGHM

SEQ ID NO: 89725 - protein, 95 aa, Homo sapiens
  Payload ID: 17967
  Gene Name: transcription factor 3
  ENSP ID: ENSP00000466954
MNQPQRMAPVGTDKELSDLLDFSMMFPLPVTNGKGRPASLAGAQFGGSGLEDRPSSGSWGSGDQSSSSFDPSRTFSEGTHFTESHSSLSSSTFLG

SEQ ID NO: 89726 - protein, 96 aa, Homo sapiens
  Payload ID: 17967
  Gene Name: transcription factor 3
  ENSP ID: ENSP00000467388
IYSPDHSSNNFSSSPSTPVGSPQGLAGTSQWPRAGAPGALSPSYDGGLHGLVGGSHPEDGLAGSTSLMHNHAALPSQPGTLPDLSRPPDSYSGLGR

SEQ ID NO: 89727 - protein, 165 aa, Homo sapiens
  Payload ID: 17967
  Gene Name: transcription factor 3
  ENSP ID: ENSP00000467508
ATAAASEIKREEKEDEENTSAADHSEEEKKELKAPRARTSPDEDEDDLLPPEQKAEREKERRVANNARERLRVRDINEAFKELGRMCQLHLNSEKPQTKLLILHQAVSVILNLEQQVRERNLNPKAACLKRREEEKVSGVVGDPQMVLSAPHPGLSEAHNPAGHM

SEQ ID NO: 89728 - protein, 51 aa, Homo sapiens; identical to SEQ ID NO: 89718
  Payload ID: 17967
  Gene Name: transcription factor 3
  ENSP ID: ENSP00000467972

SEQ ID NO: 89729 - protein, 204 aa, Homo sapiens
  Payload ID: 17967
  Gene Name: transcription factor 3
  ENSP ID: ENSP00000468481
  MOD_RES (1)..(1): Any amino acid
XLAGSTSLMHNHAALPSQPGTLPDLSRPPDSYSGLGRAGATAAASEIKREEKEDEENTSAADHSEEEKKELKAPRARTSPDEDEDDLLPPEQKAEREKERRVANNARERLRVRDINEAFKELGRMCQLHLNSEKPQTKLLILHQAVSVILNLEQQVRERNLNPKAACLKRREEEKVSGVVGDPQMVLSAPHPGLSEAHNPAGHM

SEQ ID NO: 89730 - protein, 651 aa, Homo sapiens
  Payload ID: 17967
  Gene Name: transcription factor 3
  Uniprot ID: P15923
  ENSP ID: ENSP00000468487
MNQPQRMAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTSSTDEVLSLEEKDLRDRERRMANNARERVRVRDINEAFRELGRMCQMHLKSDKAQTKLLILQQAVQVILGLEQQVRERNLNPKAACLKRREEEKVSGVVGDPQMVLSAPHPGLSEAHNPAGHM

SEQ ID NO: 89731 - protein, 654 aa, Homo sapiens; identical to SEQ ID NO: 89714
  Payload ID: 17967
  Gene Name: transcription factor 3
  Uniprot ID: P15923
  ENSP ID: ENSP00000480564

SEQ ID NO: 89732 - protein, 671 aa, Homo sapiens
  Payload ID: 17968
  Gene Name: transcription factor 4
  Uniprot ID: P15884
  ENSP ID: ENSP00000346440
MHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITRSRSSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89733 - protein, 667 aa, Homo sapiens
  Payload ID: 17968
  Gene Name: transcription factor 4
  Uniprot ID: P15884
  ENSP ID: ENSP00000348374
MHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89734 - protein, 773 aa, Homo sapiens
  Payload ID: 17968
  Gene Name: transcription factor 4
  ENSP ID: ENSP00000381382
MFSKRLEKIPQVPLLFPFIFIILTNYSKMEGAVESQPSFFKTSQDIVTCTWVENCYSSFSRRPLEQMFCKHQSKNIISWTGMVAHTCNPSTLGGQGLCDFAKMHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITRSRSSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89735 - protein, 511 aa, Homo sapiens
  Payload ID: 17968
  Gene Name: transcription factor 4
  Uniprot ID: P15884
  ENSP ID: ENSP00000409447
MYCAYTIPGMGGNSLMYYYNGKAVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITRSRSSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89736 - protein, 625 aa, Homo sapiens
  Payload ID: 17968
  Gene Name: transcription factor 4
  Uniprot ID: P15884
  ENSP ID: ENSP00000439656
MEEDSRDVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89737 - protein, 537 aa, Homo sapiens
  Payload ID: 17968
  Gene Name: transcription factor 4
  Uniprot ID: P15884
  ENSP ID: ENSP00000439827
MDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89738 - protein, 647 aa, Homo sapiens
  Payload ID: 17968
  Gene Name: transcription factor 4
  Uniprot ID: P15884
  ENSP ID: ENSP00000440731
MFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITRSRSSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89739 - protein, 600 aa, Homo sapiens
  Payload ID: 17968
  Gene Name: transcription factor 4
  Uniprot ID: P15884
  ENSP ID: ENSP00000441562
MKDIFFQFIIARVRKCYSLSCLHTLPVVPTLRKTERGSYSSYGRESNLQGCHQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITRSRSSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89740 - protein, 643 aa, Homo sapiens
  Payload ID: 17968
  Gene Name: transcription factor 4
  Uniprot ID: P15884
  ENSP ID: ENSP00000445202
MFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89741 - protein, 135 aa, Homo sapiens
  Payload ID: 17968
  Gene Name: transcription factor 4
  ENSP ID: ENSP00000454328
MFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRR

SEQ ID NO: 89742 - protein, 124 aa, Homo sapiens
  Payload ID: 17968
  Gene Name: transcription factor 4
  ENSP ID: ENSP00000454352
  MOD_RES (1)..(1): Any amino acid
XSKRLEKIPQVPLLFPFIFIILTNYSKMEGAVESQPSFFKTSQDIVTCTWVENCYSSFSRRPLEQMFCKHQSKNIISWTGMVAHTCNPSTLGGQDVFTSCEQWEKWTNFFGKWTFYWLKCRRQK

SEQ ID NO: 89743 - protein, 607 aa, Homo sapiens
  Payload ID: 17968
  Gene Name: transcription factor 4
  Uniprot ID: P15884
  ENSP ID: ENSP00000454366
MHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89744 - protein, 61 aa, Homo sapiens
  Payload ID: 17968
  Gene Name: transcription factor 4
  ENSP ID: ENSP00000454441
  MOD_RES (1)..(1): Any amino acid
XNIISWTGMVAHTCNPSTLGGQDGVSFCHPDRSAVAPSQLTATSTSQVQAILLPQPPEYPG

SEQ ID NO: 89745 - protein, 209 aa, Homo sapiens
  Payload ID: 17968
  Gene Name: transcription factor 4
  ENSP ID: ENSP00000454584
MFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGM

SEQ ID NO: 89746 - protein, 537 aa, Homo sapiens; identical to SEQ ID NO: 89737
  Payload ID: 17968
  Gene Name: transcription factor 4
  Uniprot ID: P15884
  ENSP ID: ENSP00000454647

SEQ ID NO: 89747 - protein, 56 aa, Homo sapiens
  Payload ID: 17968
  Gene Name: transcription factor 4
  ENSP ID: ENSP00000454866
MTSRDLGSHDNLSPPFVNSRIQSKTERGSYSSYGRESNLQGCHQQSLLGGDMDMGN

SEQ ID NO: 89748 - protein, 163 aa, Homo sapiens
  Payload ID: 17968
  Gene Name: transcription factor 4
  ENSP ID: ENSP00000455071
MDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYST

SEQ ID NO: 89749 - protein, 647 aa, Homo sapiens; identical to SEQ ID NO: 89738
  Payload ID: 17968
  Gene Name: transcription factor 4
  Uniprot ID: P15884
  ENSP ID: ENSP00000455135

SEQ ID NO: 89750 - protein, 165 aa, Homo sapiens
  Payload ID: 17968
  Gene Name: transcription factor 4
  ENSP ID: ENSP00000455163
MLEREGVKERVRMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVP

SEQ ID NO: 89751 - protein, 537 aa, Homo sapiens; identical to SEQ ID NO: 89737
  Payload ID: 17968
  Gene Name: transcription factor 4
  Uniprot ID: P15884
  ENSP ID: ENSP00000455179

SEQ ID NO: 89752 - protein, 596 aa, Homo sapiens
  Payload ID: 17968
  Gene Name: transcription factor 4
  Uniprot ID: P15884
  ENSP ID: ENSP00000455261
MKDIFFQFIIARVRKCYSLSCLHTLPVVPTLRKTERGSYSSYGRESNLQGCHQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89753 - protein, 162 aa, Homo sapiens
  Payload ID: 17968
  Gene Name: transcription factor 4
  ENSP ID: ENSP00000455304
MDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYS

SEQ ID NO: 89754 - protein, 642 aa, Homo sapiens
  Payload ID: 17968
  Gene Name: transcription factor 4
  ENSP ID: ENSP00000455346
MFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89755 - protein, 664 aa, Homo sapiens
  Payload ID: 17968
  Gene Name: transcription factor 4
  Uniprot ID: P15884
  ENSP ID: ENSP00000455418
MQRAKTELFRLQIVTDDLRKNEMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89756 - protein, 139 aa, Homo sapiens
  Payload ID: 17968
  Gene Name: transcription factor 4
  ENSP ID: ENSP00000455450
MHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTL

SEQ ID NO: 89757 - protein, 507 aa, Homo sapiens
  Payload ID: 17968
  Gene Name: transcription factor 4
  Uniprot ID: P15884
  ENSP ID: ENSP00000455763
MYCAYTIPGMGGNSLMYYYNGKAVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89758 - protein, 583 aa, Homo sapiens
  Payload ID: 17968
  Gene Name: transcription factor 4
  Uniprot ID: P15884
  ENSP ID: ENSP00000455984
MFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89759 - protein, 611 aa, Homo sapiens
  Payload ID: 17968
  Gene Name: transcription factor 4
  Uniprot ID: P15884
  ENSP ID: ENSP00000456125
MHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITRSRSSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89760 - protein, 179 aa, Homo sapiens
  Payload ID: 17968
  Gene Name: transcription factor 4
  ENSP ID: ENSP00000456220
MDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMAN

SEQ ID NO: 89761 - protein, 118 aa, Homo sapiens
  Payload ID: 17968
  Gene Name: transcription factor 4
  ENSP ID: ENSP00000456802
MDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHI

SEQ ID NO: 89762 - protein, 287 aa, Homo sapiens
  Payload ID: 17968
  Gene Name: transcription factor 4
  ENSP ID: ENSP00000456983
MEMDIATFMAKMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPA

SEQ ID NO: 89763 - protein, 168 aa, Homo sapiens
  Payload ID: 17968
  Gene Name: transcription factor 4
  ENSP ID: ENSP00000457082
MFSKRLEKIPQVPLLFPFIFIILTNYSKMEGAVESQPSFFKTSQDIVTCTWVENCYSSFSRRPLEMESHSVIQTGVQWHHLSSLQPPPPRFKLSSCLSLLSTRDRRLCDFAKMHHQQRMAALGTDKELSDLLDFSAMFSPPVSSGKNGPTSLASGHFTGSNVEDRSSS

SEQ ID NO: 89764 - protein, 158 aa, Homo sapiens
  Payload ID: 17968
  Gene Name: transcription factor 4
  ENSP ID: ENSP00000457113
MFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPS

SEQ ID NO: 89765 - protein, 134 aa, Homo sapiens
  Payload ID: 17968
  Gene Name: transcription factor 4
  ENSP ID: ENSP00000457245
MDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLS

SEQ ID NO: 89766 - protein, 677 aa, Homo sapiens
  Payload ID: 17968
  Gene Name: transcription factor 4
  ENSP ID: ENSP00000457263
MHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSLVLSPQVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITRSRSSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89767 - protein, 280 aa, Homo sapiens
  Payload ID: 17968
  Gene Name: transcription factor 4
  ENSP ID: ENSP00000457392
MRASKGSEGCQHAVTSQLVTGAGGDQTEMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSS

SEQ ID NO: 89768 - protein, 667 aa, Homo sapiens; identical to SEQ ID NO: 89733
  Payload ID: 17968
  Gene Name: transcription factor 4
  Uniprot ID: P15884
  ENSP ID: ENSP00000457649

SEQ ID NO: 89769 - protein, 146 aa, Homo sapiens
  Payload ID: 17968
  Gene Name: transcription factor 4
  ENSP ID: ENSP00000457747
MFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQSLLGGDMDMGNPGTLSPTKPGSQYYQYSSNNPRRRPLHSSAMEVQTK

SEQ ID NO: 89770 - protein, 507 aa, Homo sapiens
  Payload ID: 17968
  Gene Name: transcription factor 4
  Uniprot ID: P15884
  ENSP ID: ENSP00000457765
MKFKQCRCSDTGLCCLDHEGKAEVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89771 - protein, 119 aa, Homo sapiens
  Payload ID: 17968
  Gene Name: transcription factor 4
  ENSP ID: ENSP00000458122
MDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIP

SEQ ID NO: 89772 - protein, 65 aa, Homo sapiens
  Payload ID: 17968
  Gene Name: transcription factor 4
  ENSP ID: ENSP00000468277
MVMAEQSLLGGDMDMGNPGTLSPTKPGSQYYQYSSNNPRRRPLHSSAMEVQTKKVRKVPPGLPSS

SEQ ID NO: 89773 - protein, 166 aa, Homo sapiens
  Payload ID: 17968
  Gene Name: transcription factor 4
  ENSP ID: ENSP00000468729
  MOD_RES (1)..(1): Any amino acid
XHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSGSVFQIPFHHITVYKNDSPLVLPDFVGGNSLPPKSQSFNIPITDKYKGWERQITR

SEQ ID NO: 89774 - protein, 583 aa, Homo sapiens; identical to SEQ ID NO: 89758
  Payload ID: 17968
  Gene Name: transcription factor 4
  Uniprot ID: P15884
  ENSP ID: ENSP00000478549

SEQ ID NO: 89775 - protein, 224 aa, Homo sapiens
  Payload ID: 17968
  Gene Name: transcription factor 4
  ENSP ID: ENSP00000485755
MDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPS

SEQ ID NO: 89776 - protein, 451 aa, Homo sapiens
  Payload ID: 17968
  Gene Name: transcription factor 4
  Uniprot ID: P15884
  ENSP ID: ENSP00000486072
MQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 89777 - protein, 179 aa, Homo sapiens
  Payload ID: 17968
  Gene Name: transcription factor 4
  ENSP ID: ENSP00000486111
MFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQSLLGGDMDMGNPGTLSPTKPGSQYYQYSSNNPRRRPLHSSAMEVQTKKVRKVPPGLPSSVYAPSASTADYNRDSPGYPSS

SEQ ID NO: 89778 - protein, 236 aa, Homo sapiens
  Payload ID: 17968
  Gene Name: transcription factor 4
  ENSP ID: ENSP00000486148
MDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNG

SEQ ID NO: 89779 - protein, 202 aa, Homo sapiens
  Payload ID: 17968
  Gene Name: transcription factor 4
  ENSP ID: ENSP00000486215
MFSPPVSSGKNGPTSLASGHFTGSSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPP

SEQ ID NO: 89780 - protein, 155 aa, Homo sapiens
  Payload ID: 17968
  Gene Name: transcription factor 4
  ENSP ID: ENSP00000486405
MDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHR

SEQ ID NO: 89781 - protein, 671 aa, Homo sapiens; identical to SEQ ID NO: 89732
  Payload ID: 17968
  Gene Name: transcription factor 4
  Uniprot ID: P15884
  ENSP ID: ENSP00000486670

SEQ ID NO: 89782 - protein, 207 aa, Homo sapiens
  Payload ID: 17968
  Gene Name: transcription factor 4
  ENSP ID: ENSP00000486909
MDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHT

SEQ ID NO: 89783 - protein, 228 aa, Homo sapiens
  Payload ID: 17968
  Gene Name: transcription factor 4
  ENSP ID: ENSP00000486974
MKDIFFQFIIARVRKCYSLSCLHTLPVVPTLRKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTP

SEQ ID NO: 89784 - protein, 80 aa, Homo sapiens
  Payload ID: 17968
  Gene Name: transcription factor 4
  ENSP ID: ENSP00000487010
MYCAYTIPGMGGNSLMYYYNGKAVYAPSASTADYNRDSPGYPSSKPATSTFPSSFFMQELSITLLSRHQFQSSSDVHFPS

SEQ ID NO: 89785 - protein, 81 aa, Homo sapiens
  Payload ID: 17968
  Gene Name: transcription factor 4
  ENSP ID: ENSP00000487134
MFSKRLEKIPQVPLLFPFIFIILTNYSKMEGAVESQPSFFKTSQDIVTCTWVENCYSSFSRRPLEVCVILLKCITNSEWLP

SEQ ID NO: 89786 - protein, 156 aa, Homo sapiens
  Payload ID: 17968
  Gene Name: transcription factor 4
  ENSP ID: ENSP00000487150
MHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQSLLGGDMDMGNPGTLSPTKPGSQYYQYSSNNPR

SEQ ID NO: 89787 - protein, 204 aa, Homo sapiens
  Payload ID: 17968
  Gene Name: transcription factor 4
  ENSP ID: ENSP00000487171
MFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWS

SEQ ID NO: 89788 - protein, 315 aa, Homo sapiens
  Payload ID: 17968
  Gene Name: transcription factor 4
  ENSP ID: ENSP00000487218
MYCAYTIPGMGGNSLMYYYNGKAVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQ

SEQ ID NO: 89789 - protein, 135 aa, Homo sapiens
  Payload ID: 17968
  Gene Name: transcription factor 4
  ENSP ID: ENSP00000487413
MDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSY

SEQ ID NO: 89790 - protein, 221 aa, Homo sapiens
  Payload ID: 17968
  Gene Name: transcription factor 4
  ENSP ID: ENSP00000487415
MHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGH

SEQ ID NO: 89791 - protein, 128 aa, Homo sapiens
  Payload ID: 17968
  Gene Name: transcription factor 4
  ENSP ID: ENSP00000487419
MDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLH

SEQ ID NO: 89792 - protein, 81 aa, Homo sapiens
  Payload ID: 17968
  Gene Name: transcription factor 4
  ENSP ID: ENSP00000487505
LGRMVQLHLKSDKPQTKLLILHQAVAVILSLEQQVRERNLNPKAACLKRREEEKVSSEPPPLSLAGPHPGMGDASNHMGQM

SEQ ID NO: 89793 - protein, 134 aa, Homo sapiens
  Payload ID: 17968
  Gene Name: transcription factor 4
  ENSP ID: ENSP00000487557
MFSKRLEKIPQVPLLFPFIFIILTNYSKMEGAVESQPSFFKTSQDIVTCTWVENCYSSFSRRPLEQMFCKHQSKNIISWTGMVAHTCNPSTLGGQDGVSFCHPDRSAVAPSQLTATSTSQVQAILLPQPPEYPG

SEQ ID NO: 89794 - protein, 384 aa, Homo sapiens
  Payload ID: 17969
  Gene Name: transcription factor 7 (T-cell specific, HMG-box)
  Uniprot ID: P36402
  ENSP ID: ENSP00000340347
MPQLDSGGGGAGGGDDLGAPDELLAFQDEGEEQDDKSRDSAAGPERDLAELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTGGKRNAFGTYPEKAAAPAPFLPMTVL

SEQ ID NO: 89795 - protein, 268 aa, Homo sapiens
  Payload ID: 17969
  Gene Name: transcription factor 7 (T-cell specific, HMG-box)
  Uniprot ID: P36402
  ENSP ID: ENSP00000367822
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTDPGSPKKCRARFGLNQQTDWCGPCR

SEQ ID NO: 89796 - protein, 269 aa, Homo sapiens
  Payload ID: 17969
  Gene Name: transcription factor 7 (T-cell specific, HMG-box)
  Uniprot ID: P36402
  ENSP ID: ENSP00000378469
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTGGKRNAFGTYPEKAAAPAPFLPMTVL

SEQ ID NO: 89797 - protein, 481 aa, Homo sapiens
  Payload ID: 17969
  Gene Name: transcription factor 7 (T-cell specific, HMG-box)
  ENSP ID: ENSP00000378472
MPQLDSGGGGAGGGDDLGAPDELLAFQDEGEEQDDKSRDSAAGPERDLAELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTDPGSPKKCRARFGLNQQTDWCGPCRRKKKCIRYLPGEGRCPSPVPSDDSALGCPGSPAPQDSPSYHLLPRFPTELLTSPAEPAPTSPGLSTALSLPTPGPPQAPRSTLQSTQVQQQESQRQVA

SEQ ID NO: 89798 - protein, 100 aa, Homo sapiens
  Payload ID: 17969
  Gene Name: transcription factor 7 (T-cell specific, HMG-box)
  ENSP ID: ENSP00000427758
MYKETVYSAFNLLMHYPPPSGAGQHPQPQPPLVSGPRSQCRPVLAASLTSTRPISPPTVSPNSLSTNISTAHIPPLHLRTSARSKFTGLCRPLTSLASTP

SEQ ID NO: 89799 - protein, 147 aa, Homo sapiens
  Payload ID: 17969
  Gene Name: transcription factor 7 (T-cell specific, HMG-box)
  ENSP ID: ENSP00000427782
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEK

SEQ ID NO: 89800 - protein, 153 aa, Homo sapiens
  Payload ID: 17969
  Gene Name: transcription factor 7 (T-cell specific, HMG-box)
  ENSP ID: ENSP00000427870
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWPSPPLYPLSPSCGYRQHFPAPTAAPGAPYPRFTHPSLMLGSGVPGHPAAIPHPAIV

SEQ ID NO: 89801 - protein, 147 aa, Homo sapiens
  Payload ID: 17969
  Gene Name: transcription factor 7 (T-cell specific, HMG-box)
  ENSP ID: ENSP00000427968
GVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTDGIPACTILSP

SEQ ID NO: 89802 - protein, 204 aa, Homo sapiens
  Payload ID: 17969
  Gene Name: transcription factor 7 (T-cell specific, HMG-box)
  ENSP ID: ENSP00000429178
  MOD_RES (1)..(1): Any amino acid
XFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTGGKRNAFELLTSPAEPAPTSPGLSTALSLPTPGPPQAPRSTLQSTQVQQQESQRQVA

SEQ ID NO: 89803 - protein, 269 aa, Homo sapiens; identical to SEQ ID NO: 89796
  Payload ID: 17969
  Gene Name: transcription factor 7 (T-cell specific, HMG-box)
  Uniprot ID: P36402
  ENSP ID: ENSP00000429547

SEQ ID NO: 89804 - protein, 143 aa, Homo sapiens
  Payload ID: 17969
  Gene Name: transcription factor 7 (T-cell specific, HMG-box)
  ENSP ID: ENSP00000429696
MQHVGIMHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEM

SEQ ID NO: 89805 - protein, 71 aa, Homo sapiens
  Payload ID: 17969
  Gene Name: transcription factor 7 (T-cell specific, HMG-box)
  ENSP ID: ENSP00000429817
YSAFNLLMHYPPPSGAGQHPQPQPPLHKANQPPHGVPQLSLYEHFNSPHPTPAPADISQKQGTSLGWGGAQ

SEQ ID NO: 89806 - protein, 105 aa, Homo sapiens
  Payload ID: 17969
  Gene Name: transcription factor 7 (T-cell specific, HMG-box)
  ENSP ID: ENSP00000429935
  MOD_RES (1)..(1): Any amino acid
XMLYMKEMRAKVIAECTLKESAAINQILGRRWHALSREEQAKYYELARKERQLHMQLYPGWSARDNYGKKKRRSREKHQESTTENLKLTDIRRSQELQMWKQTLL

SEQ ID NO: 89807 - protein, 167 aa, Homo sapiens
  Payload ID: 17969
  Gene Name: transcription factor 7 (T-cell specific, HMG-box)
  ENSP ID: ENSP00000429946
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWPSPPLYPLSPSCGYRQHFPAPTAAPGAPYPRFTHPSLMLGSGVPGHPAAIPHPAIVPPSGKQELQPFDRN

SEQ ID NO: 89808 - protein, 269 aa, Homo sapiens
  Payload ID: 17969
  Gene Name: transcription factor 7 (T-cell specific, HMG-box)
  Uniprot ID: P36402
  ENSP ID: ENSP00000430179
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTETNWPRELKDGNGQESLSMSSSSSPA

SEQ ID NO: 89809 - protein, 122 aa, Homo sapiens
  Payload ID: 17969
  Gene Name: transcription factor 7 (T-cell specific, HMG-box)
  ENSP ID: ENSP00000430617
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIV

SEQ ID NO: 89810 - protein, 100 aa, Homo sapiens; identical to SEQ ID NO: 89798
  Payload ID: 17969
  Gene Name: transcription factor 7 (T-cell specific, HMG-box)
  ENSP ID: ENSP00000431095

SEQ ID NO: 89811 - protein, 588 aa, Homo sapiens
  Payload ID: 17970
  Gene Name: transcription factor 7-like 1 (T-cell specific, HMG-box)
  Uniprot ID: Q9HCS4
  ENSP ID: ENSP00000282111
MPQLGGGGGGGGGGSGGGGGSSAGAAGGGDDLGANDELIPFQDEGGEEQEPSSDSASAQRDLDEVKSSLVNESENQSSSSDSEAERRPQPVRDTFQKPRDYFAEVRRPQDSAFFKGPPYPGYPFLMIPDLSSPYLSNGPLSPGGARTYLQMKWPLLDVPSSATVKDTRSPSPAHLSNKVPVVQHPHHMHPLTPLITYSNDHFSPGSPPTHLSPEIDPKTGIPRPPHPSELSPYYPLSPGAVGQIPHPLGWLVPQQGQPMYSLPPGGFRHPYPALAMNASMSSLVSSRFSPHMVAPAHPGLPTSGIPHPAIVSPIVKQEPAPPSLSPAVSVKSPVTVKKEEEKKPHVKKPLNAFMLYMKEMRAKVVAECTLKESAAINQILGRKWHNLSREEQAKYYELARKERQLHSQLYPTWSARDNYGKKKKRKREKQLSQTQSQQQVQEAEGALASKSKKPCVQYLPPEKPCDSPASSHGSMLDSPATPSAALASPAAPAATHSEQAQPLSLTTKPETRAQLALHSAAFLSAKAAASSSGQMGSQPPLLSRPLPLGSMPTALLASPPSFPATLHAHQALPVLQAQPLSLVTKSAH

SEQ ID NO: 89812 - protein, 28 aa, Homo sapiens
  Payload ID: 17970
  Gene Name: transcription factor 7-like 1 (T-cell specific, HMG-box)
  ENSP ID: ENSP00000388984
MKWPLLDVPSSATVKDTRSPSPAHLSNK

SEQ ID NO: 89813 - protein, 206 aa, Homo sapiens
  Payload ID: 17971
  Gene Name: transcription factor 7-like 2 (T-cell specific, HMG-box)
  ENSP ID: ENSP00000277945
LTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNDLSAPKKCRARFGLDQQNNWCGPCRRKKKCVRYIQGEGSCLSPPSSDGSL

SEQ ID NO: 89814 - protein, 288 aa, Homo sapiens
  Payload ID: 17971
  Gene Name: transcription factor 7-like 2 (T-cell specific, HMG-box)
  ENSP ID: ENSP00000298692
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWQGQPVYPITTGGFRHPYPTALTVNASMSR

SEQ ID NO: 89815 - protein, 459 aa, Homo sapiens
  Payload ID: 17971
  Gene Name: transcription factor 7-like 2 (T-cell specific, HMG-box)
  Uniprot ID: Q9NQB0
  ENSP ID: ENSP00000344823
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCSL

SEQ ID NO: 89816 - protein, 222 aa, Homo sapiens
  Payload ID: 17971
  Gene Name: transcription factor 7-like 2 (T-cell specific, HMG-box)
  ENSP ID: ENSP00000345640
TNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSPLPCCTQGHDCQHFYPPSDFTVSTQVFRDMKRSHSLQKVGEPWCIESNKVPVVQHPHHVHPLTPLITYSNEHFTPGNPPPHLPADVDPKT

SEQ ID NO: 89817 - protein, 489 aa, Homo sapiens
  Payload ID: 17971
  Gene Name: transcription factor 7-like 2 (T-cell specific, HMG-box)
  Uniprot ID: Q9NQB0
  ENSP ID: ENSP00000347949
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVSPLPCCTQGHDCQHFYPPSDFTVSTQVFRDMKRSHSLQKVGEPWCIESNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNGEKKSAFATYKVKAAASAHPLQMEAY

SEQ ID NO: 89818 - protein, 619 aa, Homo sapiens
  Payload ID: 17971
  Gene Name: transcription factor 7-like 2 (T-cell specific, HMG-box)
  Uniprot ID: Q9NQB0
  ENSP ID: ENSP00000348274
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 89819 - protein, 120 aa, Homo sapiens
  Payload ID: 17971
  Gene Name: transcription factor 7-like 2 (T-cell specific, HMG-box)
  ENSP ID: ENSP00000358393
MLYMKEMRAKVVAECTLKESAAINQILGRRWHALSREEQAKYYELARKERQLHMQLYPGWSARDNYGKKKKRKRDKQPGETNDLSAPKKCRARFGLDQQNNWCGPCRCKYSKEVSGTVRA

SEQ ID NO: 89820 - protein, 176 aa, Homo sapiens
  Payload ID: 17971
  Gene Name: transcription factor 7-like 2 (T-cell specific, HMG-box)
  ENSP ID: ENSP00000358396
MSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNGEKKSAFATYKVKAAASAHPLQMEAY

SEQ ID NO: 89821 - protein, 317 aa, Homo sapiens
  Payload ID: 17971
  Gene Name: transcription factor 7-like 2 (T-cell specific, HMG-box)
  ENSP ID: ENSP00000358402
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVQSPLPCCTQGHDCQHFYPPSDFTVSTQVFRDMKRSHSLQKVGEPWCIESNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSR

SEQ ID NO: 89822 - protein, 596 aa, Homo sapiens
  Payload ID: 17971
  Gene Name: transcription factor 7-like 2 (T-cell specific, HMG-box)
  Uniprot ID: Q9NQB0
  ENSP ID: ENSP00000358404
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 89823 - protein, 108 aa, Homo sapiens
  Payload ID: 17971
  Gene Name: transcription factor 7-like 2 (T-cell specific, HMG-box)
  ENSP ID: ENSP00000435694
AECTLKESAAINQILGRRWHALSREEQAKYYELARKERQLHMQLYPGWSARDNYGKKKKRKRDKQPGETNDLSAPKKCRARFGLDQQNNWCGPCRCKYSKEVSGTVRA

SEQ ID NO: 89824 - protein, 476 aa, Homo sapiens
  Payload ID: 17971
  Gene Name: transcription factor 7-like 2 (T-cell specific, HMG-box)
  ENSP ID: ENSP00000440547
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSSFLSSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCRCKYSKEVSGTVRA

SEQ ID NO: 89825 - protein, 408 aa, Homo sapiens
  Payload ID: 17971
  Gene Name: transcription factor 7-like 2 (T-cell specific, HMG-box)
  ENSP ID: ENSP00000443626
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNGEKKSAFATYKVKAAASAHPLQMEAY

SEQ ID NO: 89826 - protein, 534 aa, Homo sapiens
  Payload ID: 17971
  Gene Name: transcription factor 7-like 2 (T-cell specific, HMG-box)
  ENSP ID: ENSP00000443883
MIPDLTSPYLPNGSLSPTARTYLQMKWPLLDVQAGSLQSRQALKDARSPSPAHIVQSPLPCCTQGHDCQHFYPPSDFTVSTQVFRDMKRSHSLQKVGEPWCIESNKVPVVQHPHHVHPLTPLITYSNEHFTPGNPPPHLPADVDPKTGIPRPPHPPDISPYYPLSPGTVGQIPHPLGWQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDANTPKKCRALFGLDRQTLWCKPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 89827 - protein, 607 aa, Homo sapiens
  Payload ID: 17971
  Gene Name: transcription factor 7-like 2 (T-cell specific, HMG-box)
  ENSP ID: ENSP00000444972
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSSFLSSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNDANTPKKCRALFGLDRQTLWCKPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 89828 - protein, 482 aa, Homo sapiens
  Payload ID: 17971
  Gene Name: transcription factor 7-like 2 (T-cell specific, HMG-box)
  Uniprot ID: Q9NQB0
  ENSP ID: ENSP00000446172
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITGEKKSAFATYKVKAAASAHPLQMEAY

SEQ ID NO: 89829 - protein, 579 aa, Homo sapiens
  Payload ID: 17971
  Gene Name: transcription factor 7-like 2 (T-cell specific, HMG-box)
  ENSP ID: ENSP00000446238
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNDLSAPKKCRARFGLDQQNNWCGPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 89830 - protein, 602 aa, Homo sapiens
  Payload ID: 17971
  Gene Name: transcription factor 7-like 2 (T-cell specific, HMG-box)
  Uniprot ID: Q9NQB0
  ENSP ID: ENSP00000486891
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNDANTPKKCRALFGLDRQTLWCKPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 89831 - protein, 584 aa, Homo sapiens
  Payload ID: 17971
  Gene Name: transcription factor 7-like 2 (T-cell specific, HMG-box)
  ENSP ID: ENSP00000487507
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSSFLSSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNDANTPKKCRALFGLDRQTLWCKPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 89832 - protein, 214 aa, Homo sapiens
  Payload ID: 17972
  Gene Name: transcription factor A, mitochondrial
  Uniprot ID: Q00059
  ENSP ID: ENSP00000363002
MAFLRSMWGVLSALGRSGAELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKEKLKTVKENWKNLSDSEKELYIQHAKEDETRYHNEMKSWEEQMIEVGRKDLLRRTIKKQRKYGAEEC

SEQ ID NO: 89833 - protein, 219 aa, Homo sapiens
  Payload ID: 17972
  Gene Name: transcription factor A, mitochondrial
  ENSP ID: ENSP00000378776
  MOD_RES (1)..(1): Any amino acid
XELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNVYVAERFQEAKGDSPQEKLKTVKENWKNLSDSEKEVSITVVSLKCLLRISVRECIRARLDSCEDNLVLLIIQVF

SEQ ID NO: 89834 - protein, 246 aa, Homo sapiens
  Payload ID: 17972
  Gene Name: transcription factor A, mitochondrial
  Uniprot ID: Q00059
  ENSP ID: ENSP00000420588
MAFLRSMWGVLSALGRSGAELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNVYVAERFQEAKGDSPQEKLKTVKENWKNLSDSEKELYIQHAKEDETRYHNEMKSWEEQMIEVGRKDLLRRTIKKQRKYGAEEC

SEQ ID NO: 89835 - protein, 433 aa, Homo sapiens
  Payload ID: 17973
  Gene Name: transcription factor AP-2 alpha (activating enhancer binding protein 2 alpha)
  Uniprot ID: P05549
  ENSP ID: ENSP00000316516
MSILAKMGDWQDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 89836 - protein, 431 aa, Homo sapiens
  Payload ID: 17973
  Gene Name: transcription factor AP-2 alpha (activating enhancer binding protein 2 alpha)
  Uniprot ID: P05549
  ENSP ID: ENSP00000368928
MLVHSFSAMDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 89837 - protein, 439 aa, Homo sapiens
  Payload ID: 17973
  Gene Name: transcription factor AP-2 alpha (activating enhancer binding protein 2 alpha)
  ENSP ID: ENSP00000368933
MKMLWKLTDNIKYEDCEDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 89838 - protein, 328 aa, Homo sapiens
  Payload ID: 17973
  Gene Name: transcription factor AP-2 alpha (activating enhancer binding protein 2 alpha)
  ENSP ID: ENSP00000417495
MLWKLTDNIKYEDCEDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEDRYAKSSPTCWLRTDLPWGTHGPTPSWSPASRAA

SEQ ID NO: 89839 - protein, 81 aa, Homo sapiens
  Payload ID: 17973
  Gene Name: transcription factor AP-2 alpha (activating enhancer binding protein 2 alpha)
  ENSP ID: ENSP00000417735
  MOD_RES (1)..(1): Any amino acid
XYKVTVAEVQRRLSPPECLNASLLGGVLRRAKSKNGGRSLREKLDKIGLNLPAGRRKAANVTLLTSLVEGAEMAAVLRQEY

SEQ ID NO: 89840 - protein, 173 aa, Homo sapiens
  Payload ID: 17973
  Gene Name: transcription factor AP-2 alpha (activating enhancer binding protein 2 alpha)
  ENSP ID: ENSP00000418391
MEEPRSSGQPSPESQTRLRSGGARGQTGPGSACRAESPTSARTRSQAAPTRYARPPLHPEDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYR

SEQ ID NO: 89841 - protein, 437 aa, Homo sapiens
  Payload ID: 17973
  Gene Name: transcription factor AP-2 alpha (activating enhancer binding protein 2 alpha)
  Uniprot ID: P05549
  ENSP ID: ENSP00000418541
MLWKLTDNIKYEDCEDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 89842 - protein, 218 aa, Homo sapiens
  Payload ID: 17973
  Gene Name: transcription factor AP-2 alpha (activating enhancer binding protein 2 alpha)
  ENSP ID: ENSP00000419696
  MOD_RES (1)..(1): Any amino acid
XPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEVVIFPDKCIHQILQRRK

SEQ ID NO: 89843 - protein, 121 aa, Homo sapiens
  Payload ID: 17973
  Gene Name: transcription factor AP-2 alpha (activating enhancer binding protein 2 alpha)
  ENSP ID: ENSP00000419823
MKMLWKLTDNIKYEDCEDRHDGTSNGTARLPQLGTPEPPARPAAAAAPRLARPEAEPGVWAPAHAPGAASPAVGPGSSQGLQAARGPPARPTRAQLRTRRPLDPLLTSRHRGGPACRRPGY

SEQ ID NO: 89844 - protein, 136 aa, Homo sapiens
  Payload ID: 17973
  Gene Name: transcription factor AP-2 alpha (activating enhancer binding protein 2 alpha)
  ENSP ID: ENSP00000419961
MKMLWKLTDNIKYEDCEHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAG

SEQ ID NO: 89845 - protein, 113 aa, Homo sapiens
  Payload ID: 17973
  Gene Name: transcription factor AP-2 alpha (activating enhancer binding protein 2 alpha)
  ENSP ID: ENSP00000420568
MLVHSFSAMDRHDGTSNGTARLPQLGTPEPPARPAAAAAPRLARPEAEPGVWAPAHAPGAASPAVGPGSSQGLQAARGPPARPTRAQLRTRRPLDPLLTSRHRGGPACRRPGY

SEQ ID NO: 89846 - protein, 198 aa, Homo sapiens
  Payload ID: 17974
  Gene Name: transcription factor AP-2 beta (activating enhancer binding protein 2 beta)
  ENSP ID: ENSP00000342252
MLWKLVENVKYEDIYEMLVHTYSSMDRHDGVPSHSSRLSQLGSVSQGPYSSAPPLSHTPSSDFQPPYFPPPYQPLPYHQSQDPYSHVNDPYSLNPLHQPQQHPWGQRQRQEVGSEAGSLLPQPRAALPQLSGLDPRRDYHSVRRPDVLLHSAHHGLDAGMGDSLSLHGLGHPGMEDVQSVEDANNSGMNLLDQSVIKK

SEQ ID NO: 89847 - protein, 460 aa, Homo sapiens
  Payload ID: 17974
  Gene Name: transcription factor AP-2 beta (activating enhancer binding protein 2 beta)
  Uniprot ID: Q92481
  ENSP ID: ENSP00000377265
MHSPPRDQAAIMLWKLVENVKYEDIYEDRHDGVPSHSSRLSQLGSVSQGPYSSAPPLSHTPSSDFQPPYFPPPYQPLPYHQSQDPYSHVNDPYSLNPLHQPQQHPWGQRQRQEVGSEAGSLLPQPRAALPQLSGLDPRRDYHSVRRPDVLLHSAHHGLDAGMGDSLSLHGLGHPGMEDVQSVEDANNSGMNLLDQSVIKKVPVPPKSVTSLMMNKDGFLGGMSVNTGEVFCSVPGRLSLLSSTSKYKVTVGEVQRRLSPPECLNASLLGGVLRRAKSKNGGRSLRERLEKIGLNLPAGRRKAANVTLLTSLVEGEAVHLARDFGYICETEFPAKAVSEYLNRQHTDPSDLHSRKNMLLATKQLCKEFTDLLAQDRTPIGNSRPSPILEPGIQSCLTHFSLITHGFGAPAICAALTALQNYLTEALKGMDKMFLNNTTTNRHTSGEGPGSKTGDKEEKHRK

SEQ ID NO: 89848 - protein, 452 aa, Homo sapiens
  Payload ID: 17975
  Gene Name: transcription factor AP-2 delta (activating enhancer binding protein 2 delta)
  Uniprot ID: Q7Z6R9
  ENSP ID: ENSP00000008391
MSTTFPGLVHDAEIRHDGSNSYRLMQLGCLESVANSTVAYSSSSPLTYSTTGTEFASPYFSTNHQYTPLHHQSFHYEFQHSHPAVTPDAYSLNSLHHSQQYYQQIHHGEPTDFINLHNARALKSSCLDEQRRELGCLDAYRRHDLSLMSHGSQYGMHPDQRLLPGPSLGLAAAGADDLQGSVEAQCGLVLNGQGGVIRRGGTCVVNPTDLFCSVPGRLSLLSSTSKYKVTIAEVKRRLSPPECLNASLLGGILRRAKSKNGGRCLREKLDRLGLNLPAGRRKAANVTLLTSLVEGEALHLARDFGYTCETEFPAKAVGEHLARQHMEQKEQTARKKMILATKQICKEFQDLLSQDRSPLGSSRPTPILDLDIQRHLTHFSLITHGFGTPAICAALSTFQTVLSEMLNYLEKHTTHKNGGAADSGQGHANSEKAPLRKTSEAAVKEGKTEKTD

SEQ ID NO: 89849 - protein, 442 aa, Homo sapiens
  Payload ID: 17976
  Gene Name: transcription factor AP-2 epsilon (activating enhancer binding protein 2 epsilon)
  Uniprot ID: Q6VUC0
  ENSP ID: ENSP00000362332
MLVHTYSAMERPDGLGAAAGGARLSSLPQAAYGPAPPLCHTPAATAAAEFQPPYFPPPYPQPPLPYGQAPDAAAAFPHLAGDPYGGLAPLAQPQPPQAAWAAPRAAARAHEEPPGLLAPPARALGLDPRRDYATAVPRLLHGLADGAHGLADAPLGLPGLAAAPGLEDLQAMDEPGMSLLDQSVIKKVPIPSKASSLSALSLAKDSLVGGITNPGEVFCSVPGRLSLLSSTSKYKVTVGEVQRRLSPPECLNASLLGGVLRRAKSKNGGRCLRERLEKIGLNLPAGRRKAANVTLLTSLVEGEAVHLARDFGYVCETEFPAKAAAEYLCRQHADPGELHSRKSMLLAAKQICKEFADLMAQDRSPLGNSRPALILEPGVQSCLTHFSLITHGFGGPAICAALTAFQNYLLESLKGLDKMFLSSVGSGHGETKASEKDAKHRK

SEQ ID NO: 89850 - protein, 450 aa, Homo sapiens
  Payload ID: 17977
  Gene Name: transcription factor AP-2 gamma (activating enhancer binding protein 2 gamma)
  Uniprot ID: Q92754
  ENSP ID: ENSP00000201031
MLWKITDNVKYEEDCEDRHDGSSNGNPRVPHLSSAGQHLYSPAPPLSHTGVAEYQPPPYFPPPYQQLAYSQSADPYSHLGEAYAAAINPLHQPAPTGSQQQAWPGRQSQEGAGLPSHHGRPAGLLPHLSGLEAGAVSARRDAYRRSDLLLPHAHALDAAGLAENLGLHDMPHQMDEVQNVDDQHLLLHDQTVIRKGPISMTKNPLNLPCQKELVGAVMNPTEVFCSVPGRLSLLSSTSKYKVTVAEVQRRLSPPECLNASLLGGVLRRAKSKNGGRSLREKLDKIGLNLPAGRRKAAHVTLLTSLVEGEAVHLARDFAYVCEAEFPSKPVAEYLTRPHLGGRNEMAARKNMLLAAQQLCKEFTELLSQDRTPHGTSRLAPVLETNIQNCLSHFSLITHGFGSQAICAAVSALQNYIKEALIVIDKSYMNPGDQSPADSNKTLEKMEKHRK

SEQ ID NO: 89851 - protein, 118 aa, Homo sapiens
  Payload ID: 17977
  Gene Name: transcription factor AP-2 gamma (activating enhancer binding protein 2 gamma)
  ENSP ID: ENSP00000390857
MFLQDRHDGSSNGNPRVPHLSSAGQHLYSPAPPLSHTGVAEYQPPPYFPPPYQQLAYSQSADPYSHLGEAYAAAINPLHQPAPTGSQQQAWPGRQSQEGAGLPSHHGRPAGLLPHLSG

SEQ ID NO: 89852 - protein, 338 aa, Homo sapiens
  Payload ID: 17978
  Gene Name: transcription factor AP-4 (activating enhancer binding protein 4)
  Uniprot ID: Q01664
  ENSP ID: ENSP00000204517
MEYFMVPTQKVPSLQHFRKTEKEVIGGLCSLANIPLTPETQRDQERRIRREIANSNERRRMQSINAGFQSLKTLIPHTDGEKLSKAAILQQTAEYIFSLEQEKTRLLQQNTQLKRFIQELSGSSPKRRRAEDKDEGIGSPDIWEDEKAEDLRREMIELRQQLDKERSVRMMLEEQVRSLEAHMYPEKLKVIAQQVQLQQQQEQVRLLHQEKLEREQQQLRTQLLPPPAPTHHPTVIVPAPPPPPSHHINVVTMGPSSVINSVSTSRQNLDTIVQAIQHIEGTQEKQELEEEQRRAVIVKPVRSCPEAPTSDTASDSEASDSDAMDQSREEPSGDGELP

SEQ ID NO: 89853 - protein, 115 aa, Homo sapiens
  Payload ID: 17978
  Gene Name: transcription factor AP-4 (activating enhancer binding protein 4)
  ENSP ID: ENSP00000459390
MQSINAGFQSLKTLIPHTDGEKLSKAAILQQTAEYIFSLEQEKTRLLQQNTQLKRFIQELSGSSPKRRRAEDKDEGIGSPDIWEDEKAEDLRREMIELRQQLDKERSVRMMLEEQ

SEQ ID NO: 89854 - protein, 167 aa, Homo sapiens
  Payload ID: 17978
  Gene Name: transcription factor AP-4 (activating enhancer binding protein 4)
  ENSP ID: ENSP00000460067
MEYFMVPTQKVPSLQHFRKTEKEVIGGLCRRRKPRLGVAQLPCQHSTNPRDSAGPGAADSAGDRQQQRAETHAEHQRGIPVPQDPHPPHRRREAQQGSHSPADSRVHLLPGAGEDQALAAEHTAQALHPGAERLVPQATAGRGQGRRHRLPGHLGGREGGGPAAGDD

SEQ ID NO: 89855 - protein, 44 aa, Homo sapiens
  Payload ID: 17978
  Gene Name: transcription factor AP-4 (activating enhancer binding protein 4)
  ENSP ID: ENSP00000461352
MEYFMVPTQKVPSLQHFRKTEKEVIGGLCRCARWRPTCTRKSSR

SEQ ID NO: 89856 - protein, 346 aa, Homo sapiens
  Payload ID: 17979
  Gene Name: transcription factor B1, mitochondrial
  Uniprot ID: Q8WVM0
  ENSP ID: ENSP00000356134
MAASGKLSTCRLPPLPTIREIIKLLRLQAAKQLSQNFLLDLRLTDKIVRKAGNLTNAYVYEVGPGPGGITRSILNADVAELLVVEKDTRFIPGLQMLSDAAPGKLRIVHGDVLTFKVEKAFSESLKRPWEDDPPNVHIIGNLPFSVSTPLIIKWLENISCRDGPFVYGRTQMTLTFQKEVAERLAANTGSKQRSRLSVMAQYLCNVRHIFTIPGQAFVPKPEVDVGVVHFTPLIQPKIEQPFKLVEKVVQNVFQFRRKYCHRGLRMLFPEAQRLESTGRLLELADIDPTLRPRQLSISHFKSLCDVYRKMCDEDPQLFAYNFREELKRRKSKNEEKEEDDAENYRL

SEQ ID NO: 89857 - protein, 396 aa, Homo sapiens
  Payload ID: 17980
  Gene Name: transcription factor B2, mitochondrial
  Uniprot ID: Q9H5Q4
  ENSP ID: ENSP00000355471
MWIPVVGLPRRLRLSALAGAGRFCILGSEAATRKHLPARNHCGLSDSSPQLWPEPDFRNPPRKASKASLDFKRYVTDRRLAETLAQIYLGKPSRPPHLLLECNPGPGILTQALLEAGAKVVALESDKTFIPHLESLGKNLDGKLRVIHCDFFKLDPRSGGVIKPPAMSSRGLFKNLGIEAVPWTADIPLKVVGMFPSRGEKRALWKLAYDLYSCTSIYKFGRIEVNMFIGEKEFQKLMADPGNPDLYHVLSVIWQLACEIKVLHMEPWSSFDIYTRKGPLENPKRRELLDQLQQKLYLIQMIPRQNLFTKNLTPMNYNIFFHLLKHCFGRRSATVIDHLRSLTPLDARDILMQIGKQEDEKVVNMHPQDFKTLFETIERSKDCAYKWLYDETLEDR

SEQ ID NO: 89858 - protein, 575 aa, Homo sapiens
  Payload ID: 17981
  Gene Name: transcription factor binding to IGHM enhancer 3
  Uniprot ID: P19532
  ENSP ID: ENSP00000314129
MSHAAEPARDGVEASAEGPRAVFVLLEERRPADSAQLLSLNSLLPESGIVADIELENVLDPDSFYELKSQPLPLRSSLPISLQATPATPATLSASSSAGGSRTPAMSSSSSSRVLLRQQLMRAQAQEQERRERREQAAAAPFPSPAPASPAISVVGVSAGGHTLSRPPPAQVPREVLKVQTHLENPTRYHLQQARRQQVKQYLSTTLGPKLASQALTPPPGPASAQPLPAPEAAHTTGPTGSAPNSPMALLTIGSSSEKEIDDVIDEIISLESSYNDEMLSYLPGGTTGLQLPSTLPVSGNLLDVYSSQGVATPAITVSNSCPAELPNIKREISETEAKALLKERQKKDNHNLIERRRRFNINDRIKELGTLIPKSSDPEMRWNKGTILKASVDYIRKLQKEQQRSKDLESRQRSLEQANRSLQLRIQELELQAQIHGLPVPPTPGLLSLATTSASDSLKPEQLDIEEEGRPGAATFHVGGGPAQNAPHQQPPAPPSDALLDLHFPSDHLGDLGDPFHLGLEDILMEEEEGVVGGLSGGALSPLRAASDPLLSSVSPAVSKASSRRSSFSMEEES

SEQ ID NO: 89859 - protein, 109 aa, Homo sapiens
  Payload ID: 17981
  Gene Name: transcription factor binding to IGHM enhancer 3
  Uniprot ID: P19532
  ENSP ID: ENSP00000476976
MSHAAEPARDGVEASAEGPRAVFVLLEERRPADSAQLLSLNSLLPESGIVADIELENVLDPDSFYELKSQPLPLRSRGLQDPCHVVIFFIEGLAAAAANAGPGAGAGEA

SEQ ID NO: 89860 - protein, 502 aa, Homo sapiens
  Payload ID: 17982
  Gene Name: transcription factor CP2
  Uniprot ID: Q12800
  ENSP ID: ENSP00000257915
MAWALKLPLADEVIESGLVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQVHCISTEFTMRKHGGEKGVPFRVQIDTFKENENGEYTEHLHSASCQIKVFKPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRDDVIQICGPADGIRLFNALKGRMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKAETNDSYHIILK

SEQ ID NO: 89861 - protein, 450 aa, Homo sapiens
  Payload ID: 17982
  Gene Name: transcription factor CP2
  Uniprot ID: Q12800
  ENSP ID: ENSP00000447991
MAWALKLPLADEVIESGLVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRDDVIQICGPADGIRLFNALKGRMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKETNDSYHIILK

SEQ ID NO: 89862 - protein, 381 aa, Homo sapiens
  Payload ID: 17982
  Gene Name: transcription factor CP2
  ENSP ID: ENSP00000449280
MLDNRKLGELPEINGKLVKSIFRVVFHDRRLQYTEHQQLEGWRWNRPGDRILDIDIPMSVGIIDPRANPTQLNTVEFLWDPAKRTSVFIQVHCISTEFTMRKHGGEKGVPFRVQIDTFKENENGEYTEHLHSASCQIKVFKPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRDDVIQICGPADGIRLFNALKGRMVRPRLTIYVCQESLQLREQQQQQQQQQQKHEDGDSNGTFFVYHAIYLEELTAVELTEKIAQLFSISPCQISQIYKQGPTGIHVLISDEMIQNFQ

SEQ ID NO: 89863 - protein, 424 aa, Homo sapiens
  Payload ID: 17982
  Gene Name: transcription factor CP2
  ENSP ID: ENSP00000449742
MAWALKLPLADEVIESGLVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQVHCISTEFTMRKHGGEKGVPFRVQIDTFKENENGEYTEHLHSASCQIKVFKPKGADRKQKTDREKMEKRTPHEKEKYQPSYETTILTECSPWPEITYVNNSPSPGFNSSHSSFSLGEGMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKAETNDSYHIILK

SEQ ID NO: 89864 - protein, 479 aa, Homo sapiens
  Payload ID: 17983
  Gene Name: transcription factor CP2-like 1
  Uniprot ID: Q9NZI6
  ENSP ID: ENSP00000263707
MLFWHTQPEHYNQHNSGSYLRDVLALPIFKQEEPQLSPENEARLPPLQYVLCAATSPAVKLHEETLTYLNQGQSYEIRLLENRKLGDFQDLNTKYVKSIIRVVFHDRRLQYTEHQQLEGWRWSRPGDRILDIDIPLSVGILDPRASPTQLNAVEFLWDPAKRASAFIQVHCISTEFTPRKHGGEKGVPFRVQIDTFKQNENGEYTEHLHSASCQIKVFKPKGADRKQKTDREKMEKRTAQEKEKYQPSYETTILTECSPWPDVAYQVNSAPSPSYNGSPNSFGLGEGNASPTHPVEALPVGSDHLLPSASIQDAQQWLHRNRFSQFCRLFASFSGADLLKMSRDDLVQICGPADGIRLFNAIKGRNVRPKMTIYVCQELEQNRVPLQQKRDGSGDSNLSVYHAIFLEELTTLELIEKIANLYSISPQHIHRVYRQGPTGIHVVVSNEMVQNFQDESCFVLSTIKAESNDGYHIILKCGL

SEQ ID NO: 89865 - protein, 405 aa, Homo sapiens
  Payload ID: 17984
  Gene Name: transcription factor Dp family, member 3
  Uniprot ID: Q5H9I0
  ENSP ID: ENSP00000385461
MAKYVSLTEANEELKVLMDENQTSRPVAVHTSTVNPLGKQLLPKTFGQSSVNIDQQVVIGMPQRPAASNIPVVGSPNPPSTHFASQNQHSYSSPPWAGQHNRKGEKNGMGLCRLSMKVWETVQRKGTTSCQEVVGELVAKFRAASNHASPNESAYDVKNIKRRTYDALNVLMAMNIISREKKKIKWIGLTTNSAQNCQNLRVERQKRLERIKQKQSELQQLILQQIAFKNLVLRNQYVEEQVSQRPLPNSVIHVPFIIISSSKKTVINCSISDDKSEYLFKFNSSFEIHDDTEVLMWMGMTFGLESGSCSAEDLKMARNLVPKALEPYVTEMAQGTFGGVFTTAGSRSNGTWLSASDLTNIAIGMLATSSGGSQYSGSRVETPAVEEEEEEDNNDDDLSENDEDD

SEQ ID NO: 89866 - protein, 410 aa, Homo sapiens
  Payload ID: 17985
  Gene Name: transcription factor Dp-1
  Uniprot ID: Q14186
  ENSP ID: ENSP00000364519
MAKDAGLIEANGELKVFIDQNLSPGKGVVSLVAVHPSTVNPLGKQLLPKTFGQSNVNIAQQVVIGTPQRPAASNTLVVGSPHTPSTHFASQNQPSDSSPWSAGKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLQELILQQIAFKNLVQRNRHAEQQASRPPPPNSVIHLPFIIVNTSKKTVIDCSISNDKFEYLFNFDNTFEIHDDIEVLKRMGMACGLESGSCSAEDLKMARSLVPKALEPYVTEMAQGTVGGVFITTAGSTSNGTRFSASDLTNGADGMLATSSNGSQYSGSRVETPVSYVGEDDEEDDDFNENDEDD

SEQ ID NO: 89867 - protein, 235 aa, Homo sapiens
  Payload ID: 17985
  Gene Name: transcription factor Dp-1
  ENSP ID: ENSP00000386145
MAKDAGLIEANGELKVFIDQNLSPGKGVVSLVAVHPSTVNPLGKQLLPKTFGQSNVNIAQQVVIGTPQRPAASNTLVVGSPHTPSTHFASQNQPSDSSPWSAGKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLQELILQQIAFKN

SEQ ID NO: 89868 - protein, 158 aa, Homo sapiens
  Payload ID: 17985
  Gene Name: transcription factor Dp-1
  ENSP ID: ENSP00000401389
MAKDAGLIEANGELKVFIDQNLSPGKGVVSLVAVHPSTVNPLGKQLLPKTFGQSNVNIAQQVVIGTPQRPAASNTLVVGSPHTPSTHFASQNQPSDSSPWSAGKRNRKGEKNGKGLRHFSMKVCEKVQRKGTTSYNEVADELVAEFSAADNHILPNES

SEQ ID NO: 89869 - protein, 119 aa, Homo sapiens
  Payload ID: 17985
  Gene Name: transcription factor Dp-1
  ENSP ID: ENSP00000438450
MAKDAGLIEANGELKVFIDQNLSPGKGVVSLVAVHPSTVNPLGKQLLPKTFGQSNVNIAQQVEAQQERREEWQGPTAFLHEGLREGAEERDHFLQRSGRRAGCGVQCCRQPHLTKRVSL

SEQ ID NO: 89870 - protein, 46 aa, Homo sapiens
  Payload ID: 17986
  Gene Name: transcription factor Dp-2 (E2F dimerization partner 2)
  ENSP ID: ENSP00000417108
MIISTPQRLTSSGSVLIGSPYTPAPAMVTQTHIAEATGWVPGDRKR

SEQ ID NO: 89871 - protein, 220 aa, Homo sapiens
  Payload ID: 17986
  Gene Name: transcription factor Dp-2 (E2F dimerization partner 2)
  ENSP ID: ENSP00000417220
MIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINT

SEQ ID NO: 89872 - protein, 70 aa, Homo sapiens
  Payload ID: 17986
  Gene Name: transcription factor Dp-2 (E2F dimerization partner 2)
  ENSP ID: ENSP00000417384
MTAKNVGLTSTNAEVRGFIDQNLSPTKGNISFVAFPVSNTNSPTKILPKTLGPINVNVGPQMDATRRHHL

SEQ ID NO: 89873 - protein, 385 aa, Homo sapiens
  Payload ID: 17986
  Gene Name: transcription factor Dp-2 (E2F dimerization partner 2)
  Uniprot ID: Q14188
  ENSP ID: ENSP00000417585
MIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 89874 - protein, 248 aa, Homo sapiens
  Payload ID: 17986
  Gene Name: transcription factor Dp-2 (E2F dimerization partner 2)
  ENSP ID: ENSP00000417726
MIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSQAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEI

SEQ ID NO: 89875 - protein, 206 aa, Homo sapiens
  Payload ID: 17986
  Gene Name: transcription factor Dp-2 (E2F dimerization partner 2)
  ENSP ID: ENSP00000418122
MVTQTHIAEATGWVPGDRKRARKFIDSDFSESKRSKKGDKNGKGLRHFSMKVCEKVQRKGTTSYNEVADELVSEFTNSNNHLAADSQAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSIS

SEQ ID NO: 89876 - protein, 386 aa, Homo sapiens
  Payload ID: 17986
  Gene Name: transcription factor Dp-2 (E2F dimerization partner 2)
  Uniprot ID: Q14188
  ENSP ID: ENSP00000418590
MIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSQAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 89877 - protein, 310 aa, Homo sapiens
  Payload ID: 17986
  Gene Name: transcription factor Dp-2 (E2F dimerization partner 2)
  Uniprot ID: Q14188
  ENSP ID: ENSP00000418971
MKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 89878 - protein, 349 aa, Homo sapiens
  Payload ID: 17986
  Gene Name: transcription factor Dp-2 (E2F dimerization partner 2)
  Uniprot ID: Q14188
  ENSP ID: ENSP00000419036
MLDPKCDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 89879 - protein, 114 aa, Homo sapiens
  Payload ID: 17986
  Gene Name: transcription factor Dp-2 (E2F dimerization partner 2)
  ENSP ID: ENSP00000419507
  MOD_RES (1)..(1): Any amino acid
XDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSRYVFFSGLERQTPEP

SEQ ID NO: 89880 - protein, 85 aa, Homo sapiens
  Payload ID: 17986
  Gene Name: transcription factor Dp-2 (E2F dimerization partner 2)
  ENSP ID: ENSP00000419540
MTAKNVGLTSTNAEVRGFIDQNLSPTKGNISFVAFPVSNTNSPTKILPKTLGPINVNVGPQMIISTPQRLTSSGSVLIGSPYTPA

SEQ ID NO: 89881 - protein, 89 aa, Homo sapiens
  Payload ID: 17986
  Gene Name: transcription factor Dp-2 (E2F dimerization partner 2)
  ENSP ID: ENSP00000420456
MIISTPQRLTSSGSVLIGSPYTPAPAMVTQTHIAEATGWVPGDRKRARKFIDSDFSESKRSKKGDKNGKGLRHFSMKVCEKVQRKGTTS

SEQ ID NO: 89882 - protein, 386 aa, Homo sapiens; identical to SEQ ID NO: 89876
  Payload ID: 17986
  Gene Name: transcription factor Dp-2 (E2F dimerization partner 2)
  Uniprot ID: Q14188
  ENSP ID: ENSP00000420599

SEQ ID NO: 89883 - protein, 446 aa, Homo sapiens
  Payload ID: 17986
  Gene Name: transcription factor Dp-2 (E2F dimerization partner 2)
  Uniprot ID: Q14188
  ENSP ID: ENSP00000420616
MTAKNVGLTSTNAEVRGFIDQNLSPTKGNISFVAFPVSNTNSPTKILPKTLGPINVNVGPQMIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 89884 - protein, 27 aa, Homo sapiens
  Payload ID: 17986
  Gene Name: transcription factor Dp-2 (E2F dimerization partner 2)
  ENSP ID: ENSP00000420657
MIISTPQRLTSSGSVLIGSPYTPAPAM

SEQ ID NO: 89885 - protein, 418 aa, Homo sapiens
  Payload ID: 17986
  Gene Name: transcription factor Dp-2 (E2F dimerization partner 2)
  Uniprot ID: Q14188
  ENSP ID: ENSP00000439782
MQPEGIIFEAENKPSPGTESAGTFILDLSATSRTIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 89886 - protein, 67 aa, Homo sapiens
  Payload ID: 17986
  Gene Name: transcription factor Dp-2 (E2F dimerization partner 2)
  ENSP ID: ENSP00000473436
  MOD_RES (1)..(1): Any amino acid
XDRKRARKFIDSDFSERAETWRTDPRETTACFSWFKNFSMPQNRFSSYWHLYLWEERETRLAACLSA

SEQ ID NO: 89887 - protein, 476 aa, Homo sapiens
  Payload ID: 17987
  Gene Name: transcription factor EB
  Uniprot ID: P19484
  ENSP ID: ENSP00000230323
MASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 89888 - protein, 562 aa, Homo sapiens
  Payload ID: 17987
  Gene Name: transcription factor EB
  ENSP ID: ENSP00000343948
MSEEDRTFSFGPGTRKLGFMSQLSPACSVTLGKSLPLSGLGVFSSKMDAVPVILASPCQPLCFEEDTCLIYLLPLLIHREPAPAATMASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 89889 - protein, 490 aa, Homo sapiens
  Payload ID: 17987
  Gene Name: transcription factor EB
  ENSP ID: ENSP00000351742
MTASSGWEPAPAATMASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 89890 - protein, 476 aa, Homo sapiens; identical to SEQ ID NO: 89887
  Payload ID: 17987
  Gene Name: transcription factor EB
  Uniprot ID: P19484
  ENSP ID: ENSP00000362124

SEQ ID NO: 89891 - protein, 268 aa, Homo sapiens
  Payload ID: 17987
  Gene Name: transcription factor EB
  ENSP ID: ENSP00000377824
MASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDL

SEQ ID NO: 89892 - protein, 334 aa, Homo sapiens
  Payload ID: 17987
  Gene Name: transcription factor EB
  ENSP ID: ENSP00000383998
HFQSPPPVPGEVLKLDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 89893 - protein, 476 aa, Homo sapiens; identical to SEQ ID NO: 89887
  Payload ID: 17987
  Gene Name: transcription factor EB
  Uniprot ID: P19484
  ENSP ID: ENSP00000384203

SEQ ID NO: 89894 - protein, 71 aa, Homo sapiens
  Payload ID: 17987
  Gene Name: transcription factor EB
  ENSP ID: ENSP00000393874
MASRIGLRMQLMREQAQQEEQRERMQQQAVMHYMQQQQQQQQQQLGGPPTPAINTPVHFQSPPPVPGEVLK

SEQ ID NO: 89895 - protein, 12 aa, Homo sapiens
  Payload ID: 17987
  Gene Name: transcription factor EB
  ENSP ID: ENSP00000395208
MASRIGLRMQLM

SEQ ID NO: 89896 - protein, 79 aa, Homo sapiens
  Payload ID: 17987
  Gene Name: transcription factor EB
  ENSP ID: ENSP00000396168
MASRIGLRMQLMREQAQQEEQRERMQQQAVMHYMQQQQQQQQQQLGGPPTPAINTPVHFQSPPPVPGEVLKVQSYLENP

SEQ ID NO: 89897 - protein, 222 aa, Homo sapiens
  Payload ID: 17987
  Gene Name: transcription factor EB
  ENSP ID: ENSP00000400276
MASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKREL

SEQ ID NO: 89898 - protein, 244 aa, Homo sapiens
  Payload ID: 17987
  Gene Name: transcription factor EB
  ENSP ID: ENSP00000406491
MASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIE

SEQ ID NO: 89899 - protein, 267 aa, Homo sapiens
  Payload ID: 17987
  Gene Name: transcription factor EB
  ENSP ID: ENSP00000410391
MASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKAND

SEQ ID NO: 89900 - protein, 391 aa, Homo sapiens
  Payload ID: 17987
  Gene Name: transcription factor EB
  Uniprot ID: P19484
  ENSP ID: ENSP00000412551
MASRIGLRMQLMREQAQQEEQRERMQQQAVMHYMQQQQQQQQQQLGGPPTPAINTPVHFQSPPPVPGEVLKLDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 89901 - protein, 32 aa, Homo sapiens
  Payload ID: 17987
  Gene Name: transcription factor EB
  ENSP ID: ENSP00000415035
MASRIGLRMQLMREQAQQEEQRERMQQQAVMH

SEQ ID NO: 89902 - protein, 12 aa, Homo sapiens
  Payload ID: 17987
  Gene Name: transcription factor EB
  ENSP ID: ENSP00000415946
MASRIGLRMQLM

SEQ ID NO: 89903 - protein, 347 aa, Homo sapiens
  Payload ID: 17988
  Gene Name: transcription factor EC
  Uniprot ID: O14948
  ENSP ID: ENSP00000265440
MTLDHQIINPTLKWSQPAVPSGGPLVQHAHTTLDSDAGLTENPLTKLLAIGKEDDNAQWHMEDVIEDIIGMESSFKEEGADSPLLMQRTLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQELEIQARTHGLPTLASLGTVDLGAHVTKQQSHPEQNSVDYCQQLTVSQGPSPELCDQAIAFSDPLSYFTDLSFSAALKEEQRLDGMLLDDTISPFGTDPLLSATSPAVSKESSRRSSFSSDDGDEL

SEQ ID NO: 89904 - protein, 318 aa, Homo sapiens
  Payload ID: 17988
  Gene Name: transcription factor EC
  Uniprot ID: O14948
  ENSP ID: ENSP00000318676
MTLDHQIINPTLKWSQPAVPSGGPLVQHAHTTLDSDAGLTENPLTKLLAIGKEDDNAQWHLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQELEIQARTHGLPTLASLGTVDLGAHVTKQQSHPEQNSVDYCQQLTVSQGPSPELCDQAIAFSDPLSYFTDLSFSAALKEEQRLDGMLLDDTISPFGTDPLLSATSPAVSKESSRRSSFSSDDGDEL

SEQ ID NO: 89905 - protein, 197 aa, Homo sapiens
  Payload ID: 17988
  Gene Name: transcription factor EC
  Uniprot ID: O14948
  ENSP ID: ENSP00000377125
MTLDHQIINPTLKWSQPAVPSGGPLVQHAHTTLDSDAGLTENPLTKLLAIGKEDDNAQWHLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQVFIRM

SEQ ID NO: 89906 - protein, 280 aa, Homo sapiens
  Payload ID: 17988
  Gene Name: transcription factor EC
  Uniprot ID: O14948
  ENSP ID: ENSP00000387650
MMKEKEKTIAIVKVIDTSKLKLLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQELEIQARTHGLPTLASLGTVDLGAHVTKQQSHPEQNSVDYCQQLTVSQGPSPELCDQAIAFSDPLSYFTDLSFSAALKEEQRLDGMLLDDTISPFGTDPLLSATSPAVSKESSRRSSFSSDDGDEL

SEQ ID NO: 89907 - protein, 316 aa, Homo sapiens
  Payload ID: 17988
  Gene Name: transcription factor EC
  ENSP ID: ENSP00000417432
MLQALTGLQFQLKEQLGEKERRLQISQEISAHRTEFHMQFSYKPVLHRLVPARPQIYSSQLPSFTRVPAHLESSARPQLQKAQRQKVNSFMTLDHQIINPTLKWSQPAVPSGGPLVQHAHTTLDSDAGLTENPLTKLLAIGKEDDNAQWHMEDVIEDIIGMESSFKEEGADSPLLMQRTLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQVFIRM

SEQ ID NO: 89908 - protein, 483 aa, Homo sapiens
  Payload ID: 17989
  Gene Name: transcription factor-like 5 (basic helix-loop-helix)
  ENSP ID: ENSP00000217162
MTEVEYTQLQHILCSHMEAAADGELETRLNSALLAAAGPGAGAGGFAAGGQGGAAPVYPVLCPSALAADAPCLGHIDFQELRMMLLSEAGAAEKTSGGGDGARARADGAAKEGAGAAAAAAGPDGAPEARAKPAVRVRLEDRFNSIPAEPPPAPRGPEPPEPGGALNNLVTLIRHPSELMNVPLQQQNKCTALVKNKTAATTTALQFTYPLFTTNACSTSGNSNLSQTQSSSNSCSVLEAAKHQDIGLPRAFSFCYQQEIESTKQTLGSRNKVLPEQVWIKVGEAALCKQALKRNRSRMRQLDTNVERRALGEIQNVGEGATATQGAWQSSESSQANLGEQAQSGPQGGRSQRRERHNRMERDRRRRIRICCDELNLLVPFCNAETDKATTLQWTTAFLKYIQERHGDSLKKVLSTNSRYVMLWTCFLKMKSAVDGKNPQHAYRTANHKWLCLHEARSFAFEVSIWAHFQLFRVRIPEGFLSI

SEQ ID NO: 89909 - protein, 500 aa, Homo sapiens
  Payload ID: 17989
  Gene Name: transcription factor-like 5 (basic helix-loop-helix)
  Uniprot ID: Q9UL49
  ENSP ID: ENSP00000334294
MSGPGPREPPPEAGAAGGEAAVEGAGGGDAALGEPGLSFTTTDLSLVEMTEVEYTQLQHILCSHMEAAADGELETRLNSALLAAAGPGAGAGGFAAGGQGGAAPVYPVLCPSALAADAPCLGHIDFQELRMMLLSEAGAAEKTSGGGDGARARADGAAKEGAGAAAAAAGPDGAPEARAKPAVRVRLEDRFNSIPAEPPPAPRGPEPPEPGGALNNLVTLIRHPSELMNVPLQQQNKCTALVKNKTAATTTALQFTYPLFTTNACSTSGNSNLSQTQSSSNSCSVLEAAKHQDIGLPRAFSFCYQQEIESTKQTLGSRNKVLPEQVWIKVGEAALCKQALKRNRSRMRQLDTNVERRALGEIQNVGEGATATQGAWQSSESSQANLGEQAQSGPQGGRSQRRERHNRMERDRRRRIRICCDELNLLVPFCNAETDKATTLQWTTAFLKYIQERHGDSLKKEFESVFCGKTGRRLKLTRPDSLVTCPAQGSLQSSPSMEIK

SEQ ID NO: 89910 - protein, 905 aa, Homo sapiens
  Payload ID: 17990
  Gene Name: transcription termination factor, RNA polymerase I
  Uniprot ID: Q15361
  ENSP ID: ENSP00000333920
MEGESSRFEIHTPVSDKKKKKCSIHKERPQKHSHEIFRDSSLVNEQSQITRRKKRKKDFQHLISSPLKKSRICDETANATSTLKKRKKRRYSALEVDEEAGVTVVLVDKENINNTPKHFRKDVDVVCVDMSIEQKLPRKPKTDKFQVLAKSHAHKSEALHSKVREKKNKKHQRKAASWESQRARDTLPQSESHQEESWLSVGPGGEITELPASAHKNKSKKKKKKSSNREYETLAMPEGSQAGREAGTDMQESQPTVGLDDETPQLLGPTHKKKSKKKKKKKSNHQEFEALAMPEGSQVGSEVGADMQESRPAVGLHGETAGIPAPAYKNKSKKKKKKSNHQEFEAVAMPESLESAYPEGSQVGSEVGTVEGSTALKGFKESNSTKKKSKKRKLTSVKRARVSGDDFSVPSKNSESTLFDSVEGDGAMMEEGVKSRPRQKKTQACLASKHVQEAPRLEPANEEHNVETAEDSEIRYLSADSGDADDSDADLGSAVKQLQEFIPNIKDRATSTIKRMYRDDLERFKEFKAQGVAIKFGKFSVKENKQLEKNVEDFLALTGIESADKLLYTDRYPEEKSVITNLKRRYSFRLHIGRNIARPWKLIYYRAKKMFDVNNYKGRYSEGDTEKLKMYHSLLGNDWKTIGEMVARSSLSVALKFSQISSQRNRGAWSKSETRKLIKAVEEVILKKMSPQELKEVDSKLQENPESCLSIVREKLYKGISWVEVEAKVQTRNWMQCKSKWTEILTKRMTNGRRIYYGMNALRAKVSLIERLYEINVEDTNEIDWEDLASAIGDVPPSYVQTKFSRLKAVYVPFWQKKTFPEIIDYLYETTLPLLKEKLEKMMEKKGTKIQTPAAPKQVFPFRDIFYYEDDSEGEDIEKESEGQAPCMAHACNSSTLGGQGRWII

SEQ ID NO: 89911 - protein, 390 aa, Homo sapiens
  Payload ID: 17990
  Gene Name: transcription termination factor, RNA polymerase I
  ENSP ID: ENSP00000481441
MYRDDLERFKEFKAQGVAIKFGKFSVKENKQLEKNVEDFLALTGIESADKLLYTDRYPEEKSVITNLKRRYSFRLHIGRNIARPWKLIYYRAKKMFDVNNYKGRYSEGDTEKLKMYHSLLGNDWKTIGEMVARSSLSVALKFSQISSQRNRGAWSKSETRKLIKAVEEVILKKMSPQELKEVDSKLQENPESCLSIVREKLYKGISWVEVEAKVQTRNWMQCKSKWTEILTKRMTNGRRIYYGMNALRAKVSLIERLYEINVEDTNEIDWEDLASAIGDVPPSYVQTKFSRLKAVYVPFWQKKTFPEIIDYLYETTLPLLKEKLEKMMEKKGTKIQTPAAPKQVFPFRDIFYYEDDSEGEDIEKESEGQAPCMAHACNSSTLGGQGRWII

SEQ ID NO: 89912 - protein, 1162 aa, Homo sapiens
  Payload ID: 17991
  Gene Name: transcription termination factor, RNA polymerase II
  Uniprot ID: Q9UNY4
  ENSP ID: ENSP00000358478
MEEVRCPEHGTFCFLKTGVRDGPNKGKSFYVCRADTCSFVRATDIPVSHCLLHEDFVVELQGLLLPQDKKEYRLFFRCIRSKAEGKRWCGSIPWQDPDSKEHSVSNKSQHASETFHHSSNWLRNPFKVLDKNQEPALWKQLIKGEGEEKKADKKQREKGDQLFDQKKEQKPEMMEKDLSSGLVPKKKQSVVQEKKQEEGAEIQCEAETGGTHKRDFSEIKSQQCQGNELTRPSASSQEKSSGKSQDVQRESEPLREKVTQLLPQNVHSHNSISKPQKGGPLNKEYTNWEAKETKAKDGPSIQATQKSLPQGHFQERPETHSVPAPGGPAAQAAPAAPGLSLGEGREAATSSDDEEEDDVVFVSSKPGSPLLFDSTLDLETKENLQFPDRSVQRKVSPASGVSKKVEPSDPVARRVYLTTQLKQKKSTLASVNIQALPDKGQKLIKQIQELEEVLSGLTLSPEQGTNEKSNSQVPQQSHFTKTTTGPPHLVPPQPLPRRGTQPVGSLELKSACQVTAGGSSQCYRGHTNQDHVHAVWKITSEAIGQLHRSLESCPGETVVAEDPAGLKVPLLLHQKQALAWLLWRESQKPQGGILADDMGLGKTLTMIALILTQKNQEKKEEKEKSTALTWLSKDDSCDFTSHGTLIICPASLIHHWKNEVEKRVNSNKLRVYLYHGPNRDSRARVLSTYDIVITTYSLVAKEIPTNKQEAEIPGANLNVEGTSTPLLRIAWARIILDEAHNVKNPRVQTSIAVCKLQACARWAVTGTPIQNNLLDMYSLLKFLRCSPFDEFNLWRSQVDNGSKKGGERLSILTKSLLLRRTKDQLDSTGRPLVILPQRKFQLHHLKLSEDEETVYNVFFARSRSALQSYLKRHESRGNQSGRSPNNPFSRVALEFGSEEPRHSEAADSPRSSTVHILSQLLRLRQCCCHLSLLKSALDPMELKGEGLVLSLEEQLSALTLSELRDSEPSSTVSLNGTFFKMELFEGMRESTKISSLLAELEAIQRNSASQKSVIVSQWTNMLKVVALHLKKHGLTYATIDGSVNPKQRMDLVEAFNHSRGPQVMLISLLAGGVGLNLTGGNHLFLLDMHWNPSLEDQACDRIYRVGQQKDVVIHRFVCEGTVEEKILQLQEKKKDLAKQVLSGSGESVTKLTLADLRVLFGI

SEQ ID NO: 89913 - protein, 143 aa, Homo sapiens
  Payload ID: 17991
  Gene Name: transcription termination factor, RNA polymerase II
  ENSP ID: ENSP00000408111
NMLKVVALHLKKHGLTYATIDGSVNPKQRMDLVEAFNHSRGPQVMLISLLAGGVGLNLTGGNHLFLLDMHWNPSLEDQACDRIYRVGQQKDVVIHRFVCEGTVEEKILQLQEKKKDLAKQVLSGSGESVTKLTLADLRVLFGI

SEQ ID NO: 89914 - protein, 335 aa, Homo sapiens
  Payload ID: 17992
  Gene Name: transcriptional adaptor 1
  Uniprot ID: Q96BN2
  ENSP ID: ENSP00000356848
MATFVSELEAAKKNLSEALGDNVKQYWANLKLWFKQKISKEEFDLEAHRLLTQDNVHSHNDFLLAILTRCQILVSTPDGAGSLPWPGGSAAKPGKPKGKKKLSSVRQKFDHRFQPQNPLSGAQQFVAKDPQDDDDLKLCSHTMMLPTRGQLEGRMIVTAYEHGLDNVTEEAVSAVVYAVENHLKDILTSVVSRRKAYRLRDGHFKYAFGSNVTPQPYLKNSVVAYNNLIESPPAFTAPCAGQNPASHPPPDDAEQQAALLLACSGDTLPASLPPVNMYDLFEALQVHREVIPTHTVYALNIERIITKLWHPNHEELQQDKVHRQRLAAKEGLLLC

SEQ ID NO: 89915 - protein, 443 aa, Homo sapiens
  Payload ID: 17993
  Gene Name: transcriptional adaptor 2A
  ENSP ID: ENSP00000477709
MDRLGSFSNDPSDKPPCRGCSSYLMEPYIKCAECGPPPFFLCLQCFTRGFEYKKHQSDHTYEIMTSDFPVLDPSWTAQEEMALLEAVMDCGFGNWQDVANQMCTKTKEECEKHYMKHFINNPLFASTLLNLKQAEEAKTADTAIPFHSTDDPPRPTFDSLLSRDMAGYMPARADFIEEFDNYAEWDLRDIDFVEDDSDILHALKMAVVDIYHSRLKERQRRKKIIRDHGLINLRKFQLMERRYPKEVQDLYETMRRFARIVGPVEHDKFIESHALEFELRREIKRLQEYRTAGITNFCSARTYDHLKKTREEERLKRTMLSEVLQYIQDSSACQQWLRRQADIDSGLSPSIPMASNSGRRSAPPLNLTGLPGTEKLNEKEKELCQMVRLVPGAYLEYKSALLNECNKQGGLRLAQARALIKIDVNKTRKIYDFLIREGYITKG

SEQ ID NO: 89916 - protein, 194 aa, Homo sapiens
  Payload ID: 17993
  Gene Name: transcriptional adaptor 2A
  ENSP ID: ENSP00000478162
MALLEAVMDCGFGNWQDVANQMCTKTKEECEKHYMKHFINNPLFASTLLNLKQAEEAKTADTAIPFHSTDDPPRPTFDSLLSRDMAGYMPARADFIEEFDNYAEWDLRDIDFVEDDSDILHALKMAVVDIYHSRLKERQRRKKIIRDHGLINLRKFQLMERRYPKEVQDLYETMRRFARIVGPVEHDKFIESHA

SEQ ID NO: 89917 - protein, 443 aa, Homo sapiens; identical to SEQ ID NO: 89915
  Payload ID: 17993
  Gene Name: transcriptional adaptor 2A
  ENSP ID: ENSP00000478363

SEQ ID NO: 89918 - protein, 133 aa, Homo sapiens
  Payload ID: 17993
  Gene Name: transcriptional adaptor 2A
  ENSP ID: ENSP00000478418
MDRLGSFSNDPSDKPPCRGCSSYLMEPYIKCAECGPPPFFLCLQCFTRGFEYKKHQSDHTYEIMDVANQMCTKTKEECEKHYMKHFINNPLFASTLLNLKQAEEAKTADTAIPFHSTDDPPRPTFDSLLSRDM

SEQ ID NO: 89919 - protein, 305 aa, Homo sapiens
  Payload ID: 17993
  Gene Name: transcriptional adaptor 2A
  ENSP ID: ENSP00000480446
MDRLGSFSNDPSDKPPCRGCSSYLMEPYIKCAECGPPPFFLCLQCFTRGFEYKKHQSDHTYEIMTSDFPVLDPSWTAQEEMALLEAVMDCGFGNWQDVANQMCTKTKEECEKHYMKHFINNPLFASTLLNLKQAEEAKTADTAIPFHSTDDPPRPTFDSLLSRDMAGYMPARADFIEEFDNYAEWDLRDIDFVEDDSDILHALKMAVVDIYHSRLKERQRRKKIIRDHGLINLRKFQLMERRYPKEVQDLYETMRRFARIVGPVEHDKFIESHACRWFLSLEQYLCVYIYINRRDNGVFYVKFYK

SEQ ID NO: 89920 - protein, 443 aa, Homo sapiens; identical to SEQ ID NO: 89915
  Payload ID: 17993
  Gene Name: transcriptional adaptor 2A
  ENSP ID: ENSP00000481091

SEQ ID NO: 89921 - protein, 443 aa, Homo sapiens
  Payload ID: 17993
  Gene Name: transcriptional adaptor 2A
  Uniprot ID: O75478
  ENSP ID: ENSP00000481283
MDRLGPFSNDPSDKPPCRGCSSYLMEPYIKCAECGPPPFFLCLQCFTRGFEYKKHQSDHTYEIMTSDFPVLDPSWTAQEEMALLEAVMDCGFGNWQDVANQMCTKTKEECEKHYMKHFINNPLFASTLLNLKQAEEAKTADTAIPFHSTDDPPRPTFDSLLSRDMAGYMPARADFIEEFDNYAEWDLRDIDFVEDDSDILHALKMAVVDIYHSRLKERQRRKKIIRDHGLINLRKFQLMERRYPKEVQDLYETMRRFARIVGPVEHDKFIESHALEFELRREIKRLQEYRTAGITNFCSARTYDHLKKTREEERLKRTMLSEVLQYIQDSSACQQWLRRQADIDSGLSPSIPMASNSGRRSAPPLNLTGLPGTEKLNEKEKELCQMVRLVPGAYLEYKSALLNECNKQGGLRLAQARALIKIDVNKTRKIYDFLIREGYITKG

SEQ ID NO: 89922 - protein, 84 aa, Homo sapiens
  Payload ID: 17993
  Gene Name: transcriptional adaptor 2A
  ENSP ID: ENSP00000481890
  MOD_RES (1)..(1): Any amino acid
XTSDFPVLDPSWTAQEEMALLEAVMDCGFGNWQDVANQMCTKTKEECEKHYMKHFINNPLFASTLLNLKQAEEAKTADTAIPFH

SEQ ID NO: 89923 - protein, 443 aa, Homo sapiens; identical to SEQ ID NO: 89921
  Payload ID: 17993
  Gene Name: transcriptional adaptor 2A
  Uniprot ID: O75478
  ENSP ID: ENSP00000482484

SEQ ID NO: 89924 - protein, 95 aa, Homo sapiens
  Payload ID: 17993
  Gene Name: transcriptional adaptor 2A
  ENSP ID: ENSP00000482848
MDRLGSFSNDPSDKPPCRGCSSYLMEPYIKCAECGPPPFFLCLQCFTRGFEYKKHQSDHTYEIMTSDFPVLDPSWTAQEEMALLEAVMDCGFGNW

SEQ ID NO: 89925 - protein, 56 aa, Homo sapiens
  Payload ID: 17993
  Gene Name: transcriptional adaptor 2A
  ENSP ID: ENSP00000484884
MTSDFPVLDPSWTAQEEMALLEAVMDCGFGNWQDVANQMCTKTKEECEKHYMKHFI

SEQ ID NO: 89926 - protein, 84 aa, Homo sapiens; identical to SEQ ID NO: 89922
  Payload ID: 17993
  Gene Name: transcriptional adaptor 2A
  ENSP ID: ENSP00000487758
  MOD_RES (1)..(1): Any amino acid

SEQ ID NO: 89927 - protein, 305 aa, Homo sapiens
  Payload ID: 17993
  Gene Name: transcriptional adaptor 2A
  Uniprot ID: O75478
  ENSP ID: ENSP00000487973
MDRLGPFSNDPSDKPPCRGCSSYLMEPYIKCAECGPPPFFLCLQCFTRGFEYKKHQSDHTYEIMTSDFPVLDPSWTAQEEMALLEAVMDCGFGNWQDVANQMCTKTKEECEKHYMKHFINNPLFASTLLNLKQAEEAKTADTAIPFHSTDDPPRPTFDSLLSRDMAGYMPARADFIEEFDNYAEWDLRDIDFVEDDSDILHALKMAVVDIYHSRLKERQRRKKIIRDHGLINLRKFQLMERRYPKEVQDLYETMRRFARIVGPVEHDKFIESHACRWFLSLEQYLCVYIYINRRDNGVFYVKFYK

SEQ ID NO: 89928 - protein, 443 aa, Homo sapiens; identical to SEQ ID NO: 89921
  Payload ID: 17993
  Gene Name: transcriptional adaptor 2A
  Uniprot ID: O75478
  ENSP ID: ENSP00000488016

SEQ ID NO: 89929 - protein, 95 aa, Homo sapiens
  Payload ID: 17993
  Gene Name: transcriptional adaptor 2A
  ENSP ID: ENSP00000488180
MDRLGPFSNDPSDKPPCRGCSSYLMEPYIKCAECGPPPFFLCLQCFTRGFEYKKHQSDHTYEIMTSDFPVLDPSWTAQEEMALLEAVMDCGFGNW

SEQ ID NO: 89930 - protein, 194 aa, Homo sapiens; identical to SEQ ID NO: 89916
  Payload ID: 17993
  Gene Name: transcriptional adaptor 2A
  ENSP ID: ENSP00000488320

SEQ ID NO: 89931 - protein, 133 aa, Homo sapiens
  Payload ID: 17993
  Gene Name: transcriptional adaptor 2A
  ENSP ID: ENSP00000488616
MDRLGPFSNDPSDKPPCRGCSSYLMEPYIKCAECGPPPFFLCLQCFTRGFEYKKHQSDHTYEIMDVANQMCTKTKEECEKHYMKHFINNPLFASTLLNLKQAEEAKTADTAIPFHSTDDPPRPTFDSLLSRDM

SEQ ID NO: 89932 - protein, 56 aa, Homo sapiens; identical to SEQ ID NO: 89925
  Payload ID: 17993
  Gene Name: transcriptional adaptor 2A
  ENSP ID: ENSP00000488649

SEQ ID NO: 89933 - protein, 420 aa, Homo sapiens
  Payload ID: 17994
  Gene Name: transcriptional adaptor 2B
  Uniprot ID: Q86TJ2
  ENSP ID: ENSP00000308022
MAELGKKYCVYCLAEVSPLRFRCTECQDIELCPECFSAGAEIGHHRRYHGYQLVDGGRFTLWGPEAEGGWTSREEQLLLDAIEQFGFGNWEDMAAHVGASRTPQEVMEHYVSMYIHGNLGKACIPDTIPNRVTDHTCPSGGPLSPSLTTPLPPLDISVAEQQQLGYMPLRDDYEIEYDQDAETLISGLSVNYDDDDVEIELKRAHVDMYVRKLKERQRRKNIARDYNLVPAFLGKDKKEKEKALKRKITKEEKELRLKLRPLYQFMSCKEFDDLFENMHKEKMLRAKIRELQRYRRNGITKMEESAEYEAARHKREKRKENKNLAGSKRGKEDGKDSEFAAIENLPGFELLSDREKVLCSSLNLSPARYVTVKTIIIKDHLQKRQGIPSKSRLPSYLDKVLKKRILNFLTESGWISRDAS

SEQ ID NO: 89934 - protein, 121 aa, Homo sapiens
  Payload ID: 17994
  Gene Name: transcriptional adaptor 2B
  ENSP ID: ENSP00000422398
MAAHVGASRTPQEVMEHYVSMYIHGNLGKACIPDTIPNRVTDHTCPSGGPLSPSLTTPLPPLDISVAEQQQLGYMPLRDDYEIEYDQDAETLISGLSVNYDDDDVEIELKRAHVDMYVRKL

SEQ ID NO: 89935 - protein, 328 aa, Homo sapiens
  Payload ID: 17994
  Gene Name: transcriptional adaptor 2B
  Uniprot ID: Q86TJ2
  ENSP ID: ENSP00000423181
MAAHVGASRTPQEVMEHYVSMYIHGNLGKACIPDTIPNRVTDHTCPSGGPLSPSLTTPLPPLDISVAEQQQLGYMPLRDDYEIEYDQDAETLISGLSVNYDDDDVEIELKRAHVDMYVRKLKERQRRKNIARDYNLVPAFLGKDKKEKEKALKRKITKEEKELRLKLRPLYQFMSCKEFDDLFENMHKEKMLRAKIRELQRYRRNGITKMEESAEYEAARHKREKRKENKNLAGSKRGKEDGKDSEFAAIENLPGFELLSDREKVLCSSLNLSPARYVTVKTIIIKDHLQKRQGIPSKSRLPSYLDKVLKKRILNFLTESGWISRDAS

SEQ ID NO: 89936 - protein, 345 aa, Homo sapiens
  Payload ID: 17994
  Gene Name: transcriptional adaptor 2B
  Uniprot ID: Q86TJ2
  ENSP ID: ENSP00000423947
MAELGKKYCVYCLAEEDMAAHVGASRTPQEVMEHYVSMYIHGNLGKACIPDTIPNRVTDHTCPSGGPLSPSLTTPLPPLDISVAEQQQLGYMPLRDDYEIEYDQDAETLISGLSVNYDDDDVEIELKRAHVDMYVRKLKERQRRKNIARDYNLVPAFLGKDKKEKEKALKRKITKEEKELRLKLRPLYQFMSCKEFDDLFENMHKEKMLRAKIRELQRYRRNGITKMEESAEYEAARHKREKRKENKNLAGSKRGKEDGKDSEFAAIENLPGFELLSDREKVLCSSLNLSPARYVTVKTIIIKDHLQKRQGIPSKSRLPSYLDKVLKKRILNFLTESGWISRDAS

SEQ ID NO: 89937 - protein, 129 aa, Homo sapiens
  Payload ID: 17994
  Gene Name: transcriptional adaptor 2B
  ENSP ID: ENSP00000425731
MAAHVGASRTPQEVMEHYVSMYIHGNLGKACIPDTIPNRVTDHTCPSGGPLSPSLTTPLPPLDISVAEQQQLGYMPLRDDYEIEYDQDAETLISGLSVNYDDDDVEIELKRAHVDMYVRKLKERQRRKN

SEQ ID NO: 89938 - protein, 432 aa, Homo sapiens
  Payload ID: 17995
  Gene Name: transcriptional adaptor 3
  Uniprot ID: O75528
  ENSP ID: ENSP00000307684
MSELKDCPLQFHDFKSVDHLKVCPRYTAVLARSEDDGIGIEELDTLQLELETLLSSASRRLRVLEAETQILTDWQDKKGDRRFLKLGRDHELGAPPKHGKPKKQKLEGKAGHGPGPGPGRPKSKNLQPKIQEYEFTDDPIDVPRIPKNDAPNRFWASVEPYCADITSEEVRTLEELLKPPEDEAEHYKIPPLGKHYSQRWAQEDLLEEQKDGARAAAVADKKKGLMGPLTELDTKDVDALLKKSEAQHEQPEDGCPFGALTQRLLQALVEENIISPMEDSPIPDMSGKESGADGASTSPRNQNKPFSVPHTKSLESRIKEELIAQGLLESEDRPAEDSEDEVLAELRKRQAELKALSAHNRTKKHDLLRLAKEEVSRQELRQRVRMADNEVMDAFRKIMAARQKKRTPTKKEKDQAWKTLKERESILKLLDG

SEQ ID NO: 89939 - protein, 369 aa, Homo sapiens
  Payload ID: 17995
  Gene Name: transcriptional adaptor 3
  Uniprot ID: O75528
  ENSP ID: ENSP00000343649
MSELKDCPLQFHDFKSVDHLKVCPRYTAVLARSEDDGIGIEELDTLQLELETLLSSASRRLRVLEAETQILTDWQDKKGDRRFLKLGRDHELGAPPKHGKPKKQKLEGKAGHGPGPGPGRPKSKNLQPKIQEYEFTDDPIDVPRIPKNDAPNRFWASVEPYCADITSEEVRTLEELLKPPEDEAEHYKIPPLGKHYSQRWAQEDLLEEQKDGARAAAVADKKKGLMGPLTELDTKDVDALLKKSEAQHEQPEDGCPFGALTQRLLQALVEENIISPMEDSPIPDMSGKESGADGASTSPRNQNKPFSVPHTKSLESRIKEELIAQGLLESEDRPAEDSEDEVLAELRKRQAELKALSAHNRTKKHDLLR

SEQ ID NO: 89940 - protein, 432 aa, Homo sapiens; identical to SEQ ID NO: 89938
  Payload ID: 17995
  Gene Name: transcriptional adaptor 3
  Uniprot ID: O75528
  ENSP ID: ENSP00000393471

SEQ ID NO: 89941 - protein, 95 aa, Homo sapiens
  Payload ID: 17995
  Gene Name: transcriptional adaptor 3
  ENSP ID: ENSP00000395073
MSELKDCPLQFHDFKSVDHLKVCPRYTAVLARSEDDGIGIEELDTLQLELETLLSSASRRLRVLEAETQILTDWQDKKGDRRFLKLGRDHELGAP

SEQ ID NO: 89942 - protein, 1129 aa, Homo sapiens
  Payload ID: 17996
  Gene Name: transcriptional regulating factor 1
  Uniprot ID: Q96PN7
  ENSP ID: ENSP00000339438
MGDQQLYKTNHVAHGSENLFYQQPPLGVHSGLNHNYGNAVTGGGMDAPQASPISPHFPQDTRDGLGLPVGSKNLGQMDTSRQGGWGSHAGPGNHVQLRGNLANSNMMWGAPAQAEPTDGYQYTYSQASEIRTQKLTSGVLHKLDSFTQVFANQNLRIQVNNMAQVLHTQSAVMDGAPDSALRQLLSQKPMEPPAPAIPSRYQQVPQQPHPGFTGGLSKPALQVGQHPTQGHLYYDYQQPLAQVPVQGGQPLQAPQMLSQHMQQMQQHQYYPPQQQQQAGQQRISMQEIQTQPQQIRPSQPQPPPQQQQPQQLQLQQRQGSMQIPQYYQPQPMMQHLQEQQQQQMHLQPPSYHRDPHQYTPEQAHTVQLIPLGSMSQYYYQEPQQPYSHPLYQQSHLSQHQQREDSQLKTYSSDRQAQAMLSSHGDLGPPDTGMGDPASSDLTRVSSTLPHRPLLSPSGIHLNNMGPQHQQLSPSAMWPQMHLPDGRAQPGSPESSGQPKGAFGEQFDAKNKLTCSICLKEFKNLPALNGHMRSHGGMRASPNLKQEIPRKHQPSVPKAEEPLKTVQEKKKFRHRPEPLFIPPPPSYNPNPAASYSGATLYQSQLRSPRVLGDHLLLDPTHELPPYTPPPMLSPVRQGSGLFSNVLISGHGPGAHPQLPLTPLTPTPRVLLCRSNSIDGSNVTVTPGPGEQTVDVEPRINIGLRFQAEIPELQDISALAQDTHKATLVWKPWPELENHDLQQRVENLLNLCCSSALPGGGTNSEFALHSLFEAKGDVMVALEMLLLRKPVRLKCHPLANYHYAGSDKWTSLERKLFNKALATYSKDFIFVQKMVKSKTVAQCVEYYYTWKKIMRLGRKHRTRLAEIIDDCVTSEEEEELEEEEEEDPEEDRKSTKEEESEVPKSPEPPPVPVLAPTEGPPLQALGQPSGSFICEMPNCGADCRCHVTPFLPQVFSSRQALNGHARIHGGTNQVTKARGAIPSGKQKPGGTQSGYCSVKSSPSHSTTSGETDPTTIFPCKECGKVFFKIKSRNAHMKTHRQQEEQQRQKAQKAAFAAEMAATIERTTGPVGAPGLLPLDQLSLIKPIKDVDILDDDVVQQLGGVMEEAEVVDTDLLLDDQDSVLLQGDAEL

SEQ ID NO: 89943 - protein, 1117 aa, Homo sapiens
  Payload ID: 17996
  Gene Name: transcriptional regulating factor 1
  Uniprot ID: Q96PN7
  ENSP ID: ENSP00000346285
MGDQQLYKTNHVAHGSENLFYQQPPLGVHSGLNHNYGNAVTGGGMDAPQASPISPHFPQDTRDGLGLPVGSKNLGQMDTSRQGGWGSHAGPGNHVQLRGNLANSNMMWGAPAQAEPTDGYQYTYSQASEIRTQKLTSGVLHKLDSFTQVFANQNLRIQVNNMAQVLHTQSAVMDGAPDSALRQLLSQKPMEPPAPAIPSRYQQVPQQPHPGFTGGLSKPALQVGQHPTQGHLYYDYQQPLAQVPVQGGQPLQAPQMLSQHMQQMQQHQYYPPQQQQQAGQQRISMQEIQTQPQQIRPSQPQPPPQQQQPQQLQLQQRQGSMQIPQYYQPQPMMQHLQEQQQQQMHLQPPSYHRDPHQYTPEQAHTVQLIPLGSMSQYYYQEPQQPYSHPLYQQSHLSQHQQREDSQLKTYSSDRQAQAMLSSHGDLGPPDTGMGDPASSDLTRVSSTLPHRPLLSPSGIHLNNMGPQHQQLSPSAMWPQMHLPDGRAQPGSPESSGQPKGAFGEQFDAKNKLTCSICLKEFKNLPALNGHMRSHGGMRASPNLKQEIPRKHQPSVPKAEEPLKTVQEKKKFRHRPEPLFIPPPPSYNPNPAASYSGATLYQSQLRSPRVLGDHLLLDPTHELPPYTPPPMLSPVRQGSGLFSNVLISGHGPGAHPQLPLTPLTPTPRVLLCRSNSIDGSNVTVTPGPGEQTVDVEPRINIGLRFQAEIPELQDISALAQDTHKATLVWKPWPELENHDLQQRVENLLNLCCSSALPGGGTNSEFALHSLFEAKGDVMVALEMLLLRKPVRLKCHPLANYHYAGSDKWTSLERKLFNKALATYSKDFIFVQKMVKSKTVAQCVEYYYTWKKIMRLGRKHRTRLAEIIDDCVTSEEEEELEEEEEEDPEEDRKSTKEEESEVPKSPEPPPVPVLAPTEGPPLQALGQPSGSFICEMPNCGAVFSSRQALNGHARIHGGTNQVTKARGAIPSGKQKPGGTQSGYCSVKSSPSHSTTSGETDPTTIFPCKECGKVFFKIKSRNAHMKTHRQQEEQQRQKAQKAAFAAEMAATIERTTGPVGAPGLLPLDQLSLIKPIKDVDILDDDVVQQLGGVMEEAEVVDTDLLLDDQDSVLLQGDAEL

SEQ ID NO: 89944 - protein, 956 aa, Homo sapiens
  Payload ID: 17996
  Gene Name: transcriptional regulating factor 1
  Uniprot ID: Q96PN7
  ENSP ID: ENSP00000362008
MAQVLHTQSAVMDGAPDSALRQLLSQKPMEPPAPAIPSRYQQVPQQPHPGFTGGLSKPALQVGQHPTQGHLYYDYQQPLAQVPVQGGQPLQAPQMLSQHMQQMQQHQYYPPQQQQQAGQQRISMQEIQTQPQQIRPSQPQPPPQQQQPQQLQLQQRQGSMQIPQYYQPQPMMQHLQEQQQQQMHLQPPSYHRDPHQYTPEQAHTVQLIPLGSMSQYYYQEPQQPYSHPLYQQSHLSQHQQREDSQLKTYSSDRQAQAMLSSHGDLGPPDTGMGDPASSDLTRVSSTLPHRPLLSPSGIHLNNMGPQHQQLSPSAMWPQMHLPDGRAQPGSPESSGQPKGAFGEQFDAKNKLTCSICLKEFKNLPALNGHMRSHGGMRASPNLKQEIPRKHQPSVPKAEEPLKTVQEKKKFRHRPEPLFIPPPPSYNPNPAASYSGATLYQSQLRSPRVLGDHLLLDPTHELPPYTPPPMLSPVRQGSGLFSNVLISGHGPGAHPQLPLTPLTPTPRVLLCRSNSIDGSNVTVTPGPGEQTVDVEPRINIGLRFQAEIPELQDISALAQDTHKATLVWKPWPELENHDLQQRVENLLNLCCSSALPGGGTNSEFALHSLFEAKGDVMVALEMLLLRKPVRLKCHPLANYHYAGSDKWTSLERKLFNKALATYSKDFIFVQKMVKSKTVAQCVEYYYTWKKIMRLGRKHRTRLAEIIDDCVTSEEEEELEEEEEEDPEEDRKSTKEEESEVPKSPEPPPVPVLAPTEGPPLQALGQPSGSFICEMPNCGAVFSSRQALNGHARIHGGTNQVTKARGAIPSGKQKPGGTQSGYCSVKSSPSHSTTSGETDPTTIFPCKECGKVFFKIKSRNAHMKTHRQQEEQQRQKAQKAAFAAEMAATIERTTGPVGAPGLLPLDQLSLIKPIKDVDILDDDVVQQLGGVMEEAEVVDTDLLLDDQDSVLLQGDAEL

SEQ ID NO: 89945 - protein, 1200 aa, Homo sapiens
  Payload ID: 17996
  Gene Name: transcriptional regulating factor 1
  Uniprot ID: Q96PN7
  ENSP ID: ENSP00000362013
MGDQQLYKTNHVAHGSENLFYQQPPLGVHSGLNHNYGNAVTGGGMDAPQASPISPHFPQDTRDGLGLPVGSKNLGQMDTSRQGGWGSHAGPGNHVQLRGNLANSNMMWGAPAQAEPTDGYQYTYSQASEIRTQKLTSGVLHKLDSFTQVFANQNLRIQVNNMAQVLHTQSAVMDGAPDSALRQLLSQKPMEPPAPAIPSRYQQVPQQPHPGFTGGLSKPALQVGQHPTQGHLYYDYQQPLAQVPVQGGQPLQAPQMLSQHMQQMQQHQYYPPQQQQQAGQQRISMQEIQTQPQQIRPSQPQPPPQQQQPQQLQLQQRQGSMQIPQYYQPQPMMQHLQEQQQQQMHLQPPSYHRDPHQYTPEQAHTVQLIPLGSMSQYYYQEPQQPYSHPLYQQSHLSQHQQREDSQLKTYSSDRQAQAMLSSHGDLGPPDTGMGDPASSDLTRVSSTLPHRPLLSPSGIHLNNMGPQHQQLSPSAMWPQMHLPDGRAQPGSPESSGQPKGAFGEQFDAKNKLTCSICLKEFKNLPALNGHMRSHGGMRASPNLKQEEGEKVLPPQPQPPLPPPPPPPPPPQLPPEAESLTPMVMPVSVPVKLLPPKPSSQGFTNSTVAAPSARDKPASSMSDDEMPVLEIPRKHQPSVPKAEEPLKTVQEKKKFRHRPEPLFIPPPPSYNPNPAASYSGATLYQSQLRSPRVLGDHLLLDPTHELPPYTPPPMLSPVRQGSGLFSNVLISGHGPGAHPQLPLTPLTPTPRVLLCRSNSIDGSNVTVTPGPGEQTVDVEPRINIGLRFQAEIPELQDISALAQDTHKATLVWKPWPELENHDLQQRVENLLNLCCSSALPGGGTNSEFALHSLFEAKGDVMVALEMLLLRKPVRLKCHPLANYHYAGSDKWTSLERKLFNKALATYSKDFIFVQKMVKSKTVAQCVEYYYTWKKIMRLGRKHRTRLAEIIDDCVTSEEEEELEEEEEEDPEEDRKSTKEEESEVPKSPEPPPVPVLAPTEGPPLQALGQPSGSFICEMPNCGAVFSSRQALNGHARIHGGTNQVTKARGAIPSGKQKPGGTQSGYCSVKSSPSHSTTSGETDPTTIFPCKECGKVFFKIKSRNAHMKTHRQQEEQQRQKAQKAAFAAEMAATIERTTGPVGAPGLLPLDQLSLIKPIKDVDILDDDVVQQLGGVMEEAEVVDTDLLLDDQDSVLLQGDAEL

SEQ ID NO: 89946 - protein, 1220 aa, Homo sapiens
  Payload ID: 17996
  Gene Name: transcriptional regulating factor 1
  ENSP ID: ENSP00000439689
MGDQQLYKTNHVAHGSENLFYQQPPLGVHSGLNHNYGNAVTGGGMDAPQASPISPHFPQDTRDGLGLPVGSKNLGQMDTSRQGGWGSHAGPGNHVQLRGNLANSNMMWGAPAQAEPTDGYQYTYSQASEIRTQKLTSGVLHKLDSFTQVFANQNLRIQVNNMAQVLHTQSAVMDGAPDSALRQLLSQKPMEPPAPAIPSRYQQVPQQPHPGFTGGLSKPALQVGQHPTQGHLYYDYQQPLAQVPVQGGQPLQAPQMLSQHMQQMQQHQYYPPQQQQQAGQQRISMQEIQTQPQQIRPSQPQPPPQQQQPQQLQLQQRQGSMQIPQYYQPQPMMQHLQEQQQQQMHLQPPSYHRDPHQYTPEQAHTVQLIPLGSMSQYYYQEPQQPYSHPLYQQSHLSQHQQREDSQLKTYSSDRQAQAMLSSHGDLGPPDTGMGDPASSDLTRVSSTLPHRPLLSPSGIHLNNMGPQHQQLSPSAMWPQMHLPDGRAQPGSPESSGQPKGAFGEQFDAKNKLTCSICLKEFKNLPALNGHMRSHGGMRASPNLKQEEGEKVLPPQPQPPLPPPPPPPPPPQLPPEAESLTPMVMPVSVPVKLLPPKPSSQGFTNSTVAAPSARDKPASSMSDDEMPVLVRMTLSPPHSPQGAAPRTPAEIPRKHQPSVPKAEEPLKTVQEKKKFRHRPEPLFIPPPPSYNPNPAASYSGATLYQSQLRSPRVLGDHLLLDPTHELPPYTPPPMLSPVRQGSGLFSNVLISGHGPGAHPQLPLTPLTPTPRVLLCRSNSIDGSNVTVTPGPGEQTVDVEPRINIGLRFQAEIPELQDISALAQDTHKATLVWKPWPELENHDLQQRVENLLNLCCSSALPGGGTNSEFALHSLFEAKGDVMVALEMLLLRKPVRLKCHPLANYHYAGSDKWTSLERKLFNKALATYSKDFIFVQKMVKSKTVAQCVEYYYTWKKIMRLGRKHRTRLAEIIDDCVTSEEEEELEEEEEEDPEEDRKSTKEEESEVPKSPEPPPVPVLAPTEGPPLQALGQPSGSFICEMPNCGAVFSSRQALNGHARIHGGTNQVTKARGAIPSGKQKPGGTQSGYCSVKSSPSHSTTSGETDPTTIFPCKECGKVFFKIKSRNAHMKTHRQQEEQQRQKAQKAAFAAEMAATIERTTGPVGAPGLLPLDQLSLIKPIKDVDILDDDVVQQLGGVMEEAEVVDTDLLLDDQDSVLLQGDAEL

SEQ ID NO: 89947 - protein, 345 aa, Homo sapiens
  Payload ID: 17997
  Gene Name: transducer of ERBB2, 1
  Uniprot ID: P50616
  ENSP ID: ENSP00000268957
MQLEIQVALNFIISYLYNKLPRRRVNIFGEELERLLKKKYEGHWYPEKPYKGSGFRCIHIGEKVDPVIEQASKESGLDIDDVRGNLPQDLSVWIDPFEVSYQIGEKGPVKVLYVDDNNENGCELDKEIKNSFNPEAQVFMPISDPASSVSSSPSPPFGHSAAVSPTFMPRSTQPLTFTTATFAATKFGSTKMKNSGRSNKVARTSPINLGLNVNDLLKQKAISSSMHSLYGLGLGSQQQPQQQQQPAQPPPPPPPPQQQQQQKTSALSPNAKEFIFPNMQGQGSSTNGMFPGDSPLNLSPLQYSNAFDVFAAYGGLNEKSFVDGLNFSLNNMQYSNQQFQPVMAN

SEQ ID NO: 89948 - protein, 345 aa, Homo sapiens; identical to SEQ ID NO: 89947
  Payload ID: 17997
  Gene Name: transducer of ERBB2, 1
  Uniprot ID: P50616
  ENSP ID: ENSP00000427695

SEQ ID NO: 89949 - protein, 344 aa, Homo sapiens
  Payload ID: 17998
  Gene Name: transducer of ERBB2, 2
  Uniprot ID: Q14106
  ENSP ID: ENSP00000331305
MQLEIKVALNFIISYLYNKLPRRRADLFGEELERLLKKKYEGHWYPEKPLKGSGFRCVHIGEMVDPVVELAAKRSGLAVEDVRANVPEELSVWIDPFEVSYQIGEKGAVKVLYLDDSEGCGAPELDKEIKSSFNPDAQVFVPIGSQDSSLSNSPSPSFGQSPSPTFIPRSAQPITFTTASFAATKFGSTKMKKGGGAASGGGVASSGAGGQQPPQQPRMARSPTNSLLKHKSLSLSMHSLNFITANPAPQSQLSPNAKEFVYNGGGSPSLFFDAADGQGSGTPGPFGGSGAGTCNSSSFDMAQVFGGGANSLFLEKTPFVEGLSYNLNTMQYPSQQFQPVVLAN

SEQ ID NO: 89950 - protein, 101 aa, Homo sapiens
  Payload ID: 17998
  Gene Name: transducer of ERBB2, 2
  ENSP ID: ENSP00000388549
MQLEIKVALNFIISYLYNKLPRRRADLFGEELERLLKKKYEGHWYPEKPLKGSGFRCVHIGEMVDPVVELAAKRSGLAVEDVRANVPEELSVWIDPFEVSY

SEQ ID NO: 89951 - protein, 144 aa, Homo sapiens
  Payload ID: 17999
  Gene Name: transducin (beta)-like 1 X-linked receptor 1
  ENSP ID: ENSP00000263964
MSISSDEVNFLVYRYLQESGFSHSAFTFGIESHISQSNINGALVPPAALISIIQKGLQYVEAEVSINEDGTLFDGRPIESLSLIDAVMPDVVQTRQQAYRDKLAQQQAAAAAAAAAAASQQGSAKNGENTANGEENGAHTIANN

SEQ ID NO: 89952 - protein, 72 aa, Homo sapiens
  Payload ID: 17999
  Gene Name: transducin (beta)-like 1 X-linked receptor 1
  ENSP ID: ENSP00000387849
MSISSDEVNFLVYRYLQESGFSHSAFTFGIESHISQSNINGALVPPAALISIIQKGLQYVEAEVSINEDGTL

SEQ ID NO: 89953 - protein, 75 aa, Homo sapiens
  Payload ID: 17999
  Gene Name: transducin (beta)-like 1 X-linked receptor 1
  ENSP ID: ENSP00000391559
MPDVVQTRQQAYRDKLAQQQAAAAAAAAAAASQQGSAKNGENTANGEENGAHTIANNHTDMMEVDGDVEIPPNKA

SEQ ID NO: 89954 - protein, 145 aa, Homo sapiens
  Payload ID: 17999
  Gene Name: transducin (beta)-like 1 X-linked receptor 1
  ENSP ID: ENSP00000392180
MSISSDEVNFLVYRYLQESGFSHSAFTFGIESHISQSNINGALVPPAALISIIQKGLQYVEAEVSINEDGTLFDGRPIESLSLIDAVMPDVVQTRQQAYRDKLAQQQAAAAAAAAAAASQQGSAKNGENTANGEENGAHTIANNH

SEQ ID NO: 89955 - protein, 81 aa, Homo sapiens
  Payload ID: 17999
  Gene Name: transducin (beta)-like 1 X-linked receptor 1
  ENSP ID: ENSP00000396120
MSISSDEVNFLVYRYLQESGFSHSAFTFGIESHISQSNINGALVPPAALISIIQKGLQYVEAEVSINEDGTLFDGRPIESL

SEQ ID NO: 89956 - protein, 96 aa, Homo sapiens
  Payload ID: 17999
  Gene Name: transducin (beta)-like 1 X-linked receptor 1
  ENSP ID: ENSP00000397450
MSISSDEVNFLVYRYLQESGFSHSAFTFGIESHISQSNINGALVPPAALISIIQKGLQYVEAEVSINEDGTLFDGRPIESLSLIDAVMPDVVQTRQ

SEQ ID NO: 89957 - protein, 86 aa, Homo sapiens
  Payload ID: 17999
  Gene Name: transducin (beta)-like 1 X-linked receptor 1
  ENSP ID: ENSP00000398477
MSISSDEVNFLVYRYLQESGFSHSAFTFGIESHISQSNINGALVPPAALISIIQKGLQYVEAEVSINEDGTLFDGRPIESLSLIDA

SEQ ID NO: 89958 - protein, 61 aa, Homo sapiens
  Payload ID: 17999
  Gene Name: transducin (beta)-like 1 X-linked receptor 1
  ENSP ID: ENSP00000401044
MSISSDEVNFLVYRYLQESGFSHSAFTFGIESHISQSNINGALVPPAALISIIQKGLQYVE

SEQ ID NO: 89959 - protein, 55 aa, Homo sapiens
  Payload ID: 17999
  Gene Name: transducin (beta)-like 1 X-linked receptor 1
  ENSP ID: ENSP00000402402
MPDVVQTRQQAYRDKLAQQQAAAAAAAAAAASQQGSAKNGENTANGEENGAHTIA

SEQ ID NO: 89960 - protein, 73 aa, Homo sapiens
  Payload ID: 17999
  Gene Name: transducin (beta)-like 1 X-linked receptor 1
  ENSP ID: ENSP00000404863
MPDVVQTRQQAYRDKLAQQQAAAAAAAAAAASQQGSAKNGENTANGEENGAHTIANNHTDMMEVDGDVEIPPN

SEQ ID NO: 89961 - protein, 514 aa, Homo sapiens
  Payload ID: 17999
  Gene Name: transducin (beta)-like 1 X-linked receptor 1
  Uniprot ID: Q9BZK7
  ENSP ID: ENSP00000405574
MSISSDEVNFLVYRYLQESGFSHSAFTFGIESHISQSNINGALVPPAALISIIQKGLQYVEAEVSINEDGTLFDGRPIESLSLIDAVMPDVVQTRQQAYRDKLAQQQAAAAAAAAAAASQQGSAKNGENTANGEENGAHTIANNHTDMMEVDGDVEIPPNKAVVLRGHESEVFICAWNPVSDLLASGSGDSTARIWNLSENSTSGSTQLVLRHCIREGGQDVPSNKDVTSLDWNSEGTLLATGSYDGFARIWTKDGNLASTLGQHKGPIFALKWNKKGNFILSAGVDKTTIIWDAHTGEAKQQFPFHSAPALDVDWQSNNTFASCSTDMCIHVCKLGQDRPIKTFQGHTNEVNAIKWDPTGNLLASCSDDMTLKIWSMKQDNCVHDLQAHNKEIYTIKWSPTGPGTNNPNANLMLASASFDSTVRLWDVDRGICIHTLTKHQEPVYSVAFSPDGRYLASGSFDKCVHIWNTQTGALVHSYRGTGGIFEVCWNAAGDKVGASASDGSVCVLDLRK

SEQ ID NO: 89962 - protein, 120 aa, Homo sapiens
  Payload ID: 17999
  Gene Name: transducin (beta)-like 1 X-linked receptor 1
  ENSP ID: ENSP00000406297
MSISSDEVNFLVYRYLQESGFSHSAFTFGIESHISQSNINGALVPPAALISIIQKGLQYVEAEVSINEDGTLFDGRPIESLSLIDAVMPDVVQTRQQAYRDKLAQQQAAAAAAAAAAASQ

SEQ ID NO: 89963 - protein, 514 aa, Homo sapiens; identical to SEQ ID NO: 89961
  Payload ID: 17999
  Gene Name: transducin (beta)-like 1 X-linked receptor 1
  Uniprot ID: Q9BZK7
  ENSP ID: ENSP00000413251

SEQ ID NO: 89964 - protein, 33 aa, Homo sapiens
  Payload ID: 17999
  Gene Name: transducin (beta)-like 1 X-linked receptor 1
  ENSP ID: ENSP00000415506
MSISSDEVNFLVYRYLQESGFSHSAFTFGIESH

SEQ ID NO: 89965 - protein, 105 aa, Homo sapiens
  Payload ID: 17999
  Gene Name: transducin (beta)-like 1 X-linked receptor 1
  ENSP ID: ENSP00000486082
MSISSDEVNFLVYRYLQESGFSHSAFTFGIESHISQSNINGALVPPAALISIIQKGLQYVEAEVSINEDGTLFDGRPIESLSLIDAVMPDVVQTRQQAYRDKLAQ

SEQ ID NO: 89966 - protein, 122 aa, Homo sapiens
  Payload ID: 17999
  Gene Name: transducin (beta)-like 1 X-linked receptor 1
  ENSP ID: ENSP00000486235
MRPDICLYGTQQHHIQGFSHSAFTFGIESHISQSNINGALVPPAALISIIQKGLQYVEAEVSINEDGTLFDGRPIESLSLIDAVMPDVVQTRQQAYRDKLAQQQAAAAAAAAAAASQQGSAK

SEQ ID NO: 89967 - protein, 474 aa, Homo sapiens
  Payload ID: 17999
  Gene Name: transducin (beta)-like 1 X-linked receptor 1
  ENSP ID: ENSP00000486324
MSISSDEVNFLVYRYLQESGFSHSAFTFGIESHISQSNINGALVPPAALISIIQKGLQYVEAEVSINEDGTLFDGRPIESLSLIDAVMPDVVQTRQQAYRDKLAQQQAAAAAAAAAAASQQGSAKNGENTANGEENGAHTIANNHTDMMEVDGDVEIPPNKAVVLRGHESEVFICAWNPVSDLLASGSGDSTARIWNLSENSTSGSTQLVLRHCIREGGQDVPSNKDVTSLDWNSEGTLLATGSYDGFARIWTKDGNLASTLGQHKGPIFALKWNKKGNFILSAGVDKTTIIWDAHTGEAKQQFPFHSAPALDVDWQSNNTFASCSTDMCIHVCKLGQDRPIKTFQGHTNEVNAIKWDPTGNLLASCSDDMTLKIWSMKQDNCVHDLQAHNKEIYTIKWSPTGPGTNNPNANLMLASASFDSTVRLWDVDRGICIHTLTKHQEPVYSVAFSPDGRYLASGSFDKCVHIWNTQVL

SEQ ID NO: 89968 - protein, 67 aa, Homo sapiens
  Payload ID: 17999
  Gene Name: transducin (beta)-like 1 X-linked receptor 1
  ENSP ID: ENSP00000486622
  MOD_RES (1)..(1): Any amino acid
XNNPNANLMLASGSFDKCVHIWNTQTGALVHSYRGTGGIFEVCWNAAGDKVGASASDGSVCVLDLRK

SEQ ID NO: 89969 - protein, 112 aa, Homo sapiens
  Payload ID: 17999
  Gene Name: transducin (beta)-like 1 X-linked receptor 1
  ENSP ID: ENSP00000486866
MSISSDEVNFLVYRYLQESGFSHSAFTFGIESHISQSNINGALVPPAALISIIQKGLQYVEAEVSINEDGTLFDGRPIESLSLIDAVMPDVVQTRQQAYRDKLAQQQAAAAA

SEQ ID NO: 89970 - protein, 522 aa, Homo sapiens
  Payload ID: 18000
  Gene Name: transducin (beta)-like 1, Y-linked
  Uniprot ID: Q9BQ87
  ENSP ID: ENSP00000328879
MSITSDEVNFLVYRYLQESGFSHSAFTFGIESHISQSNINGTLVPPSALISILQKGLQYVEAEISINKDGTVFDSRPIESLSLIVAVIPDVVQMRQQAFGEKLTQQQASAAATEASAMAKAATMTPAAISQQNPPKNREATVNGEENGAHEINNHSKPMEIDGDVEIPPNKATVLRGHESEVFICAWNPVSDLLASGSGDSTARIWNLNENSNGGSTQLVLRHCIREGGHDVPSNKDVTSLDWNSDGTLLAMGSYDGFARIWTENGNLASTLGQHKGPIFALKWNKKGNYVLSAGVDKTTIIWDAHTGEAKQQFPFHSAPALDVDWQNNMTFASCSTDMCIHVCRLGCDHPVKTFQGHTNEVNAIKWDPSGMLLASCSDDMTLKIWSMKQDACVHDLQAHSKEIYTIKWSPTGPATSNPNSSIMLASASFDSTVRLWDVEQGVCTHTLMKHQEPVYSVAFSPDGKYLASGSFDKYVHIWNTQSGSLVHSYQGTGGIFEVCWNARGDKVGASASDGSVCVLDL

SEQ ID NO: 89971 - protein, 522 aa, Homo sapiens; identical to SEQ ID NO: 89970
  Payload ID: 18000
  Gene Name: transducin (beta)-like 1, Y-linked
  Uniprot ID: Q9BQ87
  ENSP ID: ENSP00000347289

SEQ ID NO: 89972 - protein, 522 aa, Homo sapiens; identical to SEQ ID NO: 89970
  Payload ID: 18000
  Gene Name: transducin (beta)-like 1, Y-linked
  Uniprot ID: Q9BQ87
  ENSP ID: ENSP00000372499

SEQ ID NO: 89973 - protein, 577 aa, Homo sapiens
  Payload ID: 18001
  Gene Name: transducin (beta)-like 1X-linked
  Uniprot ID: O60907
  ENSP ID: ENSP00000217964
MTELAGASSSCCHRPAGRGAMQSVLHHFQRLRGREGGSHFINTSSPRGEAKMSITSDEVNFLVYRYLQESGFSHSAFTFGIESHISQSNINGTLVPPAALISILQKGLQYVEAEISINEDGTVFDGRPIESLSLIDAVMPDVVQTRQQAFREKLAQQQASAAAAAAAATAAATAATTTSAGVSHQNPSKNREATVNGEENRAHSVNNHAKPMEIDGEVEIPSSKATVLRGHESEVFICAWNPVSDLLASGSGDSTARIWNLNENSNGGSTQLVLRHCIREGGHDVPSNKDVTSLDWNTNGTLLATGSYDGFARIWTEDGNLASTLGQHKGPIFALKWNRKGNYILSAGVDKTTIIWDAHTGEAKQQFPFHSAPALDVDWQNNTTFASCSTDMCIHVCRLGCDRPVKTFQGHTNEVNAIKWDPSGMLLASCSDDMTLKIWSMKQEVCIHDLQAHNKEIYTIKWSPTGPATSNPNSNIMLASASFDSTVRLWDIERGVCTHTLTKHQEPVYSVAFSPDGKYLASGSFDKCVHIWNTQSGNLVHSYRGTGGIFEVCWNARGDKVGASASDGSVCVLDLRK

SEQ ID NO: 89974 - protein, 526 aa, Homo sapiens
  Payload ID: 18001
  Gene Name: transducin (beta)-like 1X-linked
  Uniprot ID: O60907
  ENSP ID: ENSP00000370348
MSITSDEVNFLVYRYLQESGFSHSAFTFGIESHISQSNINGTLVPPAALISILQKGLQYVEAEISINEDGTVFDGRPIESLSLIDAVMPDVVQTRQQAFREKLAQQQASAAAAAAAATAAATAATTTSAGVSHQNPSKNREATVNGEENRAHSVNNHAKPMEIDGEVEIPSSKATVLRGHESEVFICAWNPVSDLLASGSGDSTARIWNLNENSNGGSTQLVLRHCIREGGHDVPSNKDVTSLDWNTNGTLLATGSYDGFARIWTEDGNLASTLGQHKGPIFALKWNRKGNYILSAGVDKTTIIWDAHTGEAKQQFPFHSAPALDVDWQNNTTFASCSTDMCIHVCRLGCDRPVKTFQGHTNEVNAIKWDPSGMLLASCSDDMTLKIWSMKQEVCIHDLQAHNKEIYTIKWSPTGPATSNPNSNIMLASASFDSTVRLWDIERGVCTHTLTKHQEPVYSVAFSPDGKYLASGSFDKCVHIWNTQSGNLVHSYRGTGGIFEVCWNARGDKVGASASDGSVCVLDLRK

SEQ ID NO: 89975 - protein, 577 aa, Homo sapiens; identical to SEQ ID NO: 89973
  Payload ID: 18001
  Gene Name: transducin (beta)-like 1X-linked
  Uniprot ID: O60907
  ENSP ID: ENSP00000385988

SEQ ID NO: 89976 - protein, 526 aa, Homo sapiens; identical to SEQ ID NO: 89974
  Payload ID: 18001
  Gene Name: transducin (beta)-like 1X-linked
  Uniprot ID: O60907
  ENSP ID: ENSP00000394097

SEQ ID NO: 89977 - protein, 79 aa, Homo sapiens
  Payload ID: 18001
  Gene Name: transducin (beta)-like 1X-linked
  ENSP ID: ENSP00000397878
MTELAGASSSCCHRPAGRGAMQSVLHHFQRLRGREGGSHFINTSSPRGEAKMSITSDEVNFLVYRYLQESGFSHSAFTF

SEQ ID NO: 89978 - protein, 59 aa, Homo sapiens
  Payload ID: 18001
  Gene Name: transducin (beta)-like 1X-linked
  ENSP ID: ENSP00000402923
MTELAGASSSCCHRPAGRGAMQSVLHHFQRLRGREGGSHFINTSSPRGEAKMSITSDEV

SEQ ID NO: 89979 - protein, 75 aa, Homo sapiens
  Payload ID: 18001
  Gene Name: transducin (beta)-like 1X-linked
  ENSP ID: ENSP00000407069
MSITSDEVNFLVYRYLQESGFSHSAFTFGIESHISQSNINGTLVPPAALISILQKGLQYVEAEISINEDGTVFDG

SEQ ID NO: 89980 - protein, 44 aa, Homo sapiens
  Payload ID: 18001
  Gene Name: transducin (beta)-like 1X-linked
  ENSP ID: ENSP00000415508
MSITSDEVNFLVYRYLQESGFSHSAFTFGIESHISQSNINGTLV

SEQ ID NO: 89981 - protein, 447 aa, Homo sapiens
  Payload ID: 18002
  Gene Name: transducin (beta)-like 2
  Uniprot ID: Q9Y4P3
  ENSP ID: ENSP00000307260
MELSQMSELMGLSVLLGLLALMATAAVARGWLRAGEERSGRPACQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 89982 - protein, 46 aa, Homo sapiens
  Payload ID: 18002
  Gene Name: transducin (beta)-like 2
  ENSP ID: ENSP00000398195
MELSQMSELMGLSVLLGLLALMATAAVARGWLRAGEERSGRPACGQ

SEQ ID NO: 89983 - protein, 39 aa, Homo sapiens
  Payload ID: 18002
  Gene Name: transducin (beta)-like 2
  ENSP ID: ENSP00000400569
MGLSFSSGPRSFFPVGIGEHLQSFTTCQLCDSIKYLLQK

SEQ ID NO: 89984 - protein, 107 aa, Homo sapiens
  Payload ID: 18002
  Gene Name: transducin (beta)-like 2
  ENSP ID: ENSP00000404242
MELSQMSELMGLSVLLGLLALMATAAVARGWLRAGEERSGRPACQKANGFPPDKSSGSKKQKQYQRIRKEKPQQHNFTHRLLAAALKMIAPSASGAPRTSCSESTAA

SEQ ID NO: 89985 - protein, 43 aa, Homo sapiens
  Payload ID: 18002
  Gene Name: transducin (beta)-like 2
  ENSP ID: ENSP00000406418
MELSQMSELMGLSVLLGLLALMATAAVARGWLRAGEERSGRPA

SEQ ID NO: 89986 - protein, 43 aa, Homo sapiens; identical to SEQ ID NO: 89985
  Payload ID: 18002
  Gene Name: transducin (beta)-like 2
  ENSP ID: ENSP00000407503

SEQ ID NO: 89987 - protein, 54 aa, Homo sapiens
  Payload ID: 18002
  Gene Name: transducin (beta)-like 2
  ENSP ID: ENSP00000408255
MELSQMSELMGLSVLLGLLALMATAAVARGWLRAGEERSGRPAWSCSVTQDGMQ

SEQ ID NO: 89988 - protein, 176 aa, Homo sapiens
  Payload ID: 18002
  Gene Name: transducin (beta)-like 2
  ENSP ID: ENSP00000409820
MELSQMSELMGLSVLLGLLALMATAAVARGWLRAGEERSGRPACQKANGFPPDKSSGSKKQKQYQRIRKEKPQQHNFTHRLLAAALKSHSGNISCMDFSSNGKYLATCADDRTIRIWSTKDFLQREHRSMRANVELDHATLSLHRLAGQRGHPPCLQDDQAGGWGLHLHSHPRGLP

SEQ ID NO: 89989 - protein, 75 aa, Homo sapiens
  Payload ID: 18002
  Gene Name: transducin (beta)-like 2
  ENSP ID: ENSP00000410737
MELSQMSELMGLSVLLGLLALMATAAVARGWLRAGEERSGRPAWPRSFFPVGIGEHLQSFTTCQLCDSIKYLLQK

SEQ ID NO: 89990 - protein, 411 aa, Homo sapiens
  Payload ID: 18002
  Gene Name: transducin (beta)-like 2
  ENSP ID: ENSP00000413979
MGLSFSSGQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTDVEYKKKQDPYLLKTGRFEEAAGAAPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 89991 - protein, 64 aa, Homo sapiens
  Payload ID: 18002
  Gene Name: transducin (beta)-like 2
  ENSP ID: ENSP00000414865
MGLSFSSGNVSFASRDGDPPCRAKKQMDFHLTNLRDPRSRNNISGFGRRSLNNTTSPTASWLQL

SEQ ID NO: 89992 - protein, 96 aa, Homo sapiens
  Payload ID: 18002
  Gene Name: transducin (beta)-like 2
  ENSP ID: ENSP00000480898
MDFSSNGKYLATCADDRTIRIWSTKDFLQREHRSMRANVELDHATLVRFSPDCRAFIVWLANGDTLRVFKMTKREDGGYTFTATPEDFPKKHKAPV

SEQ ID NO: 89993 - protein, 446 aa, Homo sapiens [sequence omitted]

SEQ ID NO: 89994 - protein, 697 aa, Homo sapiens
  Payload ID: 18003
  Gene Name: transducin (beta)-like 3
  ENSP ID: ENSP00000331815
  MOD_RES (1)..(1): Any amino acid
XAWQEGSVTRLWKAIHTAPVATMAFDPTSTLLATGGCDGAVRVWDIVRHYGTHHFRGSPGVVHLVAFHPDPTRLLLFSSATDAAIRVWSLQDRSCLAVLTAHYSAVTSLAFSADGHTMLSSGRDKICIIWDLQSCQATRTVPVFESVEAAVLLPEEPVSQLGVKSPGLYFLTAGDQGTLRVWEAASGQCVYTQAQPPGPGQELTHCTLAHTAGVVLTATADHNLLLYEARSLRLQKQFAGYSEEVLDVRFLGPEDSHVVVASNSPCLKVFELQTSACQILHGHTDIVLALDVFRKGWLFASCAKDQSVRIWRMNKAGQVMLKESFLVTGSQDCTVKLWPLPKALLSKNTAPDNGPILLQAQTTQRCHDKDINSVAIAPNDKLLATGSQDRTAKLWALPQCQLLGVFSGHRRGLWCVQFSPMDQVLATASADGTIKLWALQDFSCLKTFEGHDASVLKVAFVSRGTQLLSSGSDGLVKLWTIKNNECVRTLDAHEDKVWGLHCSRLDDHALTGASDSRVILWKDVTEAEQAEEQARQEEQVVRQQELDNLLHEKRYLRALGLAISLDRPHTVLTVIQAIRRDPEACEKLEATMLRLRRDQKEALLRFCVTWNTNSRHCHEAQAVLGVLLRREAPEELLAYEGVRAALEALLPYTERHFQRLSRTLQAAAFLDFLWHNMKLPVPAAAPTPWETHKGALP

SEQ ID NO: 89995 - protein, 77 aa, Homo sapiens
  Payload ID: 18003
  Gene Name: transducin (beta)-like 3
  ENSP ID: ENSP00000454735
MAETAAGVGRFKTNYAVERKIEPFYKGGKAQTSLSPAGPDWPAPLLRLWHQSQHSGSGLGGRAAESGAGGPGGHHCL

SEQ ID NO: 89996 - protein, 808 aa, Homo sapiens
  Payload ID: 18003
  Gene Name: transducin (beta)-like 3
  Uniprot ID: Q12788
  ENSP ID: ENSP00000454836
MAETAAGVGRFKTNYAVERKIEPFYKGGKAQLDQTGQHLFCVCGTRVNILEVASGAVLRSLEQEDQEDITAFDLSPDNEVLVTASRALLLAQWAWQEGSVTRLWKAIHTAPVATMAFDPTSTLLATGGCDGAVRVWDIVRHYGTHHFRGSPGVVHLVAFHPDPTRLLLFSSATDAAIRVWSLQDRSCLAVLTAHYSAVTSLAFSADGHTMLSSGRDKICIIWDLQSCQATRTVPVFESVEAAVLLPEEPVSQLGVKSPGLYFLTAGDQGTLRVWEAASGQCVYTQAQPPGPGQELTHCTLAHTAGVVLTATADHNLLLYEARSLRLQKQFAGYSEEVLDVRFLGPEDSHVVVASNSPCLKVFELQTSACQILHGHTDIVLALDVFRKGWLFASCAKDQSVRIWRMNKAGQVMCVAQGSGHTHSVGTVCCSRLKESFLVTGSQDCTVKLWPLPKALLSKNTAPDNGPILLQAQTTQRCHDKDINSVAIAPNDKLLATGSQDRTAKLWALPQCQLLGVFSGHRRGLWCVQFSPMDQVLATASADGTIKLWALQDFSCLKTFEGHDASVLKVAFVSRGTQLLSSGSDGLVKLWTIKNNECVRTLDAHEDKVWGLHCSRLDDHALTGASDSRVILWKDVTEAEQAEEQARQEEQVVRQQELDNLLHEKRYLRALGLAISLDRPHTVLTVIQAIRRDPEACEKLEATMLRLRRDQKEALLRFCVTWNTNSRHCHEAQAVLGVLLRREAPEELLAYEGVRAALEALLPYTERHFQRLSRTLQAAAFLDFLWHNMKLPVPAAAPTPWETHKGALP

SEQ ID NO: 89997 - protein, 518 aa, Homo sapiens [sequence omitted]

SEQ ID NO: 89998 - protein, 144 aa, Homo sapiens
  Payload ID: 18004
  Gene Name: transducin-like enhancer of split 1 (E(sp1) homolog, Drosophila)
  ENSP ID: ENSP00000365646
MQRHYVMYYEMSYGLNIEMHKQTEIAKRLNTICAQVIPFLSQEHQQQVAQAVERAKQVTMAELNAIIGQQQLQAQHLSHGHGPPVPLTPHPSGLQPPGIPPLGGSAGLLALSSALSGQSHLAIKDDKKHHDAEHHRGERPGKPD

SEQ ID NO: 89999 - protein, 769 aa, Homo sapiens
  Payload ID: 18004
  Gene Name: transducin-like enhancer of split 1 (E(sp1) homolog, Drosophila)
  ENSP ID: ENSP00000365655
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGQQQLQAQHLSHGHGPPVPLTPHPSGLQPPGIPPLGGSAGLLALSSALSGQSHLAIKDDKKHHDAEHHRDREPGTSNSLLVPDSLRGTDKRRNGPEFSNDIKKRKVDDKDSSHYDSDGDKSDDNLVVDVSNEDPSSPRASPAHSPRENGIDKNRLLKKDASSSPASTASSASSTSLKSKEMSLHEKASTPVLKSSTPTPRSDMPTPGTSATPGLRPGLGKPPAIDPLVNQAAAGLRTPLAVPGPYPAPFGMVPHAGMNGELTSPGAAYASLHNMSPQMSAAARGRRGGYGRSPMVGFDPPPHMRVPTIPPNLAGIPGGKPAYSFHVTADGQMQPVPFPPDALIGPGIPRHARQINTLNHGEVVCAVTISNPTRHVYTGGKGCVKVWDISHPGNKSPVSQLDCLNRDNYIRSCKLLPDGCTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMESSNVEVLHVNKPDKYQLHLHESCVLSLKFAYCGKWFVSTGKDNLLNAWRTPYGASIFQSKESSSVLSCDISVDDKYIVTGSGDKKATVYEVIY

SEQ ID NO: 90000 - protein, 127 aa, Homo sapiens
  Payload ID: 18004
  Gene Name: transducin-like enhancer of split 1 (E(sp1) homolog, Drosophila)
  ENSP ID: ENSP00000365667
MPTPGTSATPGLRPGLGKPPAIDPLVNQAAAGLRTPLAVPGPYPAPFGMVPHAGMNGELTSPGAAYASLHNMSPQMSAAAAAAAVVAYGRSPMVGFDPPPHMRVPTIPPNLAGIPGGKPSLVPAPAH

SEQ ID NO: 90001 - protein, 770 aa, Homo sapiens
  Payload ID: 18004
  Gene Name: transducin-like enhancer of split 1 (E(sp1) homolog, Drosophila)
  Uniprot ID: Q04724
  ENSP ID: ENSP00000365682
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGQQQLQAQHLSHGHGPPVPLTPHPSGLQPPGIPPLGGSAGLLALSSALSGQSHLAIKDDKKHHDAEHHRDREPGTSNSLLVPDSLRGTDKRRNGPEFSNDIKKRKVDDKDSSHYDSDGDKSDDNLVVDVSNEDPSSPRASPAHSPRENGIDKNRLLKKDASSSPASTASSASSTSLKSKEMSLHEKASTPVLKSSTPTPRSDMPTPGTSATPGLRPGLGKPPAIDPLVNQAAAGLRTPLAVPGPYPAPFGMVPHAGMNGELTSPGAAYASLHNMSPQMSAAAAAAAVVAYGRSPMVGFDPPPHMRVPTIPPNLAGIPGGKPAYSFHVTADGQMQPVPFPPDALIGPGIPRHARQINTLNHGEVVCAVTISNPTRHVYTGGKGCVKVWDISHPGNKSPVSQLDCLNRDNYIRSCKLLPDGCTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMESSNVEVLHVNKPDKYQLHLHESCVLSLKFAYCGKWFVSTGKDNLLNAWRTPYGASIFQSKESSSVLSCDISVDDKYIVTGSGDKKATVYEVIY

SEQ ID NO: 90002 - protein, 242 aa, Homo sapiens
  Payload ID: 18004
  Gene Name: transducin-like enhancer of split 1 (E(sp1) homolog, Drosophila)
  ENSP ID: ENSP00000391347
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGVRGLPGLPPTQQQLQAQHLSHGHGPPVPLTPHPSGLQPPGIPPLGGSAGLLALSSALSGQSHLAIKDDKKHHDAEHHRDREPGTSNSLLVPDSLRGTDKRRNGPEFSNDIKKRKVDDK

SEQ ID NO: 90003 - protein, 743 aa, Homo sapiens
  Payload ID: 18005
  Gene Name: transducin-like enhancer of split 2
  Uniprot ID: Q04725
  ENSP ID: ENSP00000262953
MYPQGRHPTPLQSGQPFKFSILEICDRIKEEFQFLQAQYHSLKLECEKLASEKTEMQRHYVMYYEMSYGLNIEMHKQAEIVKRLSGICAQIIPFLTQEHQQQVLQAVERAKQVTVGELNSLIGQQLQPLSHHAPPVPLTPRPAGLVGGSATGLLALSGALAAQAQLAAAVKEDRAGVEAEGSRVERAPSRSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 90004 - protein, 621 aa, Homo sapiens
  Payload ID: 18005
  Gene Name: transducin-like enhancer of split 2
  Uniprot ID: Q04725
  ENSP ID: ENSP00000392427
MQRHYVMYYEMSYGLNIEMHKQAEIVKRLSGICAQIIPFLTQEHQQQVLQAVERAKQVTVGELNSLIGSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 90005 - protein, 706 aa, Homo sapiens
  Payload ID: 18005
  Gene Name: transducin-like enhancer of split 2
  Uniprot ID: Q04725
  ENSP ID: ENSP00000392869
MVQSRLTATSASQDSPASGLQTPLQSGQPFKFSILEICDRIKEEFQFLQAQYHSLKLECEKLASEKTEMQRHYVMYYEMSYGLNIEMHKQAEIVKRLSGICAQIIPFLTQEHQQQVLQAVERAKQVTVGELNSLIGQQQLQPLSHHAPPVPLTPRPAGLVGGSATGLLALSGALAAQAQLAAAVKEDRAGVEAEGSRVERAPSRSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCVQGVVLSPEL

SEQ ID NO: 90006 - protein, 621 aa, Homo sapiens; identical to SEQ ID NO: 90004
  Payload ID: 18005
  Gene Name: transducin-like enhancer of split 2
  Uniprot ID: Q04725
  ENSP ID: ENSP00000413107

SEQ ID NO: 90007 - protein, 280 aa, Homo sapiens
  Payload ID: 18005
  Gene Name: transducin-like enhancer of split 2
  ENSP ID: ENSP00000465292
  MOD_RES (1)..(1): Any amino acid
XQEHQQQVLQAVERAKQVTVGELNSLIGVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSS

SEQ ID NO: 90008 - protein, 119 aa, Homo sapiens
  Payload ID: 18005
  Gene Name: transducin-like enhancer of split 2
  ENSP ID: ENSP00000465519
MQRHYVMYYEMSYGLNIEMHKQAEIVKRLSGICAQIIPFLTQEHQQQVLQAVERAKQVTVGELNSLIGQQLQPLSHHAPPVPLTPPLPRNRTSHLLSGQRLHTFPCCMWGPMGRGPRWK

SEQ ID NO: 90009 - protein, 744 aa, Homo sapiens
  Payload ID: 18005
  Gene Name: transducin-like enhancer of split 2
  ENSP ID: ENSP00000466542
MYPQGRHPTPLQSGQPFKFSILEICDRIKEEFQFLQAQYHSLKLECEKLASEKTEMQRHYVMYYEMSYGLNIEMHKQAEIVKRLSGICAQIIPFLTQEHQQQVLQAVERAKQVTVGELNSLIGQQQLQPLSHHAPPVPLTPRPAGLVGGSATGLLALSGALAAQAQLAAAVKEDRAGVEAEGSRVERAPSRSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 90010 - protein, 131 aa, Homo sapiens
  Payload ID: 18005
  Gene Name: transducin-like enhancer of split 2
  ENSP ID: ENSP00000467337
  MOD_RES (1)..(1): Any amino acid
XQTPLQSGQPFKFSILEICDRIKEEFQFLQAQYHSLKLECEKLASEKTEMQRHYVMYYEMSYGLNIEMHKQSASPSPPESLVEEERPSGPGGGGKQRADEKEPSGPYESDEDKSDYNLVVDEDQPSEPPSP

SEQ ID NO: 90011 - protein, 140 aa, Homo sapiens
  Payload ID: 18005
  Gene Name: transducin-like enhancer of split 2
  ENSP ID: ENSP00000467358
MYPQGRHPTPLQSGQPFKFSILEICDRIKEEFQFLQAQYHSLKLECEKLASEKTEMQRHYVMYYEMSYGLNIEMHKQAEIVKRLSGICAQIIPFLTQESASPSPPESLVEEERPSGPGGGGKQRADEKEPSGPYESDEDK

SEQ ID NO: 90012 - protein, 706 aa, Homo sapiens; identical to SEQ ID NO: 90005
  Payload ID: 18005
  Gene Name: transducin-like enhancer of split 2
  Uniprot ID: Q04725
  ENSP ID: ENSP00000468279

SEQ ID NO: 90013 - protein, 178 aa, Homo sapiens
  Payload ID: 18005
  Gene Name: transducin-like enhancer of split 2
  ENSP ID: ENSP00000468666
MYPQGRHPTPLQSGQPFKFSILEICDRIKEEFQFLQAQYHSLKLECEKLASEKTEMQRHYVMYYEMSYGLNIEMHKQAEIVKRLSGICAQIIPFLTQEHQQQVLQAVERAKQVTVGELNSLIGQQQLQPLSHHAPPVPLTPRPAGLVGGSATGLLALSGALAAQAQLAAAVKEDRAGV

SEQ ID NO: 90014 - protein, 760 aa, Homo sapiens
  Payload ID: 18006
  Gene Name: transducin-like enhancer of split 3
  Uniprot ID: Q04726
  ENSP ID: ENSP00000319233
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPASALRTPISITSSYAAPFAMMSHHEMNGSLTSPGAYAGLHNIPPQMSAAAAAAAAAYGRSPMVSFGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 90015 - protein, 769 aa, Homo sapiens
  Payload ID: 18006
  Gene Name: transducin-like enhancer of split 3
  Uniprot ID: Q04726
  ENSP ID: ENSP00000394717
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPMVSFGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 90016 - protein, 762 aa, Homo sapiens
  Payload ID: 18006
  Gene Name: transducin-like enhancer of split 3
  Uniprot ID: Q04726
  ENSP ID: ENSP00000415057
MAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPMVSFGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 90017 - protein, 699 aa, Homo sapiens
  Payload ID: 18006
  Gene Name: transducin-like enhancer of split 3
  ENSP ID: ENSP00000442594
MSYGLNIEMHKQTEIAKRLNTILAQIMPFLSQEHQQQVAQAVERAKQVTMTELNAIIGVRGLPNLPLTQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPASALRTPISITSSYAAPFAMMSHHEMNGSLTSPGAYAGLHNIPPQMSAAAAAAAAAYGRSPMVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 90018 - protein, 445 aa, Homo sapiens
  Payload ID: 18006
  Gene Name: transducin-like enhancer of split 3
  ENSP ID: ENSP00000452803
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPMVGFDPHPPMRATGLPSSLASIPGGKPVLIPCEC

SEQ ID NO: 90019 - protein, 154 aa, Homo sapiens
  Payload ID: 18006
  Gene Name: transducin-like enhancer of split 3
  ENSP ID: ENSP00000452809
MRPRAWGAVGAPTPAGGAAWIWGDERQVPTTAQPQGGPERGHNLVLPSPSPASIAGATWRRYYEMSYGLNIEMHKQTEIAKRLNTILAQIMPFLSQEHQQQVAQAVERAKQVTMTELNAIIGQQQLQAQHLSHATHGPPVQLPPHPSGLQPPGI

SEQ ID NO: 90020 - protein, 772 aa, Homo sapiens
  Payload ID: 18006
  Gene Name: transducin-like enhancer of split 3
  Uniprot ID: Q04726
  ENSP ID: ENSP00000452871
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIGIMASALRTPISITSSYAAPFAMMSHHEMNGSLTSPGAYAGLHNIPPQMSAAAAAAAAAYGRSPMVSFGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 90021 - protein, 778 aa, Homo sapiens
  Payload ID: 18006
  Gene Name: transducin-like enhancer of split 3
  ENSP ID: ENSP00000452881
MPPPPPLSCLRGLQAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIGIMASALRTPISITSSYAAPFAMMSHHEMNGSLTSPGAYAGLHNIPPQMSAAAAAAAAAYGRSPMVSFGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 90022 - protein, 774 aa, Homo sapiens
  Payload ID: 18006
  Gene Name: transducin-like enhancer of split 3
  ENSP ID: ENSP00000452933
MPPPPPLSCLRGLQAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPMVSFGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 90023 - protein, 782 aa, Homo sapiens
  Payload ID: 18006
  Gene Name: transducin-like enhancer of split 3
  ENSP ID: ENSP00000453081
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGVRGLPNLPLTQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIGIMASALRTPISITSSYAAPFAMMSHHEMNGSLTSPGAYAGLHNIPPQMSAAAAAAAAAYGRSPMVSFGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 90024 - protein, 764 aa, Homo sapiens
  Payload ID: 18006
  Gene Name: transducin-like enhancer of split 3
  Uniprot ID: Q04726
  ENSP ID: ENSP00000453083
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPMVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 90025 - protein, 764 aa, Homo sapiens; identical to SEQ ID NO: 90024
  Payload ID: 18006
  Gene Name: transducin-like enhancer of split 3
  Uniprot ID: Q04726
  ENSP ID: ENSP00000453107

SEQ ID NO: 90026 - protein, 611 aa, Homo sapiens
  Payload ID: 18006
  Gene Name: transducin-like enhancer of split 3
  ENSP ID: ENSP00000453219
  MOD_RES (1)..(1): Any amino acid
XPPTTLPPAPRLFVSTWGGRPTLGFRCENELGGPGASSRFPGRPPLGLGSPLPRTSPARALGASTLSESRPLPAMYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIASALRTPISITSSYAAPFAMMSHHEMNGSLTSPGAYAGLHNIPPQMSAAAAAAAAAYGRSPMVSFGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLGQLHPLLQAAP

SEQ ID NO: 90027 - protein, 448 aa, Homo sapiens
  Payload ID: 18006
  Gene Name: transducin-like enhancer of split 3
  ENSP ID: ENSP00000453373
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIGIMASALRTPISITSSYAAPFAMMSHHEMNGSLTSPGAYAGLHNIPPQMSAAAAAAAAAYGRSPMVGFDPHPPMRATGLPSSLASIPGGKPVLIPCEC

SEQ ID NO: 90028 - protein, 767 aa, Homo sapiens
  Payload ID: 18006
  Gene Name: transducin-like enhancer of split 3
  Uniprot ID: Q04726
  ENSP ID: ENSP00000453435
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIGIMASALRTPISITSSYAAPFAMMSHHEMNGSLTSPGAYAGLHNIPPQMSAAAAAAAAAYGRSPMVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 90029 - protein, 772 aa, Homo sapiens
  Payload ID: 18006
  Gene Name: transducin-like enhancer of split 3
  Uniprot ID: Q04726
  ENSP ID: ENSP00000453760
MPPPPPLSCLRGLQAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIGIMASALRTPISITSSYAAPFAMMSHHEMNGSLTSPGAYAGLHNIPPQMSAAAAAAAAAYGRSPMVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 90030 - protein, 353 aa, Homo sapiens
  Payload ID: 18006
  Gene Name: transducin-like enhancer of split 3
  ENSP ID: ENSP00000454029
MVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 90031 - protein, 716 aa, Homo sapiens
  Payload ID: 18006
  Gene Name: transducin-like enhancer of split 3
  ENSP ID: ENSP00000454141
MQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIGIMASALRTPISITSSYAAPFAMMSHHEMNGSLTSPGAYAGLHNIPPQMSAAAAAAAAAYGRSPMVSFGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 90032 - protein, 39 aa, Homo sapiens
  Payload ID: 18006
  Gene Name: transducin-like enhancer of split 3
  ENSP ID: ENSP00000456178
VAQAVERAKQVTMTELNAIIGIRKFEAPGLEVTCPRPHS

SEQ ID NO: 90033 - protein, 103 aa, Homo sapiens
  Payload ID: 18006
  Gene Name: transducin-like enhancer of split 3
  ENSP ID: ENSP00000457641
MQRHYVMYYEMSYGLNIEMHKQTEIAKRLNTILAQIMPFLSQEHQQQVAQAVERAKQVTMTELNAIIGVRGLPNLPLTQQQLQAQHLSHATHGPPVQLPPHPS

SEQ ID NO: 90034 - protein, 772 aa, Homo sapiens
  Payload ID: 18006
  Gene Name: transducin-like enhancer of split 3
  ENSP ID: ENSP00000485965
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRGAAGLGNNSVSPSESLRASEKHRGSADYSMEAKKRKAEEKDSLSRYDSDGDKSDDLVVDVSNEDPATPRVSPAHSPPENGLDKARSLKKDAPTSPASVASSSSTPSSKTKDLGHNDKSSTPGLKSNTPTPRNDAPTPGTSTTPGLRSMPGKPPGMDPIGIMASALRTPISITSSYAAPFAMMSHHEMNGSLTSPGAYAGLHNIPPQMSAAAAAAAAAYGRSPMVSFGAVGFDPHPPMRATGLPSSLASIPGGKPAYSFHVSADGQMQPVPFPHDALAGPGIPRHARQINTLSHGEVVCAVTISNPTRHVYTGGKGCVKIWDISQPGSKSPISQLDCLNRDNYIRSCKLLPDGRTLIVGGEASTLTIWDLASPTPRIKAELTSSAPACYALAISPDAKVCFSCCSDGNIAVWDLHNQTLVRQFQGHTDGASCIDISHDGTKLWTGGLDNTVRSWDLREGRQLQQHDFTSQIFSLGYCPTGEWLAVGMESSNVEVLHHTKPDKYQLHLHESCVLSLKFAYCGKWFVSTGKDNLLNAWRTPYGASIFQSKESSSVLSCDISADDKYIVTGSGDKKATVYEVIY

SEQ ID NO: 90035 - protein, 748 aa, Homo sapiens
  Payload ID: 18007
  Gene Name: transducin-like enhancer of split 4
  Uniprot ID: Q04727
  ENSP ID: ENSP00000265284
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 90036 - protein, 805 aa, Homo sapiens
  Payload ID: 18007
  Gene Name: transducin-like enhancer of split 4
  Uniprot ID: Q04727
  ENSP ID: ENSP00000365720
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLKRDMGKLSETRLSEDEQCTLGLQRWFCRLWFMNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 90037 - protein, 704 aa, Homo sapiens
  Payload ID: 18007
  Gene Name: transducin-like enhancer of split 4
  Uniprot ID: Q04727
  ENSP ID: ENSP00000365727
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 90038 - protein, 773 aa, Homo sapiens
  Payload ID: 18007
  Gene Name: transducin-like enhancer of split 4
  Uniprot ID: Q04727
  ENSP ID: ENSP00000365735
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 90039 - protein, 128 aa, Homo sapiens
  Payload ID: 18007
  Gene Name: transducin-like enhancer of split 4
  ENSP ID: ENSP00000397822
MIRDLSKMYPQTRHPAPHQPAQPFKFTISESCDRIKEEFQFLQAQYHSLKLECEKLASEKTEMQRHYVMAEIVKRLNAICAQVIPFLSQEHQQQVVQAVERAKQVTMAELNAIIGQQQLQAQHLSHGH

SEQ ID NO: 90040 - protein, 211 aa, Homo sapiens
  Payload ID: 18007
  Gene Name: transducin-like enhancer of split 4
  ENSP ID: ENSP00000400334
  MOD_RES (1)..(1): Any amino acid
XSPAHSPRENGLDKTRLLKKDAPISPASIASSSSTPSSKSKELSLKRDMGKLSETRLSEDEQCTLGLQRWFCRLWFMNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGK

SEQ ID NO: 90041 - protein, 322 aa, Homo sapiens
  Payload ID: 18007
  Gene Name: transducin-like enhancer of split 4
  ENSP ID: ENSP00000409313
APHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEKRDMGKLSETRLSEDEQCTLGLQRWFCRLWFMNEKSTTPVSKSNTPTPRTDAPTPGSNSTPGLRPVPGKPPGVDPL

SEQ ID NO: 90042 - protein, 195 aa, Homo sapiens
  Payload ID: 18007
  Gene Name: transducin-like enhancer of split 4
  ENSP ID: ENSP00000412567
MARVPPTGQFRFRAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQR

SEQ ID NO: 90043 - protein, 224 aa, Homo sapiens
  Payload ID: 18007
  Gene Name: transducin-like enhancer of split 4
  ENSP ID: ENSP00000415423
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGEKKNKSDTPGSLKQQQLQAQHLSHGHGLPVPLTPHPSGLQPPAIPPIGSSAGLLALSSALGGQSHLPIKDEKKHHDNDHQRGEQRLHQELFSIP

SEQ ID NO: 90044 - protein, 343 aa, Homo sapiens
  Payload ID: 18007
  Gene Name: transducin-like enhancer of split 4
  ENSP ID: ENSP00000417102
  MOD_RES (1)..(1): Any amino acid
XASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPTKCFYHLRAFPGNELEMELPRDTHRAYSFHVSADGQMQPVPFPPDALIGPGIPRHARQINTLNHGEVVCAVTISNPTRHVYTGGKGCVKVWDISHPGNKSPVSQL

SEQ ID NO: 90045 - protein, 90 aa, Homo sapiens
  Payload ID: 18007
  Gene Name: transducin-like enhancer of split 4
  ENSP ID: ENSP00000417245
MIRDLSKMYPQTRHPAPHQPAQPFKFTISESCDRIKEEFQFLQAQYHSLKLECEKLASEKTEMQRHYVMYYEMSYGLNIEMHKQRLFFTN

SEQ ID NO: 90046 - protein, 259 aa, Homo sapiens
  Payload ID: 18007
  Gene Name: transducin-like enhancer of split 4
  ENSP ID: ENSP00000417715
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKQNYLLLIMDEIGDQRGRTFWVPVSLNPDFKRHSPAMLVLCASTELFSIPISQFPRC

SEQ ID NO: 90047 - protein, 239 aa, Homo sapiens
  Payload ID: 18007
  Gene Name: transducin-like enhancer of split 4
  ENSP ID: ENSP00000417844
QQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNENEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSP

SEQ ID NO: 90048 - protein, 101 aa, Homo sapiens
  Payload ID: 18007
  Gene Name: transducin-like enhancer of split 4
  ENSP ID: ENSP00000417906
MIRDLSKMYPQTRHPAPHQPAQPFKFTISESCDRIKEEFQFLQAQYHSLKLECEKLASEKTEMQRHYVMYYEMSYGLNIEMHKQVSYFFITILNDSNTGTL

SEQ ID NO: 90049 - protein, 165 aa, Homo sapiens
  Payload ID: 18007
  Gene Name: transducin-like enhancer of split 4
  ENSP ID: ENSP00000418409
SSSVSPSASFRGAEKHRNSADYSSESKKQKTEEKEIAARYNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPP

SEQ ID NO: 90050 - protein, 572 aa, Homo sapiens
  Payload ID: 18008
  Gene Name: transducin-like enhancer of split 6
  Uniprot ID: Q9H808
  ENSP ID: ENSP00000246112
MTSRDQPRPKGPPKSTSPCPGISNSESSPTLNYQGILNRLKQFPRFSPHFAAELESIYYSLHKIQQDVAEHHKQIGNVLQIVESCSQLQGFQSEEVSPAEPASPGTPQQVKDKTLQESSFEDIMATRSSDWLRRPLGEDNQPETQLFWDKEPWFWHDTLTEQLWRIFAGVHDEKAKPRDRQQAPGLGQESKAPGSCDPGTDPCPEDASTPRPPEASSSPPEGSQDRNTSWGVVQEPPGRASRFLQSISWDPEDFEDAWKRPDALPGQSKRLAVPCKLEKMRILAHGELVLATAISSFTRHVFTCGRRGIKVWSLTGQVAEDRFPESHLPIQTPGAFLRTCLLSSNSRSLLTGGYNLASVSVWDLAAPSLHVKEQLPCAGLNCQALDANLDANLAFASFTSGVVRIWDLRDQSVVRDLKGYPDGVKSIVVKGYNIWTGGPDACLRCWDQRTIMKPLEYQFKSQIMSLSHSPQEDWVLLGMANGQQWLQSTSGSQRHMVGQKDSVILSVKFSPFGQWWASVGMDDFLGVYSMPAGTKVFEVPEMSPVTCCDVSSNNRLVVTGSGEHASVYQITY

SEQ ID NO: 90051 - protein, 449 aa, Homo sapiens
  Payload ID: 18008
  Gene Name: transducin-like enhancer of split 6
  Uniprot ID: Q9H808
  ENSP ID: ENSP00000406893
MATRSSDWLRRPLGEDNQPETQLFWDKEPWFWHDTLTEQLWRIFAGVHDEKAKPRDRQQAPGLGQESKAPGSCDPGTDPCPEDASTPRPPEASSSPPEGSQDRNTSWGVVQEPPGRASRFLQSISWDPEDFEDAWKRPDALPGQSKRLAVPCKLEKMRILAHGELVLATAISSFTRHVFTCGRRGIKVWSLTGQVAEDRFPESHLPIQTPGAFLRTCLLSSNSRSLLTGGYNLASVSVWDLAAPSLHVKEQLPCAGLNCQALDANLDANLAFASFTSGVVRIWDLRDQSVVRDLKGYPDGVKSIVVKGYNIWTGGPDACLRCWDQRTIMKPLEYQFKSQIMSLSHSPQEDWVLLGMANGQQWLQSTSGSQRHMVGQKDSVILSVKFSPFGQWWASVGMDDFLGVYSMPAGTKVFEVPEMSPVTCCDVSSNNRLVVTGSGEHASVYQITY

SEQ ID NO: 90052 - protein, 154 aa, Homo sapiens
  Payload ID: 18008
  Gene Name: transducin-like enhancer of split 6
  ENSP ID: ENSP00000411783
MTSRDQPRPKGPPKSTSPCPGISNSESSPTLNYQGILNRLKQFPRFSPHFAAELESIYYSLHKIQQDVAEHHKQIGNVLQIVESCSQLQGFQSEEVSPAEPASPGTPQQVKDKTLQESSFEDIMATRSSDWLRRPLGEDNQPETQLFWDKEPWF

SEQ ID NO: 90053 - protein, 45 aa, Homo sapiens
  Payload ID: 18008
  Gene Name: transducin-like enhancer of split 6
  ENSP ID: ENSP00000467126
MTSRDQPRPKGPPKSTSPCPGISNSESSPTLNYQGILNRLKQFPR

SEQ ID NO: 90054 - protein, 416 aa, Homo sapiens
  Payload ID: 18008
  Gene Name: transducin-like enhancer of split 6
  ENSP ID: ENSP00000483606
MATRSSDWLRRPLGEDNQPETQLFWDKEPWFWHDTLTEQLWRIFAGVHDEKAKPRDRQQAPGLGQESKAPGSCDPGTDPCPEDASTPRPPEASSSPPEGSQDRNTSWGVVQEPPGRASRFLQSISWDPEDFEDAWKRPDALPGQSKRLAVPCKLEKMRILAHGELVLATAISSFTRHVFTCGRRGIKVWSLTGQVAEDRFPESHLPIQTPGAFLRTCLLSSNSRSLLTGGYNLASVSVWDLAAPSLHVKEQLPCAGLNCQALDANLDANLAFASFTSGVVRIWDLRDQSVVRDLKGYPDGVKSIVVKGYNIWTGGPDACLRCWDQRTIMKPLEYQFKSQIMSLSHSPQEDWVLLGMANGQQWLQSTSGSQRHMVGQRQRHPERQVLPLWPVVGKRWNGRLPWRLQHAGGDKSVRGA

SEQ ID NO: 90055 - protein, 698 aa, Homo sapiens
  Payload ID: 18009
  Gene Name: transferrin
  Uniprot ID: P02787
  ENSP ID: ENSP00000385834
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAIAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 90056 - protein, 115 aa, Homo sapiens
  Payload ID: 18009
  Gene Name: transferrin
  ENSP ID: ENSP00000401505
MRLAVGALLVCAVLGLCLAVPDKTVRWCAVSEHEATKCQSFRDHMKSVIPSDGPSVACVKKASYLDCIRAIAVSRCCLKESGRKPYFLCFQSLWNNSLLTGKRSGCCDTGCRFGV

SEQ ID NO: 90057 - protein, 75 aa, Homo sapiens
  Payload ID: 18009
  Gene Name: transferrin
  ENSP ID: ENSP00000417468
MKSVIPSDGPSVACVKKASYLDCIRAIAANEADAVTLDAGLVYDAYLAPNNLKPVVAEFYGSKEDPQTFYYAVAV

SEQ ID NO: 90058 - protein, 120 aa, Homo sapiens
  Payload ID: 18009
  Gene Name: transferrin
  ENSP ID: ENSP00000418396
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDFLLCCCCGEEG

SEQ ID NO: 90059 - protein, 102 aa, Homo sapiens
  Payload ID: 18009
  Gene Name: transferrin
  ENSP ID: ENSP00000418716
MRLAVGALLVCAVLGLCLAVPDKTVRWCAVSEHEATKCQSFRDHMKSVIPSDGPFSYRRGPKYGRQGGLDLGASQPGPGTFWQRQIKRIPTIQLSSWEGPAV

SEQ ID NO: 90060 - protein, 134 aa, Homo sapiens
  Payload ID: 18009
  Gene Name: transferrin
  ENSP ID: ENSP00000419338
MNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCH

SEQ ID NO: 90061 - protein, 143 aa, Homo sapiens
  Payload ID: 18009
  Gene Name: transferrin
  ENSP ID: ENSP00000419714
  MOD_RES (1)..(1): Any amino acid
XYFAIAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGETIQKRRGKGAEMGYRPVSHRKKP

SEQ ID NO: 90062 - protein, 760 aa, Homo sapiens
  Payload ID: 18010
  Gene Name: transferrin receptor
  Uniprot ID: P02786
  ENSP ID: ENSP00000353224
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 90063 - protein, 760 aa, Homo sapiens; identical to SEQ ID NO: 90062
  Payload ID: 18010
  Gene Name: transferrin receptor
  Uniprot ID: P02786
  ENSP ID: ENSP00000376197

SEQ ID NO: 90064 - protein, 679 aa, Homo sapiens
  Payload ID: 18010
  Gene Name: transferrin receptor
  ENSP ID: ENSP00000390133
MIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 90065 - protein, 81 aa, Homo sapiens
  Payload ID: 18010
  Gene Name: transferrin receptor
  ENSP ID: ENSP00000402839
MMDQARSAFSNLFGGEPLSYTRFSLARQVDGDNSHVEMKLAVDEEENADNNTKANVTKPKRCSGSICYGTIAVIVFFLIGC

SEQ ID NO: 90066 - protein, 118 aa, Homo sapiens
  Payload ID: 18010
  Gene Name: transferrin receptor
  ENSP ID: ENSP00000414015
AAAEVAGQFVIKLTHDVELNLDYERYNSQLLSFVRDLNQYRADIKEMGLSLQWLYSARGDFFRATSRLTTDFGNAEKTDRFVMKKLNDRVMREGPQMMLLLTDARPSNHFLSPLLSLH

SEQ ID NO: 90067 - protein, 801 aa, Homo sapiens
  Payload ID: 18011
  Gene Name: transferrin receptor 2
  Uniprot ID: Q9UP52
  ENSP ID: ENSP00000223051
MERLWGLFQRAQQLSPRSSQTVYQRVEGPRKGHLEEEEEDGEEGAETLAHFCPMELRGPEPLGSRPRQPNLIPWAAAGRRAAPYLVLTALLIFTGAFLLGYVAFRGSCQACGDSVLVVSEDVNYEPDLDFHQGRLYWSDLQAMFLQFLGEGRLEDTIRQTSLRERVAGSAGMAALTQDIRAALSRQKLDHVWTDTHYVGLQFPDPAHPNTLHWVDEAGKVGEQLPLEDPDVYCPYSAIGNVTGELVYAHYGRPEDLQDLRARGVDPVGRLLLVRVGVISFAQKVTNAQDFGAQGVLIYPEPADFSQDPPKPSLSSQQAVYGHVHLGTGDPYTPGFPSFNQTQFPPVASSGLPSIPAQPISADIASRLLRKLKGPVAPQEWQGSLLGSPYHLGPGPRLRLVVNNHRTSTPINNIFGCIEGRSEPDHYVVIGAQRDAWGPGAAKSAVGTAILLELVRTFSSMVSNGFRPRRSLLFISWDGGDFGSVGSTEWLEGYLSVLHLKAVVYVSLDNAVLGDDKFHAKTSPLLTSLIESVLKQVDSPNHSGQTLYEQVVFTNPSWDAEVIRPLPMDSSAYSFTAFVGVPAVEFSFMEDDQAYPFLHTKEDTYENLHKVLQGRLPAVAQAVAQLAGQLLIRLSHDRLLPLDFGRYGDVVLRHIGNLNEFSGDLKARGLTLQWVYSARGDYIRAAEKLRQEIYSSEERDERLTRMYNVRIMRVEFYFLSQYVSPADSPFRHIFMGRGDHTLGALLDHLRLLRSNSSGTPGATSSTGFQESRFRRQLALLTWTLQGAANALSGDVWNIDNNF

SEQ ID NO: 90068 - protein, 355 aa, Homo sapiens
  Payload ID: 18011
  Gene Name: transferrin receptor 2
  ENSP ID: ENSP00000413905
MERLWGLFQRAQQLSPRSSQTVYQRVEGPRKGHLEEEEEDGEEGAETLAHFCPMELRGPEPLGSRPRQPNLIPWAAAGRRAAPYLVLTALLIFTGAFLLGYVAFRGSCQACGDSVLVVSEDVNYEPDLDFHQGRLYWSDLQAMFLQFLGEGRLEDTIRQTSLRERVAGSAGMAALTQDIRAALSRQKLDHVWTDTHYVGLQFPDPAHPNTLHWVDEAGKVGEQLPLEDPDVYCPYSAIGNVTGELVYAHYGRPEDLQDLRARGVDPVGRLLLVRVGVISFAQKEAQRPCGPPRMAGEPPRLPLSPGPRATTAASGQQSQDLHPHQQHLRLHRRPLRARSLRCHRGPEGCMGPRSS

SEQ ID NO: 90069 - protein, 169 aa, Homo sapiens
  Payload ID: 18011
  Gene Name: transferrin receptor 2
  ENSP ID: ENSP00000418942
  MOD_RES (1)..(1): Any amino acid
XYGRPEDLQDLRARGVDPVGRLLLVRVGVISFAQKVTNAQDFGAQGVLIYPEPADFSQDPPKPSLSSQQAVYGHVHLGTGDPYTPGFPSFNQTQFPPVASSGLPSIPAQPISADIASRLLRLECSGAILAHCNLHLPGSSDSSASDSRVSRITGSSKALWPPKNGRGAS

SEQ ID NO: 90070 - protein, 801 aa, Homo sapiens; identical to SEQ ID NO: 90067
  Payload ID: 18011
  Gene Name: transferrin receptor 2
  Uniprot ID: Q9UP52
  ENSP ID: ENSP00000420525

SEQ ID NO: 90071 - protein, 3830 aa, Homo sapiens
  Payload ID: 18012
  Gene Name: transformation/transcription domain-associated protein
  Uniprot ID: Q9Y4A5
  ENSP ID: ENSP00000347733
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQAIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 90072 - protein, 3859 aa, Homo sapiens
  Payload ID: 18012
  Gene Name: transformation/transcription domain-associated protein
  Uniprot ID: Q9Y4A5
  ENSP ID: ENSP00000352925
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNESISECGRCPLSPFCQFEEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQGKPTWSGMHSSSIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 90073 - protein, 3588 aa, Homo sapiens
  Payload ID: 18012
  Gene Name: transformation/transcription domain-associated protein
  ENSP ID: ENSP00000394645
  MOD_RES (1)..(1): Any amino acid
XTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNESISECGRCPLSPFCQFEPAMEGVEEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQAIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDSGQQQPSSVGNQSHSASDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 90074 - protein, 71 aa, Homo sapiens
  Payload ID: 18012
  Gene Name: transformation/transcription domain-associated protein
  ENSP ID: ENSP00000401107
MAFVATQGATVVDQTTLMKKYLQFVAALTDVNTPDETKLKMMQEVSENFENVTSSPQYSTFLEHIIPRFLT

SEQ ID NO: 90075 - protein, 3848 aa, Homo sapiens
  Payload ID: 18012
  Gene Name: transformation/transcription domain-associated protein
  ENSP ID: ENSP00000403708
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSAGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQAIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDSGQQQPSSVGNQSHSASDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 90076 - protein, 3848 aa, Homo sapiens; identical to SEQ ID NO: 90075
  Payload ID: 18012
  Gene Name: transformation/transcription domain-associated protein
  ENSP ID: ENSP00000485781

SEQ ID NO: 90077 - protein, 282 aa, Homo sapiens
  Payload ID: 18013
  Gene Name: transformer 2 alpha homolog (Drosophila)
  Uniprot ID: Q13595
  ENSP ID: ENSP00000297071
MSDVEENNFEGRESRSQSKSPTGTPARVKSESRSGSRSPSRVSKHSESHSRSRSKSRSRSRRHSHRRYTRSRSHSHSHRRRSRSRSYTPEYRRRRSRSHSPMSNRRRHTGSRANPDPNTCLGVFGLSLYTTERDLREVFSRYGPLSGVNVVYDQRTGRSRGFAFVYFERIDDSKEAMERANGMELDGRRIRVDYSITKRAHTPTPGIYMGRPTHSGGGGGGGGGGGGGGGGRRRDSYYDRGYDRGYDRYEDYDYRYRRRSPSPYYSRYRSRSRSRSYSPRRY

SEQ ID NO: 90078 - protein, 180 aa, Homo sapiens
  Payload ID: 18013
  Gene Name: transformer 2 alpha homolog (Drosophila)
  Uniprot ID: Q13595
  ENSP ID: ENSP00000376290
MSNRRRHTGSRANPDPNTCLGVFGLSLYTTERDLREVFSRYGPLSGVNVVYDQRTGRSRGFAFVYFERIDDSKEAMERANGMELDGRRIRVDYSITKRAHTPTPGIYMGRPTHSGGGGGGGGGGGGGGGGRRRDSYYDRGYDRGYDRYEDYDYRYRRSPSPYYSRYRSRSRSRSYSPRRY

SEQ ID NO: 90079 - protein, 63 aa, Homo sapiens
  Payload ID: 18013
  Gene Name: transformer 2 alpha homolog (Drosophila)
  ENSP ID: ENSP00000413898
MSDVEENNFEGRVNVREEIEEFFPRMWKINQDKRRLMKRVSLSVKISNGNSCSCKIGEQVRIS

SEQ ID NO: 90080 - protein, 181 aa, Homo sapiens
  Payload ID: 18013
  Gene Name: transformer 2 alpha homolog (Drosophila)
  Uniprot ID: Q13595
  ENSP ID: ENSP00000441116
MSNRRRHTGSRANPDPNTCLGVFGLSLYTTERDLREVFSRYGPLSGVNVVYDQRTGRSRGFAFVYFERIDDSKEAMERANGMELDGRRIRVDYSITKRAHTPTPGIYMGRPTHSGGGGGGGGGGGGGGGGRRRDSYYDRGYDRGYDRYEDYDYRYRRRSPSPYYSRYRSRSRSRSYSPRRY

SEQ ID NO: 90081 - protein, 181 aa, Homo sapiens; identical to SEQ ID NO: 90080
  Payload ID: 18013
  Gene Name: transformer 2 alpha homolog (Drosophila)
  Uniprot ID: Q13595
  ENSP ID: ENSP00000480822

SEQ ID NO: 90082 - protein, 127 aa, Homo sapiens
  Payload ID: 18014
  Gene Name: transformer 2 beta homolog (Drosophila)
  ENSP ID: ENSP00000259043
  MOD_RES (1)..(1): Any amino acid
XPIADVSIVYDQQSRRSRGFAFVYFENVDDAKEAKERANGMELDGRRIRVDFSITKRPHTPTPGIYMGRPTYGSSRRRDYYDRGYDRGYDDRDYYSRSYRRRSPSPYYSRGGYRSRSRSRSYSPRRY

SEQ ID NO: 90083 - protein, 38 aa, Homo sapiens
  Payload ID: 18014
  Gene Name: transformer 2 beta homolog (Drosophila)
  Uniprot ID: P62995
  ENSP ID: ENSP00000343857
MSDSGEQNYGERVNVEEGKCGSRHLTSFINEYLKLRNK

SEQ ID NO: 90084 - protein, 188 aa, Homo sapiens
  Payload ID: 18014
  Gene Name: transformer 2 beta homolog (Drosophila)
  Uniprot ID: P62995
  ENSP ID: ENSP00000371626
MSTRRRHVGNRANPDPNCCLGVFGLSLYTTERDLREVFSKYGPIADVSIVYDQQSRRSRGFAFVYFENVDDAKEAKERANGMELDGRRIRVDFSITKRPHTPTPGIYMGRPTYGSSRRRDYYDRGYDRGYDDRDYYSRSYRGGGGGGGGWRAAQDRDQIYRRRSPSPYYSRGGYRSRSRSRSYSPRRY

SEQ ID NO: 90085 - protein, 107 aa, Homo sapiens
  Payload ID: 18014
  Gene Name: transformer 2 beta homolog (Drosophila)
  ENSP ID: ENSP00000406561
  MOD_RES (1)..(1): Any amino acid
XMELDGRRIRVDFSITKRPHTPTPGIYMGRPTYGSSRRRDYYDRGYDRGYDDRDYYSRSYRGGGGGGGGWRAAQDRDQIYRRSPSPYYSRGGYRSRSRSRSYSPRRY

SEQ ID NO: 90086 - protein, 38 aa, Homo sapiens; identical to SEQ ID NO: 90083
  Payload ID: 18014
  Gene Name: transformer 2 beta homolog (Drosophila)
  Uniprot ID: P62995
  ENSP ID: ENSP00000416887

SEQ ID NO: 90087 - protein, 288 aa, Homo sapiens
  Payload ID: 18014
  Gene Name: transformer 2 beta homolog (Drosophila)
  Uniprot ID: P62995
  ENSP ID: ENSP00000416959
MSDSGEQNYGERESRSASRSGSAHGSGKSARHTPARSRSKEDSRRSRSKSRSRSESRSRSRRSSRRHYTRSRSRSRSHRRSRSRSYSRDYRRRHSHSHSPMSTRRRHVGNRANPDPNCCLGVFGLSLYTTERDLREVFSKYGPIADVSIVYDQQSRRSRGFAFVYFENVDDAKEAKERANGMELDGRRIRVDFSITKRPHTPTPGIYMGRPTYGSSRRRDYYDRGYDRGYDDRDYYSRSYRGGGGGGGGWRAAQDRDQIYRRRSPSPYYSRGGYRSRSRSRSYSPRRY

SEQ ID NO: 90088 - protein, 444 aa, Homo sapiens
  Payload ID: 18015
  Gene Name: transforming growth factor beta 1 induced transcript 1
  Uniprot ID: O43294
  ENSP ID: ENSP00000355117
MPRSGAPKERPAEPLTPPPSYGHQPQTGSGESSGASGDKDHLYSTVCKPRSPKPAAPAAPPFSSSSGVLGTGLCELDRLLQELNATQFNITDEIMSQFPSSKVASGEQKEDQSEDKKRPSLPSSPSPGLPKASATSATLELDRLMASLSDFRVQNHLPASGPTQPPVVSSTNEGSPSPPEPTGKGSLDTMLGLLQSDLSRRGVPTQAKGLCGSCNKPIAGQVVTALGRAWHPEHFVCGGCSTALGGSSFFEKDGAPFCPECYFERFSPRCGFCNQPIRHKMVTALGTHWHPEHFCCVSCGEPFGDEGFHEREGRPYCRRDFLQLFAPRCQGCQGPILDNYISALSALWHPDCFVCRECFAPFSGGSFFEHEGRPLCENHFHARRGSLCATCGLPVTGRCVSALGRRFHPDHFTCTFCLRPLTKGSFQERAGKPYCQPCFLKLFG

SEQ ID NO: 90089 - protein, 444 aa, Homo sapiens; identical to SEQ ID NO: 90088
  Payload ID: 18015
  Gene Name: transforming growth factor beta 1 induced transcript 1
  Uniprot ID: O43294
  ENSP ID: ENSP00000378327

SEQ ID NO: 90090 - protein, 461 aa, Homo sapiens
  Payload ID: 18015
  Gene Name: transforming growth factor beta 1 induced transcript 1
  Uniprot ID: O43294
  ENSP ID: ENSP00000378332
MEDLDALLSDLETTTSHMPRSGAPKERPAEPLTPPPSYGHQPQTGSGESSGASGDKDHLYSTVCKPRSPKPAAPAAPPFSSSSGVLGTGLCELDRLLQELNATQFNITDEIMSQFPSSKVASGEQKEDQSEDKKRPSLPSSPSPGLPKASATSATLELDRLMASLSDFRVQNHLPASGPTQPPVVSSTNEGSPSPPEPTGKGSLDTMLGLLQSDLSRRGVPTQAKGLCGSCNKPIAGQVVTALGRAWHPEHFVCGGCSTALGGSSFFEKDGAPFCPECYFERFSPRCGFCNQPIRHKMVTALGTHWHPEHFCCVSCGEPFGDEGFHEREGRPYCRRDFLQLFAPRCQGCQGPILDNYISALSALWHPDCFVCRECFAPFSGGSFFEHEGRPLCENHFHARRGSLCATCGLPVTGRCVSALGRRFHPDHFTCTFCLRPLTKGSFQERAGKPYCQPCFLKLFG

SEQ ID NO: 90091 - protein, 114 aa, Homo sapiens
  Payload ID: 18015
  Gene Name: transforming growth factor beta 1 induced transcript 1
  ENSP ID: ENSP00000454688
MPRSGAPKERPAEPLTPPPSYGHQPQTGSGESSGASGDKDHLYSTVCKPRSPKPAAPAAPPFSSSSGVLGTGLCELDRLLQELNATQFNITALPARLLASQRLLPPQPLWSWID

SEQ ID NO: 90092 - protein, 216 aa, Homo sapiens
  Payload ID: 18015
  Gene Name: transforming growth factor beta 1 induced transcript 1
  ENSP ID: ENSP00000455709
MPCSLTWRLPPRTCQGQGLPKSALRSLSPLPHPMATSHSTVCKPRSPKPAAPAAPPFSSSSGVLGTGLCELDRLLQELNATQFNITDEIMSQFPSSKVASGEQKEDQSEDKKRPSLPSSPSPGLPKASATSATLELDRLMASLSDFRVQNHLPASGPTQPPVVSSTNEGSPSPPEPTGKGSLDTMLGLLQSDLSRRGVPTQAKGLCGSCNKPIAGQ

SEQ ID NO: 90093 - protein, 52 aa, Homo sapiens
  Payload ID: 18015
  Gene Name: transforming growth factor beta 1 induced transcript 1
  ENSP ID: ENSP00000456341
MEDLDRVWGVFRSLGGQGPPVQHGMQASVPKACSPGGPSILLFQRCLGYRAL

SEQ ID NO: 90094 - protein, 89 aa, Homo sapiens
  Payload ID: 18015
  Gene Name: transforming growth factor beta 1 induced transcript 1
  ENSP ID: ENSP00000456482
MPRSGAPKERPAEPLTPPPSYGHQPQTGSGESSGASGDKDHLYSTVCKPRSPKPAAPAAPPFSSSSGVLGTGLCELDRLLQELNATQFN

SEQ ID NO: 90095 - protein, 165 aa, Homo sapiens
  Payload ID: 18015
  Gene Name: transforming growth factor beta 1 induced transcript 1
  ENSP ID: ENSP00000456783
MPRSGAPKERPAEPLTPPPSYGHQPQTGSGESSGASGDKDHLYSTVCKPRSPKPAAPAAPPFSSSSGVLGTGLCELDRLLQELNATQFNITDEIMSQFPSSKVASGEQKEDQSEDKKRPSLPSSPSPGLPKASATSATLELDRLMASLSDFRVQNHLPASGPTQP

SEQ ID NO: 90096 - protein, 444 aa, Homo sapiens; identical to SEQ ID NO: 90088
  Payload ID: 18015
  Gene Name: transforming growth factor beta 1 induced transcript 1
  Uniprot ID: O43294
  ENSP ID: ENSP00000457586

SEQ ID NO: 90097 - protein, 61 aa, Homo sapiens
  Payload ID: 18015
  Gene Name: transforming growth factor beta 1 induced transcript 1
  ENSP ID: ENSP00000459283
MEDLDALLSDLETTTSHMPRSGAPKERPAEPLTPPPSYGHQPQTGSGESSGASGDKDHLYR

SEQ ID NO: 90098 - protein, 160 aa, Homo sapiens
  Payload ID: 18016
  Gene Name: transforming growth factor beta regulator 1
  ENSP ID: ENSP00000284290
MSLLDGLASSPRAPLQSSKARMKKLPKKSQNEKYRLKYLRLRKAAKATVFENAAICDEIARLEEKFLKAKEERRYLLKKLLQLQALTEGEVQAAAPSHSSSLPLTYGVASSVGTIQGAGPISGPSTGAEEPFGKKTKKEKKEKGKENNKLEDHHRPTWLS

SEQ ID NO: 90099 - protein, 411 aa, Homo sapiens
  Payload ID: 18016
  Gene Name: transforming growth factor beta regulator 1
  Uniprot ID: Q3YBR2
  ENSP ID: ENSP00000409016
MSLLDGLASSPRAPLQSSKARMKKLPKKSQNEKYRLKYLRLRKAAKATVFENAAICDEIARLEEKFLKAKEERRYLLKKLLQLQALTEGEVQAAAPSHSSSLPLTYGVASSVGTIQGAGPISGPSTGAEEPFGKKTKKEKKEKGKENNKLEVLKKTCKKKKMAGGARKLVQPIALDPSGRPVFPIGLGGLTVYSLGEIITDRPGFHDESAIYPVGYCSTRIYASMKCPDQKCLYTCQIKDGGVQPQFEIVPEDDPQNAIVSSSADACHAELLRTISTTMGKLMPNLLPAGADFFGFSHPAIHNLIQSCPGARKCINYQWVKFDVCKPGDGQLPEGLPENDAAMSFEAFQRQIFDEDQNDPLLPGSLDLPELQPAAFVSSYQPMYLTHEPLVDTHLQHLKSPSQGSPIQSSD

SEQ ID NO: 90100 - protein, 112 aa, Homo sapiens
  Payload ID: 18016
  Gene Name: transforming growth factor beta regulator 1
  ENSP ID: ENSP00000435448
MSLLDGLASSPRAPLQSSKARMKKLPKKSQNEKYRLKYLRLRKAAKATVFIITDRPGFHDESAIYPVGYCSTRIYASMKCPDQKCLYTCQIKDGGVQPQFEIVPEDDPQNAI

SEQ ID NO: 90101 - protein, 160 aa, Homo sapiens; identical to SEQ ID NO: 90098
  Payload ID: 18016
  Gene Name: transforming growth factor beta regulator 1
  ENSP ID: ENSP00000436238

SEQ ID NO: 90102 - protein, 101 aa, Homo sapiens
  Payload ID: 18016
  Gene Name: transforming growth factor beta regulator 1
  ENSP ID: ENSP00000436599
MSLLDGLASSPRAPLQSSKARMKKLPKKSQNEKYRLKYLRLRKAAKATVFENAAICDEIARLEEKFLKAKEERRSSPTDLAFMMRVPSTPWAIAVLEYMPA

SEQ ID NO: 90103 - protein, 631 aa, Homo sapiens
  Payload ID: 18017
  Gene Name: transforming growth factor beta regulator 4
  Uniprot ID: Q969Z0
  ENSP ID: ENSP00000258770
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFHQLLCLLNSQIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKCLELVEHFGPNELRKVLVMLAAQSRRSVPLLRAISYHLVQKPFSLTKDVLLDVAYAYGKLSFHQTQVSQRLATDLLSLMPSLTSGEVAHCAKSFALLKWLSLPLFEAFAQHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 90104 - protein, 521 aa, Homo sapiens
  Payload ID: 18017
  Gene Name: transforming growth factor beta regulator 4
  Uniprot ID: Q969Z0
  ENSP ID: ENSP00000354992
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFHQLLCLLNSQIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 90105 - protein, 521 aa, Homo sapiens; identical to SEQ ID NO: 90104
  Payload ID: 18017
  Gene Name: transforming growth factor beta regulator 4
  Uniprot ID: Q969Z0
  ENSP ID: ENSP00000379016

SEQ ID NO: 90106 - protein, 103 aa, Homo sapiens
  Payload ID: 18017
  Gene Name: transforming growth factor beta regulator 4
  ENSP ID: ENSP00000417071
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMV

SEQ ID NO: 90107 - protein, 128 aa, Homo sapiens
  Payload ID: 18017
  Gene Name: transforming growth factor beta regulator 4
  ENSP ID: ENSP00000417324
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFH

SEQ ID NO: 90108 - protein, 248 aa, Homo sapiens
  Payload ID: 18017
  Gene Name: transforming growth factor beta regulator 4
  ENSP ID: ENSP00000417743
MEPVEKERASTPYIEKQVDHLIKKATRPEELLELLGGSHDLDSNQAAMVLIRLSHLLSEKPEDKGLLIQDAHFHQLLCLLNSQIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKCLELVEHFGPNELRKVLVMLAAQSRRSVPLLRAISYHLVQKPFSLTKDVLLDVAYAY

SEQ ID NO: 90109 - protein, 118 aa, Homo sapiens
  Payload ID: 18017
  Gene Name: transforming growth factor beta regulator 4
  ENSP ID: ENSP00000417967
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDK

SEQ ID NO: 90110 - protein, 274 aa, Homo sapiens
  Payload ID: 18017
  Gene Name: transforming growth factor beta regulator 4
  ENSP ID: ENSP00000417974
  MOD_RES (1)..(1): Any amino acid
XQTQVSQRLATDLLSLMPSLTSGEVAHCAKSFALLKWLSLPLFEAFAQHVLNRAQDITLPHLCSVLLAFARLNFHPDQEDQFFSLVHEKLGSELPGLEPALQVDLVWALCVLQQAREAELQAVLHPEFHIQFLGEPPAPSTTGTGKLPGLVCLVPGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSK

SEQ ID NO: 90111 - protein, 283 aa, Homo sapiens
  Payload ID: 18017
  Gene Name: transforming growth factor beta regulator 4
  ENSP ID: ENSP00000418631
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKCLELVEHFGPNELRKVLVMLAAQSRRSVPLLRAISYHLVQKPFSLTKDVLLDVAYAYGKLSFHQTQVSQRLAT

SEQ ID NO: 90112 - protein, 631 aa, Homo sapiens; identical to SEQ ID NO: 90103
  Payload ID: 18017
  Gene Name: transforming growth factor beta regulator 4
  Uniprot ID: Q969Z0
  ENSP ID: ENSP00000420597

SEQ ID NO: 90113 - protein, 160 aa, Homo sapiens
  Payload ID: 18018
  Gene Name: transforming growth factor, alpha
  Uniprot ID: P01135
  ENSP ID: ENSP00000295400
MVPSAGQLALFALGIVLAACQALENSTSPLSADPPVAAAVVSHFNDCPDSHTQFCFHGTCRFLVQEDKPACVCHSGYVGARCEHADLLAVVAASQKKQAITALVVVSIVALAVLIITCVLIHCCQVRKHCEWCRALICRHEKPSALLKGRTACCHSETVV

SEQ ID NO: 90114 - protein, 120 aa, Homo sapiens
  Payload ID: 18018
  Gene Name: transforming growth factor, alpha
  ENSP ID: ENSP00000377787
MVPSAGQLALFALGIVLAACQALENSTSPLSDPPVAAAVVSHFNDCPDSHTQFCFHGTCRFLVQEDKPACVCHSGYVGARCEHADLLAVVAASQKKQAITALVVVSIVALAVLIITCVLI

SEQ ID NO: 90115 - protein, 161 aa, Homo sapiens
  Payload ID: 18018
  Gene Name: transforming growth factor, alpha
  Uniprot ID: P01135
  ENSP ID: ENSP00000387493
MVPSAGQLALFALGIVLAACQALENSTSPLSDPPVAAAVVSHFNDCPDSHTQFCFHGTCRFLVQEDKPACVCHSGYVGARCEHADLLAVVAASQKKQAITALVVVSIVALAVLIITCVLIHCCQVRKHCEWCRALICRHEKPSALLKGRTACCHSETATLG

SEQ ID NO: 90116 - protein, 159 aa, Homo sapiens
  Payload ID: 18018
  Gene Name: transforming growth factor, alpha
  Uniprot ID: P01135
  ENSP ID: ENSP00000404099
MVPSAGQLALFALGIVLAACQALENSTSPLSDPPVAAAVVSHFNDCPDSHTQFCFHGTCRFLVQEDKPACVCHSGYVGARCEHADLLAVVAASQKKQAITALVVVSIVALAVLIITCVLIHCCQVRKHCEWCRALICRHEKPSALLKGRTACCHSETVV

SEQ ID NO: 90117 - protein, 166 aa, Homo sapiens
  Payload ID: 18018
  Gene Name: transforming growth factor, alpha
  ENSP ID: ENSP00000404131
MFKIGRGALDLFSELLSFGGIVLAACQALENSTSPLSADPPVAAAVVSHFNDCPDSHTQFCFHGTCRFLVQEDKPACVCHSGYVGARCEHADLLAVVAASQKKQAITALVVVSIVALAVLIITCVLIHCCQVRKHCEWCRALICRHEKPSALLKGRTACCHSETVV

SEQ ID NO: 90118 - protein, 131 aa, Homo sapiens
  Payload ID: 18018
  Gene Name: transforming growth factor, alpha
  ENSP ID: ENSP00000407432
  MOD_RES (1)..(1): Any amino acid
XPPVAAAVVSHFNDCPDSHTQFCFHGTCRFLVQEDKPACVCHSGYVGARCEHADLLAVVAASQKKQAITALVVVSIVALAVLIITCVLIHCCQVRKHCEWCRALICRHEKPSALLKGRTACCHSETGCRLY

SEQ ID NO: 90119 - protein, 165 aa, Homo sapiens
  Payload ID: 18018
  Gene Name: transforming growth factor, alpha
  ENSP ID: ENSP00000414127
MFKIGRGALDLFSELLSFGGIVLAACQALENSTSPLSDPPVAAAVVSHFNDCPDSHTQFCFHGTCRFLVQEDKPACVCHSGYVGARCEHADLLAVVAASQKKQAITALVVVSIVALAVLIITCVLIHCCQVRKHCEWCRALICRHEKPSALLKGRTACCHSETVV

SEQ ID NO: 90120 - protein, 390 aa, Homo sapiens
  Payload ID: 18019
  Gene Name: transforming growth factor, beta 1
  Uniprot ID: P01137
  ENSP ID: ENSP00000221930
MPPSGLRLLPLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 90121 - protein, 120 aa, Homo sapiens
  Payload ID: 18019
  Gene Name: transforming growth factor, beta 1
  ENSP ID: ENSP00000472767
  MOD_RES (1)..(1): Any amino acid
XFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKLNEQNLIQEVPNIWQREVG

SEQ ID NO: 90122 - protein, 442 aa, Homo sapiens
  Payload ID: 18020
  Gene Name: transforming growth factor, beta 2
  Uniprot ID: P61812
  ENSP ID: ENSP00000355896
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSETVCPVVTTPSGSVGSLCSRQSQVLCGYLDAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 90123 - protein, 414 aa, Homo sapiens
  Payload ID: 18020
  Gene Name: transforming growth factor, beta 2
  Uniprot ID: P61812
  ENSP ID: ENSP00000355897
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 90124 - protein, 412 aa, Homo sapiens
  Payload ID: 18021
  Gene Name: transforming growth factor, beta 3
  Uniprot ID: P10600
  ENSP ID: ENSP00000238682
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 90125 - protein, 309 aa, Homo sapiens
  Payload ID: 18021
  Gene Name: transforming growth factor, beta 3
  Uniprot ID: P10600
  ENSP ID: ENSP00000451110
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFR

SEQ ID NO: 90126 - protein, 426 aa, Homo sapiens
  Payload ID: 18022
  Gene Name: transforming growth factor, beta receptor 1
  Uniprot ID: P36897
  ENSP ID: ENSP00000364129
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 90127 - protein, 503 aa, Homo sapiens
  Payload ID: 18022
  Gene Name: transforming growth factor, beta receptor 1
  Uniprot ID: P36897
  ENSP ID: ENSP00000364133
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 90128 - protein, 383 aa, Homo sapiens
  Payload ID: 18022
  Gene Name: transforming growth factor, beta receptor 1
  ENSP ID: ENSP00000446685
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTGPFSVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRNS

SEQ ID NO: 90129 - protein, 126 aa, Homo sapiens
  Payload ID: 18022
  Gene Name: transforming growth factor, beta receptor 1
  ENSP ID: ENSP00000447182
MCIAEIDLIPRDRPFVCAPSSKTGSVTTTYCCNQDHCNKIELPTTGPFSVKSSPGLGPVELAAVIAGPVCFVCISLMLMVYICHNRTVIHHRVPNEEDPSLDRPFISEGTTLKDLIYDMTTSGSGS

SEQ ID NO: 90130 - protein, 507 aa, Homo sapiens
  Payload ID: 18022
  Gene Name: transforming growth factor, beta receptor 1
  Uniprot ID: P36897
  ENSP ID: ENSP00000447297
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTGPFSVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 90131 - protein, 122 aa, Homo sapiens
  Payload ID: 18022
  Gene Name: transforming growth factor, beta receptor 1
  ENSP ID: ENSP00000447707
MCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGS

SEQ ID NO: 90132 - protein, 114 aa, Homo sapiens
  Payload ID: 18022
  Gene Name: transforming growth factor, beta receptor 1
  ENSP ID: ENSP00000448518
MCIAEIDLIPRDRPFVCAPSSKTGSVTTTYCCNQDHCNKIELPTTGPFSVKSSPGLGPVELAAVIAGPVCFVCISLMLMVYICHNRTVIHHRVPNEEDPSLDRPFISEGTTLKD

SEQ ID NO: 90133 - protein, 114 aa, Homo sapiens
  Payload ID: 18022
  Gene Name: transforming growth factor, beta receptor 1
  ENSP ID: ENSP00000449028
MCIAEIDLIPRDRPFVCAPSSKTGSVTTTYCCNQDHCNKIELPTTGLPLLVQRTIARTIVLQESIGKGRFGEVWRGKWRGEEVAVKIFSSREERSWFREAEIYQTVMLRHENIL

SEQ ID NO: 90134 - protein, 118 aa, Homo sapiens
  Payload ID: 18022
  Gene Name: transforming growth factor, beta receptor 1
  ENSP ID: ENSP00000449934
MCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTS

SEQ ID NO: 90135 - protein, 434 aa, Homo sapiens
  Payload ID: 18022
  Gene Name: transforming growth factor, beta receptor 1
  ENSP ID: ENSP00000450052
MCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 90136 - protein, 860 aa, Homo sapiens
  Payload ID: 18023
  Gene Name: transforming growth factor, beta receptor associated protein 1
  Uniprot ID: Q8WUH2
  ENSP ID: ENSP00000258449
MMSIKAFTLVSAVERELLMGDKERVNIECVECCGRDLYVGTNDCFVYHFLLEERPVPAGPATFTATKQLQRHLGFKKPVNELRAASALNRLLVLCDNSISLVNMLNLEPVPSGARIKGAATFALNENPVSGDPFCVEVCIISVKRRTIQMFLVYEDRVQIVKEVSTAEQPLAVAVDGHFLCLALTTQYIIHNYSTGVSQDLFPYCSEERPPIVKRIGRQEFLLAGPGGLGMFATVAGISQRAPVHWSENVIGAAVSFPYVIALDDEFITVHSMLDQQQKQTLPFKEGHILQDFEGRVIVATSKGVYILVPLPLEKQIQDLLASRRVEEALVLAKGARRNIPKEKFQVMYRRILQQAGFIQFAQLQFLEAKELFRSGQLDVRELISLYPFLLPTSSSFTRSHPPLHEYADLNQLTQGDQEKMAKCKRFLMSYLNEVRSTEVANGYKEDIDTALLKLYAEADHDSLLDLLVTENFCLLTDSAAWLEKHKKYFALGLLYHYNNQDAAAVQLWVNIVNGDVQDSTRSDLYEYIVDFLTYCLDEELVWAYADWVLQKSEEVGVQVFTKRPLDEQQKNSFNPDDIINCLKKYPKALVKYLEHLVIDKRLQKEEYHTHLAVLYLEEVLLQRASASGKGAEATETQAKLRRLLQKSDLYRVHFLLERLQGAGLPMESAILHGKLGEHEKALHILVHELQDFAAAEDYCLWCSEGRDPPHRQQLFHTLLAIYLHAGPTAHELAVAAVDLLNRHATEFDAAQVLQMLPDTWSVQLLCPFLMGAMRDSIHARRTMQVALGLARSENLIYTYDKMKLKGSSIQLSDKKLCQICQNPFCEPVFVRYPNGGLVHTHCAASRHTNPSSSSPGTRT

SEQ ID NO: 90137 - protein, 860 aa, Homo sapiens; identical to SEQ ID NO: 90136
  Payload ID: 18023
  Gene Name: transforming growth factor, beta receptor associated protein 1
  Uniprot ID: Q8WUH2
  ENSP ID: ENSP00000377027

SEQ ID NO: 90138 - protein, 860 aa, Homo sapiens; identical to SEQ ID NO: 90136
  Payload ID: 18023
  Gene Name: transforming growth factor, beta receptor associated protein 1
  Uniprot ID: Q8WUH2
  ENSP ID: ENSP00000471434

SEQ ID NO: 90139 - protein, 567 aa, Homo sapiens
  Payload ID: 18024
  Gene Name: transforming growth factor, beta receptor II (70/80kDa)
  Uniprot ID: P37173
  ENSP ID: ENSP00000295754
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 90140 - protein, 592 aa, Homo sapiens
  Payload ID: 18024
  Gene Name: transforming growth factor, beta receptor II (70/80kDa)
  Uniprot ID: P37173
  ENSP ID: ENSP00000351905
MGRGLLRGLWPLHIVLWTRIASTIPPHVQKSDVEMEAQKDEIICPSCNRTAHPLRHINNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 90141 - protein, 851 aa, Homo sapiens
  Payload ID: 18025
  Gene Name: transforming growth factor, beta receptor III
  Uniprot ID: Q03167
  ENSP ID: ENSP00000212355
MTSHYVIAIFALMSSCLATAGPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 90142 - protein, 850 aa, Homo sapiens
  Payload ID: 18025
  Gene Name: transforming growth factor, beta receptor III
  Uniprot ID: Q03167
  ENSP ID: ENSP00000359426
MTSHYVIAIFALMSSCLATAGPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 90143 - protein, 35 aa, Homo sapiens
  Payload ID: 18025
  Gene Name: transforming growth factor, beta receptor III
  ENSP ID: ENSP00000395975
MTSHYVIAIFALMSSCLATAGPEPGALCELSPVSA

SEQ ID NO: 90144 - protein, 850 aa, Homo sapiens; identical to SEQ ID NO: 90142
  Payload ID: 18025
  Gene Name: transforming growth factor, beta receptor III
  Uniprot ID: Q03167
  ENSP ID: ENSP00000432638

SEQ ID NO: 90145 - protein, 89 aa, Homo sapiens
  Payload ID: 18025
  Gene Name: transforming growth factor, beta receptor III
  ENSP ID: ENSP00000433477
MTSHYVIAIFALMSSCLATAGPEPGALCELSPVSASHPVQALMESFTVLSGCASRGTTGLPQEVHVLNLRTAGQGPGQLQREACSMNHY

SEQ ID NO: 90146 - protein, 49 aa, Homo sapiens
  Payload ID: 18025
  Gene Name: transforming growth factor, beta receptor III
  ENSP ID: ENSP00000434994
MTSHYVIAIFALMSSCLATAGWSAMARSWLTATSASRVQAILLPQPPEY

SEQ ID NO: 90147 - protein, 851 aa, Homo sapiens; identical to SEQ ID NO: 90141
  Payload ID: 18025
  Gene Name: transforming growth factor, beta receptor III
  Uniprot ID: Q03167
  ENSP ID: ENSP00000436127

SEQ ID NO: 90148 - protein, 316 aa, Homo sapiens
  Payload ID: 18026
  Gene Name: transforming growth factor, beta receptor III-like
  Uniprot ID: H3BV60
  ENSP ID: ENSP00000457962
MGESAAATASLFQRRRRGRGGRVTFPGGLKGSARFLSFGPPFPAPPAPPFPAAPGPWLRRPLFSLKLSDTEDVFPRRAGPLEVPADSRVFVQAALARPSPRWGLALHRCSVTPSSRPAPGPALALLREGCPADTSVAFPPPPPPSPGAARPARFSFRLRPVFNASVQFLHCQLSRCRRLRGVRRAPAPLTPPPPPPPSRCLPQDEACADTGSGSAEGLAADGPHLHTLTQPIVVTVPRPPPRPPKSVPGRAVRPEPPAPAPAALEPAPVVALVLAAFVLGAALAAGLGLVCAHSAPHAPGPPARASPSGPQPRRSQ

SEQ ID NO: 90149 - protein, 683 aa, Homo sapiens
  Payload ID: 18027
  Gene Name: transforming growth factor, beta-induced, 68kDa
  Uniprot ID: Q15582
  ENSP ID: ENSP00000416330
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPANRPQERGDELADSALEIFKQASAFSRASQRSVRLAPVYQKLLERMKH

SEQ ID NO: 90150 - protein, 366 aa, Homo sapiens
  Payload ID: 18027
  Gene Name: transforming growth factor, beta-induced, 68kDa
  ENSP ID: ENSP00000421440
  MOD_RES (1)..(1): Any amino acid
XAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPAPVYQKLLERMKH

SEQ ID NO: 90151 - protein, 128 aa, Homo sapiens
  Payload ID: 18027
  Gene Name: transforming growth factor, beta-induced, 68kDa
  ENSP ID: ENSP00000421540
  MOD_RES (1)..(1): Any amino acid
XPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAVR

SEQ ID NO: 90152 - protein, 194 aa, Homo sapiens
  Payload ID: 18027
  Gene Name: transforming growth factor, beta-induced, 68kDa
  ENSP ID: ENSP00000423871
  MOD_RES (1)..(1): Any amino acid
XNGVVHLIDKVISTITNNIQQIIEIEDTFETLRAAVAASGLNTMLEGNGQYTLLAPTNEAFEKIPSETLNRILGDPEALRDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTL

SEQ ID NO: 90153 - protein, 65 aa, Homo sapiens
  Payload ID: 18027
  Gene Name: transforming growth factor, beta-induced, 68kDa
  ENSP ID: ENSP00000423935
MATNGVVHVITNVLQPPANRPQERGDELADSALEIFKQASAFSRASQRSVRLAPVYQKLLERMKH

SEQ ID NO: 90154 - protein, 59 aa, Homo sapiens
  Payload ID: 18027
  Gene Name: transforming growth factor, beta-induced, 68kDa
  ENSP ID: ENSP00000426589
  MOD_RES (1)..(1): Any amino acid
XKTLFELAAESDVSTAIDLFRQAGLGNHLSGSERLTLLAPLNSVFKGAHLSGPNHHPFL

SEQ ID NO: 90155 - protein, 78 aa, Homo sapiens
  Payload ID: 18027
  Gene Name: transforming growth factor, beta-induced, 68kDa
  ENSP ID: ENSP00000427137
  MOD_RES (1)..(1): Any amino acid
XQGDKLEVSLKNNVVSVNKEPVAEPDIMATNGVVHVITNVLQPPANRPQERGDELADSALEIFKQASAFSRPLSIKSY

SEQ ID NO: 90156 - protein, 219 aa, Homo sapiens
  Payload ID: 18027
  Gene Name: transforming growth factor, beta-induced, 68kDa
  ENSP ID: ENSP00000474155
RAAVAASGLNTMLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNVSSGS

SEQ ID NO: 90157 - protein, 395 aa, Homo sapiens
  Payload ID: 18028
  Gene Name: transforming, acidic coiled-coil containing protein 1
  Uniprot ID: O75410
  ENSP ID: ENSP00000276520
MAFSPWQILSPVQWAKWTWSAVRGGAAGEDEAGGPEGDPEEEDSQAETKSLSFRSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 90158 - protein, 805 aa, Homo sapiens
  Payload ID: 18028
  Gene Name: transforming, acidic coiled-coil containing protein 1
  Uniprot ID: O75410
  ENSP ID: ENSP00000321703
MAFSPWQILSPVQWAKWTWSAVRGGAAGEDEAGGPEGDPEEEDSQAETKSLSFSSDSEGNFETPEAETPIRSPFKESCDPSLGLAGPGAKSQESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 90159 - protein, 138 aa, Homo sapiens
  Payload ID: 18028
  Gene Name: transforming, acidic coiled-coil containing protein 1
  ENSP ID: ENSP00000428175
MTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEA

SEQ ID NO: 90160 - protein, 562 aa, Homo sapiens
  Payload ID: 18028
  Gene Name: transforming, acidic coiled-coil containing protein 1
  ENSP ID: ENSP00000428253
  MOD_RES (1)..(1): Any amino acid
XRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITTTEQVKFLCFLLSGCKVKKHETQSLALDACSRDEGAVISQISDISNRDGHATDEEKLASTSCGQKSAGAEVKGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 90161 - protein, 610 aa, Homo sapiens
  Payload ID: 18028
  Gene Name: transforming, acidic coiled-coil containing protein 1
  Uniprot ID: O75410
  ENSP ID: ENSP00000428450
MTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 90162 - protein, 133 aa, Homo sapiens
  Payload ID: 18028
  Gene Name: transforming, acidic coiled-coil containing protein 1
  ENSP ID: ENSP00000428466
MGGSHSQTPRGREPAGERHPRPTETASGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVL

SEQ ID NO: 90163 - protein, 609 aa, Homo sapiens
  Payload ID: 18028
  Gene Name: transforming, acidic coiled-coil containing protein 1
  ENSP ID: ENSP00000428687
MTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 90164 - protein, 731 aa, Homo sapiens
  Payload ID: 18028
  Gene Name: transforming, acidic coiled-coil containing protein 1
  Uniprot ID: O75410
  ENSP ID: ENSP00000428706
MNNILKLKSSDSEGNFETPEAETPIRSPFKESCDPSLGLAGPGAKSQESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 90165 - protein, 145 aa, Homo sapiens
  Payload ID: 18028
  Gene Name: transforming, acidic coiled-coil containing protein 1
  ENSP ID: ENSP00000428949
MGGSHSQTPRGREPAGERHPRPTETATTEQVKFLCFLLSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVL

SEQ ID NO: 90166 - protein, 60 aa, Homo sapiens
  Payload ID: 18028
  Gene Name: transforming, acidic coiled-coil containing protein 1
  ENSP ID: ENSP00000429330
MTEGSMGVTLEASAEADLKAGNSCPELVPSRRSKLRKPKPVPLRKKAIGGEFSDTNAAVE

SEQ ID NO: 90167 - protein, 242 aa, Homo sapiens
  Payload ID: 18028
  Gene Name: transforming, acidic coiled-coil containing protein 1
  ENSP ID: ENSP00000429418
MEEDGSTVLGLLESSAEKAPVSVSCGGESPLDGICLSESDKTAVLTLIREEIITKEIEANEWKKKYEETRQEVLEMRKIVAEYEKTIAQMIDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 90168 - protein, 454 aa, Homo sapiens
  Payload ID: 18028
  Gene Name: transforming, acidic coiled-coil containing protein 1
  ENSP ID: ENSP00000430306
  MOD_RES (1)..(1): Any amino acid
XLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITTTEQVKFLCFLLSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 90169 - protein, 557 aa, Homo sapiens [sequence omitted]

SEQ ID NO: 90170 - protein, 129 aa, Homo sapiens
  Payload ID: 18028
  Gene Name: transforming, acidic coiled-coil containing protein 1
  ENSP ID: ENSP00000430562
MAFSPWQILSPVQWAKWTWSAVRGGAAGEDEAGGPEGDPEEEDSQAETKSLSFSSDSEGNFETPEAETPIRSPFKESCDPSLGLAGPGAKSQESQEADEQLVAEVVEKCSSKTCSKPSENEVPQQAIDS

SEQ ID NO: 90171 - protein, 30 aa, Homo sapiens
  Payload ID: 18028
  Gene Name: transforming, acidic coiled-coil containing protein 1
  ENSP ID: ENSP00000430819
MTEGSMGVTLEASAEADLKAGNSCPELVPS

SEQ ID NO: 90172 - protein, 581 aa, Homo sapiens
  Payload ID: 18028
  Gene Name: transforming, acidic coiled-coil containing protein 1
  ENSP ID: ENSP00000430959
MTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 90173 - protein, 580 aa, Homo sapiens
  Payload ID: 18028
  Gene Name: transforming, acidic coiled-coil containing protein 1
  ENSP ID: ENSP00000473342
MFTLPSTLRSNAKTNHQSSDSEGNFETPEAETPIRSPFKESCDPSLGLAGPGAKSQESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKGIEKETCQKMEEDGSTVLGLLESSAEKAPVSVSCGGESPLDGICLSESDKTAVLTLIREEIITKEIEANEWKKKYEETRQEVLEMRKESYEP

SEQ ID NO: 90174 - protein, 1026 aa, Homo sapiens
  Payload ID: 18029
  Gene Name: transforming, acidic coiled-coil containing protein 2
  Uniprot ID: O95359
  ENSP ID: ENSP00000260733
MGGSQSLQPAPASDLNLEASEAMSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEITAPEGSFASADALLSRLAHPVSLCGALDYLEPDLAEKNPPLFAQKLQEELEFAIMRIEALKLARQIALASRSHQDAKREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 90175 - protein, 2948 aa, Homo sapiens
  Payload ID: 18029
  Gene Name: transforming, acidic coiled-coil containing protein 2
  Uniprot ID: O95359
  ENSP ID: ENSP00000334280
MGNENSTSDNQRTLSAQTPRSAQPPGNSQNIKRKQQDTPGSPDHRDASSIGSVGLGGFCTASESSASLDPCLVSPEVTEPRKDPQGARGPEGSLLPSPPPSQEREHPSSSMPFAECPPEGCLASPAAAPEDGPQTQSPRREPAPNAPGDIAAAFPAERDSSTPYQEIAAVPSAGRERQPKEEGQKSSFSFSSGIDQSPGMSPVPLREPMKAPLCGEGDQPGGFESQEKEAAGGFPPAESRQGVASVQVTPEAPAAAQQGTESSAVLEKSPLKPMAPIPQDPAPRASDRERGQGEAPPQYLTDDLEFLRACHLPRSNSGAAPEAEVNAASQESCQQPVGAYLPHAELPWGLPSPALVPEAGGSGKEALDTIDVQGHPQTGMRGTKPNQVVCVAAGGQPEGGLPVSPEPSLLTPTEEAHPASSLASFPAAQIPIAVEEPGSSSRESVSKAGMPVSADAAKEVVDAGLVGLERQVSDLGSKGEHPEGDPGEVPAPSPQERGEHLNTEQSHEVQPGVPPPPLPKEQSHEVQPGAPPPPLPKAPSESARGPPGPTDGAKVHEDSTSPAVAKEGSRSPGDSPGGKEEAPEPPDGGDPGNLQGEDSQAFSSKRDPEVGKDELSKPSSDAESRDHPSSHSAQPPRKGGAGHTDGPHSQTAEADASGLPHKLGEEDPVLPPVPDGAGEPTVPEGAIWEGSGLQPKCPDTLQSREGLGRMESFLTLESEKSDFPPTPVAEVAPKAQEGESTLEIRKMGSCDGEGLLTSPDQPRGPACDASRQEFHAGVPHPPQGENLAADLGLTALILDQDQQGIPSCPGEGWIRGAASEWPLLSSEKHLQPSQAQPETSIFDVLKEQAQPPENGKETSPSHPGFKDQGADSSQIHVPVEPQEDNNLPTHGGQEQALGSELQSQLPKGTLSDTPTSSPTDMVWESSLTEESELSAPTRQKLPALGEKRPEGACGDGQSSRVSPPAADVLKDFSLAGNFSRKETCCTGQGPNKSQQALADALEEGSQHEEACQRHPGASEAADGCSPLWGLSKREMASGNTGEAPPCQPDSVALLDAVPCLPALAPASPGVTPTQDAPETEACDETQEGRQQPVPAPQQKMECWATSDAESPKLLASFPSAGEQGGEAGAAETGGSAGAGDPGKQQAPEKPGEATLSCGLLQTEHCLTSGEEASTSALRESCQAEHPMASCQDALLPARELGGIPRSTMDFSTHQAVPDPKELLLSGPPEVAAPDTPYLHVDSAAQRGAEDSGVKAVSSADPRAPGESPCPVGEPPLALENAASLKLFAGSLAPLLQPGAAGGEIPAVQASSGSPKARTTEGPVDSMPCLDRMPLLAKGKQATGEEKAATAPGAGAKASGEGMAGDAAGETEGSMERMGEPSQDPKQGTSGGVDTSSEQIATLTGFPDFREHIAKIFEKPVLGALATPGEKAGAGRSAVGKDLTRPLGPEKLLDGPPGVDVTLLPAPPARLQVEKKQQLAGEAEISHLALQDPASDKLLGPAGLTWERNLPGAGVGKEMAGVPPTLREDERPEGPGAAWPGLEGQAYSQLERSRQELASGLPSPAATQELPVERAAAFQVAPHSHGEEAVAQDRIPSGKQHQETSACDSPHGEDGPGDFAHTGVPGHVPRSTCAPSPQREVLTVPEANSEPWTLDTLGGERRPGVTAGILEMRNALGNQSTPAPPTGEVADTPLEPGKVAGAAGEAEGDITLSTAETQACASGDLPEAGTTRTFSVVAGDLVLPGSCQDPACSDKAPGMEGTAALHGDSPARPQQAKEQPGPERPIPAGDGKVCVSSPPEPDETHDPKLQHLAPEELHTDRESPRPGPSMLPSVPKKDAPRVMDKVTSDETRGAEGTESSPVADDIIQPAAPADLESPTLAASSYHGDVVGQVSTDLIAQSISPAAAHAGLPPSAAEHIVSPSAPAGDRVEASTPSCPDPAKDLSRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEITAPEGSFASADALLSRLAHPVSLCGALDYLEPDLAEKNPPLFAQKLQEELEFAIMRIEALKLARQIALASRSHQDAKREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 90176 - protein, 1094 aa, Homo sapiens
  Payload ID: 18029
  Gene Name: transforming, acidic coiled-coil containing protein 2
  Uniprot ID: O95359
  ENSP ID: ENSP00000350701
MGNENSTSDNQRTLSAQTPRSAQPPGNSQNIKRKQQDTPGSPDHRDASSSPVADDIIQPAAPADLESPTLAASSYHGDVVGQVSTDLIAQRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEITAPEGSFASADALLSRLAHPVSLCGALDYLEPDLAEKNPPLFAQKLQEELEFAIMRIEALKLARQIALASRSHQDAKREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 90177 - protein, 996 aa, Homo sapiens
  Payload ID: 18029
  Gene Name: transforming, acidic coiled-coil containing protein 2
  Uniprot ID: O95359
  ENSP ID: ENSP00000353763
MGGSQSLQPAPASDLNLEASEAMSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEITAPEGSFASADALLSRLAHPVSLCGALDYLEPDLAEKNPPLFAQKLQREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 90178 - protein, 1038 aa, Homo sapiens
  Payload ID: 18029
  Gene Name: transforming, acidic coiled-coil containing protein 2
  ENSP ID: ENSP00000357995
MGGSQSLQPAPASDLNLEASEAMSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTMVEDVMSVCSLFDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEITAPEGSFASADALLSRLAHPVSLCGALDYLEPDLAEKNPPLFAQKLQEELEFAIMRIEALKLARQIALASRSHQDAKREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 90179 - protein, 571 aa, Homo sapiens
  Payload ID: 18029
  Gene Name: transforming, acidic coiled-coil containing protein 2
  Uniprot ID: O95359
  ENSP ID: ENSP00000357996
MPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 90180 - protein, 575 aa, Homo sapiens
  Payload ID: 18029
  Gene Name: transforming, acidic coiled-coil containing protein 2
  ENSP ID: ENSP00000357997
MPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 90181 - protein, 2948 aa, Homo sapiens; identical to SEQ ID NO: 90175
  Payload ID: 18029
  Gene Name: transforming, acidic coiled-coil containing protein 2
  Uniprot ID: O95359
  ENSP ID: ENSP00000358001

SEQ ID NO: 90182 - protein, 2875 aa, Homo sapiens
  Payload ID: 18029
  Gene Name: transforming, acidic coiled-coil containing protein 2
  ENSP ID: ENSP00000395048
MGNENSTSDNQRTLSAQTPRSAQPPGNSQNIKRKQQDTPGSPDHRDASSIGSVGLGGFCTASESSASLDPCLVSPEVTEPRKDPQGARGPEGSLLPSPPPSQEREHPSSSMPFAECPPEGCLASPAAAPEDGPQTQSPRREPAPNAPGDIAAAFPAERDSSTPYQEIAAVPSAGRERQPKEEGQKSSFSFSSGIDQSPGMSPVPLREPMKAPLCGEGDQPGGFESQEKEAAGGFPPAESRQGVASVQVTPEAPAAAQQGTESSAVLEKSPLKPMAPIPQDPAPRASDRERGQGEAPPQYLTDDLEFLRACHLPRSNSGAAPEAEVNAASQESCQQPVGAYLPHAELPWGLPSPALVPEAGGSGKEALDTIDVQGHPQTGMRGTKPNQVVCVAAGGQPEGGLPVSPEPSLLTPTEEAHPASSLASFPAAQIPIAVEEPGSSSRESVSKAGMPVSADAAKEVVDAGLVGLERQVSDLGSKGEHPEGDPGEVPAPSPQERGEHLNTEQSHEVQPGVPPPPLPKEQSHEVQPGAPPPPLPKAPSESARGPPGPTDGAKVHEDSTSPAVAKEGSRSPGDSPGGKEEAPEPPDGGDPGNLQGEDSQAFSSKRDPEVGKDELSKPSSDAESRDHPSSHSAQPPRKGGAGHTDGPHSQTAEADASGLPHKLGEEDPVLPPVPDGAGEPTVPEGAIWEGSGLQPKCPDTLQSREGLGRMESFLTLESEKSDFPPTPVAEVAPKAQEGESTLEIRKMGSCDGEGLLTSPDQPRGPACDASRQEFHAGVPHPPQGENLAADLGLTALILDQDQQGIPSCPGEGWIRGAASEWPLLSSEKHLQPSQAQPETSIFDVLKEQAQPPENGKETSPSHPGFKDQGADSSQIHVPVEPQEDNNLPTHGGQEQALGSELQSQLPKGTLSDTPTSSPTDMVWESSLTEESELSAPTRQKLPALGEKRPEGACGDGQSSRVSPPAADVLKDFSLAGNFSRKETCCTGQGPNKSQQALADALEEGSQHEEACQRHPGASEAADGCSPLWGLSKREMASGNTGEAPPCQPDSVALLDAVPCLPALAPASPGVTPTQDAPETEACDETQEGRQQPVPAPQQKMECWATSDAESPKLLASFPSAGEQGGEAGAAETGGSAGAGDPGKQQAPEKPGEATLSCGLLQTEHCLTSGEEASTSALRESCQAEHPMASCQDALLPARELGGIPRSTMDFSTHQAVPDPKELLLSGPPEVAAPDTPYLHVDSAAQRGAEDSGVKAVSSADPRAPGESPCPVGEPPLALENAASLKLFAGSLAPLLQPGAAGGEIPAVQASSGSPKARTTEGPVDSMPCLDRMPLLAKGKQATGEEKAATAPGAGAKASGEGMAGDAAGETEGSMERMGEPSQDPKQGTSGGVDTSSEQIATLTGFPDFREHIAKIFEKPVLGALATPGEKAGAGRSAVGKDLTRPLGPEKLLDGPPGVDVTLLPAPPARLQVEKKQQLAGEAEISHLALQDPASDKLLGPAGLTWERNLPGAGVGKEMAGVPPTLREDERPEGPGAAWPGLEGQAYSQLERSRQELASGLPSPAATQELPVERAAAFQVAPHSHGEEAVAQDRIPSGKQHQETSACDSPHGEDGPGDFAHTGVPGHVPRSTCAPSPQREVLTVPEANSEPWTLDTLGGERRPGVTAGILEMRNALGNQSTPAPPTGEVADTPLEPGKVAGAAGEAEGDITLSTAETQACASGDLPEAGTTRTFSVVAGDLVLPGSCQDPACSDKAPGMEGTAALHGDSPARPQQAKEQPGPERPIPAGDGKVCVSSPPEPDETHDPKLQHLAPEELHTDRESPRPGPSMLPSVPKKDAPRVMDKVTSDETRGAEGTERSAKDIGLWKAMMPSLDTDTLDVLERRVVLIQHEFLHKKEANGHSRFMYSSPVADDIIQPAAPADLESPTLAASSYHGDVVGQVSTDLIAQRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 90183 - protein, 669 aa, Homo sapiens
  Payload ID: 18029
  Gene Name: transforming, acidic coiled-coil containing protein 2
  ENSP ID: ENSP00000420967
MAYASWQRWSPVEWARWMWTAVTSSGDSSLLVLQGDSGKRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCS

SEQ ID NO: 90184 - protein, 184 aa, Homo sapiens
  Payload ID: 18029
  Gene Name: transforming, acidic coiled-coil containing protein 2
  ENSP ID: ENSP00000421702
  MOD_RES (1)..(1): Any amino acid
XQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKVTHLG

SEQ ID NO: 90185 - protein, 409 aa, Homo sapiens
  Payload ID: 18029
  Gene Name: transforming, acidic coiled-coil containing protein 2
  ENSP ID: ENSP00000422725
SVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSAL

SEQ ID NO: 90186 - protein, 1008 aa, Homo sapiens
  Payload ID: 18029
  Gene Name: transforming, acidic coiled-coil containing protein 2
  ENSP ID: ENSP00000422815
MGGSQSLQPAPASDLNLEASEAMSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTMVEDVMSVCSLFDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEITAPEGSFASADALLSRLAHPVSLCGALDYLEPDLAEKNPPLFAQKLQREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 90187 - protein, 183 aa, Homo sapiens
  Payload ID: 18029
  Gene Name: transforming, acidic coiled-coil containing protein 2
  ENSP ID: ENSP00000423069
  MOD_RES (1)..(1): Any amino acid
XNSTSDNQQEDSVLHNVILWPPNPEPTQRTLSAQTPRSAQPPGNSQNIKRKQQDTPGSPDHRDASSVGLGGFCTASESSASLDPCLVSPEVTEPRKDPQGARGPEGSLLPSPPPSQEREHPSSSMPFAECPPEGCLASPAAAPEDGPQTQSPRREPAPNAPGDIAAAFPAERDSSTPYQEIAA

SEQ ID NO: 90188 - protein, 153 aa, Homo sapiens
  Payload ID: 18029
  Gene Name: transforming, acidic coiled-coil containing protein 2
  ENSP ID: ENSP00000423764
  MOD_RES (1)..(1): Any amino acid
XIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRFHGQVLFSLFRMHYCISFLNKIDLIVCSTKETIRISCYWFAFS

SEQ ID NO: 90189 - protein, 2875 aa, Homo sapiens; identical to SEQ ID NO: 90182
  Payload ID: 18029
  Gene Name: transforming, acidic coiled-coil containing protein 2
  ENSP ID: ENSP00000424467

SEQ ID NO: 90190 - protein, 1094 aa, Homo sapiens; identical to SEQ ID NO: 90176
  Payload ID: 18029
  Gene Name: transforming, acidic coiled-coil containing protein 2
  Uniprot ID: O95359
  ENSP ID: ENSP00000425062

SEQ ID NO: 90191 - protein, 165 aa, Homo sapiens
  Payload ID: 18029
  Gene Name: transforming, acidic coiled-coil containing protein 2
  ENSP ID: ENSP00000425525
KKKTPLKTDTFRVKKSPKRSPLSDPPSQDPTPAATPETPPVISAVVHATDEEKLAVTNQKWTCMTVDLEADKQDYPQPSDLSTFVNETKFSSPTEGKQLCSQLDPHSASENPAPREPKARRETSQPELDYRNSYEIEYMEKIGSSLPQDDDAPKKQALYLMFDTS

SEQ ID NO: 90192 - protein, 189 aa, Homo sapiens
  Payload ID: 18029
  Gene Name: transforming, acidic coiled-coil containing protein 2
  ENSP ID: ENSP00000426303
ESLVPSGENLASETKTESAKTEGPSPALLEETPLEPAVGPKAACPLDSESAEGVVPPASGGGRVQNSPPVGRKTLPLTTAPEAGEESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPV

SEQ ID NO: 90193 - protein, 2826 aa, Homo sapiens
  Payload ID: 18029
  Gene Name: transforming, acidic coiled-coil containing protein 2
  ENSP ID: ENSP00000427618
MGNENSTSDNQRTLSAQTPRSAQPPGNSQNIKRKQQDTPGSPDHRDASSIGSVGLGGFCTASESSASLDPCLVSPEVTEPRKDPQGARGPEGSLLPSPPPSQEREHPSSSMPFAECPPEGCLASPAAAPEDGPQTQSPRREPAPNAPGDIAAAFPAERDSSTPYQEIAAVPSAGRERQPKEEGQKSSFSFSSGIDQSPGMSPVPLREPMKAPLCGEGDQPGGFESQEKEAAGGFPPAESRQGVASVQVTPEAPAAAQQGTESSAVLEKSPLKPMAPIPQDPAPRASDRERGQGEAPPQYLTDDLEFLRACHLPRSNSGAAPEAEVNAASQESCQQPVGAYLPHAELPWGLPSPALVPEAGGSGKEALDTIDVQGHPQTGMRGTKPNQVVCVAAGGQPEGGLPVSPEPSLLTPTEEAHPASSLASFPAAQIPIAVEEPGSSSRESVSKAGMPVSADAAKEVVDAGLVGLERQVSDLGSKGEHPEGDPGEVPAPSPQERGEHLNTEQSHEVQPGVPPPPLPKEQSHEVQPGAPPPPLPKAPSESARGPPGPTDGAKVHEDSTSPAVAKEGSRSPGDSPGGKEEAPEPPDGGDPGNLQGEDSQAFSSKRDPEVGKDELSKPSSDAESRDHPSSHSAQPPRKGGAGHTDGPHSQTAEADASGLPHKLGEEDPVLPPVPDGAGEPTVPEGAIWEGSGLQPKCPDTLQSREGLGRMESFLTLESEKSDFPPTPVAEVAPKAQEGESTLEIRKMGSCDGEGLLTSPDQPRGPACDASRQEFHAGVPHPPQGENLAADLGLTALILDQDQQGIPSCPGEGWIRGAASEWPLLSSEKHLQPSQAQPETSIFDVLKEQAQPPENGKETSPSHPGFKDQGADSSQIHVPVEPQEDNNLPTHGGQEQALGSELQSQLPKGTLSDTPTSSPTDMVWESSLTEESELSAPTRQKLPALGEKRPEGACGDGQSSRVSPPAADVLKDFSLAGNFSRKETCCTGQGPNKSQQALADALEEGSQHEEACQRHPGASEAADGCSPLWGLSKREMASGNTGEAPPCQPDSVALLDAVPCLPALAPASPGVTPTQDAPETEACDETQEGRQQPVPAPQQKMECWATSDAESPKLLASFPSAGEQGGEAGAAETGGSAGAGDPGKQQAPEKPGEATLSCGLLQTEHCLTSGEEASTSALRESCQAEHPMASCQDALLPARELGGIPRSTMDFSTHQAVPDPKELLLSGPPEVAAPDTPYLHVDSAAQRGAEDSGVKAVSSADPRAPGESPCPVGEPPLALENAASLKLFAGSLAPLLQPGAAGGEIPAVQASSGSPKARTTEGPVDSMPCLDRMPLLAKGKQATGEEKAATAPGAGAKASGEGMAGDAAGETEGSMERMGEPSQDPKQGTSGGVDTSSEQIATLTGFPDFREHIAKIFEKPVLGALATPGEKAGAGRSAVGKDLTRPLGPEKLLDGPPGVDVTLLPAPPARLQVEKKQQLAGEAEISHLALQDPASDKLLGPAGLTWERNLPGAGVGKEMAGVPPTLREDERPEGPGAAWPGLEGQAYSQLERSRQELASGLPSPAATQELPVERAAAFQVAPHSHGEEAVAQDRIPSGKQHQETSACDSPHGEDGPGDFAHTGVPGHVPRSTCAPSPQREVLTVPEANSEPWTLDTLGGERRPGVTAGILEMRNALGNQSTPAPPTGEVADTPLEPGKVAGAAGEAEGDITLSTAETQACASGDLPEAGTTRTFSVVAGDLVLPGSCQDPACSDKAPGMEGTAALHGDSPARPQQAKEQPGPERPIPAGDGKVCVSSPPEPDETHDPKLQHLAPEELHTDRESPRPGPSMLPSVPKKDAPRVMDKVTSDETRGAEGTESSPVADDIIQPAAPADLESPTLAASSYHGDVVGQVSTDLIAQRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 90194 - protein, 175 aa, Homo sapiens
  Payload ID: 18029
  Gene Name: transforming, acidic coiled-coil containing protein 2
  ENSP ID: ENSP00000489610
  MOD_RES (1)..(1): Any amino acid
XEVMEMRKIVAEYEKTIAQMIGKPEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 90195 - protein, 838 aa, Homo sapiens
  Payload ID: 18030
  Gene Name: transforming, acidic coiled-coil containing protein 3
  Uniprot ID: Q9Y6A5
  ENSP ID: ENSP00000326550
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAEEECKAETPHGAEEECRHGGVCAPAAVATSPPGAIPKEACGGAPLQGLPGEALGCPAGVGTPVPADGTQTLTCAHTSAPESTAPTNHLVAGRAMTLSPQEEVAAGQMASSSRSGPVKLEFDVSDGATSKRAPPPRRLGERSGLKPPLRKAAVRQQKAPQEVEEDDGRSGAGEDPPMPASRGSYHLDWDKMDDPNFIPFGGDTKSGCSEAQPPESPETRLGQPAAEQLHAGPATEEPGPCLSQQLHSASAEDTPVVQLAAETPTAESKERALNSASTSLPTSCPGSEPVPTHQQGQPALELKEESFRDPAEVLGTGAEVDYLEQFGTSSFKESALRKQSLYLKFDPLLRDSPGRPVPVATETSSMHGANETPSGRPREAKLVEFDFLGALDIPVPGPPPGVPAPGGPPLSTGPIVDLLQYSQKDLDAVVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 90196 - protein, 221 aa, Homo sapiens
  Payload ID: 18030
  Gene Name: transforming, acidic coiled-coil containing protein 3
  ENSP ID: ENSP00000415914
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAE

SEQ ID NO: 90197 - protein, 230 aa, Homo sapiens
  Payload ID: 18030
  Gene Name: transforming, acidic coiled-coil containing protein 3
  ENSP ID: ENSP00000418095
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAEEECKAETPH

SEQ ID NO: 90198 - protein, 63 aa, Homo sapiens
  Payload ID: 18030
  Gene Name: transforming, acidic coiled-coil containing protein 3
  ENSP ID: ENSP00000418727
MSLQVLNDKNVSNEKNTENCDFLFSPPEVTGRSSVLRVSQKENVPPKNLAKAMKVLSSSLRNR

SEQ ID NO: 90199 - protein, 193 aa, Homo sapiens
  Payload ID: 18030
  Gene Name: transforming, acidic coiled-coil containing protein 3
  ENSP ID: ENSP00000419210
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKEKQLHSASAEDTPVVQLAAETPTAESKERALNSASTSLPTSCPGSEPVPTHQQGQPALELKEESFRDPAEVLGTGAEVDYLEQFGTSSFKESA

SEQ ID NO: 90200 - protein, 217 aa, Homo sapiens
  Payload ID: 18030
  Gene Name: transforming, acidic coiled-coil containing protein 3
  ENSP ID: ENSP00000420838
  MOD_RES (1)..(1): Any amino acid
XPVKLEFDVSDGATSKRAPPPRRLGERSGLKPPLRKAAVRQQKAPQEVEEDDGRSGAGEDPPMPASRGSYHLDWDKMDDPNFIPFGGDTKSGCSEAQPPESPETRLGQPAAEQLHAGPATEEPGPCLSQQLHSASAEDTPVVQLAAETPTAESKERALNSASTSLPTSCPGSEPVDYLEQFGTSSFKESALRKQSLYLKFDPLLRDSPGRPVPVATE

SEQ ID NO: 90201 - protein, 145 aa, Homo sapiens
  Payload ID: 18030
  Gene Name: transforming, acidic coiled-coil containing protein 3
  ENSP ID: ENSP00000478580
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKEKAAAFSLSGGHACGAVGSRDPNSREQGESLELCQHLASHKLSRQ

SEQ ID NO: 90202 - protein, 145 aa, Homo sapiens; identical to SEQ ID NO: 90201
  Payload ID: 18030
  Gene Name: transforming, acidic coiled-coil containing protein 3
  ENSP ID: ENSP00000483196

SEQ ID NO: 90203 - protein, 201 aa, Homo sapiens
  Payload ID: 18031
  Gene Name: transgelin
  Uniprot ID: Q01995
  ENSP ID: ENSP00000278968
MANKGPSYGMSREVQSKIEKKYDEELEERLVEWIIVQCGPDVGRPDRGRLGFQVWLKNGVILSKLVNSLYPDGSKPVKVPENPPSMVFKQMEQVAQFLKAAEDYGVIKTDMFQTVDLFEGKDMAAVQRTLMALGSLAVTKNDGHYRGDPNWFMKKAQEHKREFTESQLQEGKHVIGLQMGSNRGASQAGMTGYGRPRQIIS

SEQ ID NO: 90204 - protein, 201 aa, Homo sapiens; identical to SEQ ID NO: 90203
  Payload ID: 18031
  Gene Name: transgelin
  Uniprot ID: Q01995
  ENSP ID: ENSP00000376678

SEQ ID NO: 90205 - protein, 91 aa, Homo sapiens
  Payload ID: 18031
  Gene Name: transgelin
  ENSP ID: ENSP00000431862
MANKGPSYGMSREVQSKIEKKYDEELEERLVEWIIVQCGPDVGRPDRGRLGFQVWLKNGVILSKLVNSLYPDGSKPVKVPENPPSMVFKQM

SEQ ID NO: 90206 - protein, 201 aa, Homo sapiens; identical to SEQ ID NO: 90203
  Payload ID: 18031
  Gene Name: transgelin
  Uniprot ID: Q01995
  ENSP ID: ENSP00000431941

SEQ ID NO: 90207 - protein, 201 aa, Homo sapiens; identical to SEQ ID NO: 90203
  Payload ID: 18031
  Gene Name: transgelin
  Uniprot ID: Q01995
  ENSP ID: ENSP00000432054

SEQ ID NO: 90208 - protein, 201 aa, Homo sapiens; identical to SEQ ID NO: 90203
  Payload ID: 18031
  Gene Name: transgelin
  Uniprot ID: Q01995
  ENSP ID: ENSP00000432282

SEQ ID NO: 90209 - protein, 151 aa, Homo sapiens
  Payload ID: 18031
  Gene Name: transgelin
  ENSP ID: ENSP00000432380
  MOD_RES (1)..(1): Any amino acid
XPDRGRLGFQILSKLVNSLYPDGSKPVKVPENPPSMVFKQMEQVAQFLKAAEDYGVIKTDMFQTVDLFEGKDMAAVQRTLMALGSLAVTKNDGHYRGDPNWFMKKAQEHKREFTESQLQEGKHVIGLQMGSNRGASQAGMTGYGRPRQIIS

SEQ ID NO: 90210 - protein, 199 aa, Homo sapiens
  Payload ID: 18032
  Gene Name: transgelin 2
  Uniprot ID: P37802
  ENSP ID: ENSP00000357075
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 90211 - protein, 220 aa, Homo sapiens
  Payload ID: 18032
  Gene Name: transgelin 2
  Uniprot ID: P37802
  ENSP ID: ENSP00000357076
MSAFSLALALVSSPQPPPPIGMANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 90212 - protein, 199 aa, Homo sapiens; identical to SEQ ID NO: 90210
  Payload ID: 18032
  Gene Name: transgelin 2
  Uniprot ID: P37802
  ENSP ID: ENSP00000357077

SEQ ID NO: 90213 - protein, 187 aa, Homo sapiens
  Payload ID: 18032
  Gene Name: transgelin 2
  ENSP ID: ENSP00000412429
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQA

SEQ ID NO: 90214 - protein, 199 aa, Homo sapiens
  Payload ID: 18033
  Gene Name: transgelin 3
  Uniprot ID: Q9UI15
  ENSP ID: ENSP00000273368
MANRGPSYGLSREVQEKIEQKYDADLENKLVDWIILQCAEDIEHPPPGRAHFQKWLMDGTVLCKLINSLYPPGQEPIPKISESKMAFKQMEQISQFLKAAETYGVRTTDIFQTVDLWEGKDMAAVQRTLMALGSVAVTKDDGCYRGEPSWFHRKAQQNRRGFSEEQLRQGQNVIGLQMGSNKGASQAGMTGYGMPRQIM

SEQ ID NO: 90215 - protein, 199 aa, Homo sapiens; identical to SEQ ID NO: 90214
  Payload ID: 18033
  Gene Name: transgelin 3
  Uniprot ID: Q9UI15
  ENSP ID: ENSP00000377494

SEQ ID NO: 90216 - protein, 199 aa, Homo sapiens; identical to SEQ ID NO: 90214
  Payload ID: 18033
  Gene Name: transgelin 3
  Uniprot ID: Q9UI15
  ENSP ID: ENSP00000391160

SEQ ID NO: 90217 - protein, 115 aa, Homo sapiens
  Payload ID: 18033
  Gene Name: transgelin 3
  ENSP ID: ENSP00000417904
MAFKQMEQISQFLKAAETYGVRTTDIFQTVDLWEGKDMAAVQRTLMALGSVAVTKDDGCYRGEPSWFHRKAQQNRRGFSEEQLRQGQNVIGLQMGSNKGASQAGMTGYGMPRQIM

SEQ ID NO: 90218 - protein, 199 aa, Homo sapiens; identical to SEQ ID NO: 90214
  Payload ID: 18033
  Gene Name: transgelin 3
  Uniprot ID: Q9UI15
  ENSP ID: ENSP00000419105

SEQ ID NO: 90219 - protein, 78 aa, Homo sapiens
  Payload ID: 18033
  Gene Name: transgelin 3
  ENSP ID: ENSP00000420346
VLCKLINSLYPPGQEPIPKISESKMAFKQMEQISQFLKAAETYGVRTTDIFQTVDLWEGKPSRIGEAFPRSSFARDRT

SEQ ID NO: 90220 - protein, 163 aa, Homo sapiens
  Payload ID: 18033
  Gene Name: transgelin 3
  ENSP ID: ENSP00000420675
MANRGPSYGLSREVQEKIEQKYDADLENKLVDWIILQCAEDIEHPPPGRAHFQKWLMDGTESPAESERLFRGAASPGTERNRPADGQQQGSLPGGHDRVRDAQADHVGRGILPLVERTNVPHHGLYEKEIVSHLLTFSSFSKPSVPGFCKCCISAENPRCLLL

SEQ ID NO: 90221 - protein, 221 aa, Homo sapiens
  Payload ID: 18033
  Gene Name: transgelin 3
  ENSP ID: ENSP00000480097
MANRGPSYGLSREVQEKIEQKYDADLENKLVDWIILQCAEDIEHPPPGRAHFQKWLMDGTVLCKLINSLYPPGQEPIPKISESKMAFKQMEQISQFLKAAETYGVRTTDIFQTVDLWEGKDMAAVQRTLMALGSVAVTKDDGCYRGEPSWFHRKAQQNRRGFSEEQLRQGQNVIGLQMGSNKGASQAGMTGYGMPGRSCRTRHLPLVERTNVPHHGLYEKK

SEQ ID NO: 90222 - protein, 817 aa, Homo sapiens
  Payload ID: 18034
  Gene Name: transglutaminase 1
  Uniprot ID: P22735
  ENSP ID: ENSP00000206765
MMDGPRSDVGRWGGNPLQPPTTPSPEPEPEPDGRSRRGGGRSFWARCCGCCSCRNAADDDWGPEPSDSRGRGSSSGTRRPGSRGSDSRRPVSRGSGVNAAGDGTIREGMLVVNGVDLLSSRSDQNRREHHTDEYEYDELIVRRGQPFHMLLLLSRTYESSDRITLELLIGNNPEVGKGTHVIIPVGKGGSGGWKAQVVKASGQNLNLRVHTSPNAIIGKFQFTVRTQSDAGEFQLPFDPRNEIYILFNPWCPEDIVYVDHEDWRQEYVLNESGRIYYGTEAQIGERTWNYGQFDHGVLDACLYILDRRGMPYGGRGDPVNVSRVISAMVNSLDDNGVLIGNWSGDYSRGTNPSAWVGSVEILLSYLRTGYSVPYGQCWVFAGVTTTVLRCLGLATRTVTNFNSAHDTDTSLTMDIYFDENMKPLEHLNHDSVWNFHVWNDCWMKRPDLPSGFDGWQVVDATPQETSSGIFCCGPCSVESIKNGLVYMKYDTPFIFAEVNSDKVYWQRQDDGSFKIVYVEEKAIGTLIVTKAISSNMREDITYLYKHPEGSDAERKAVETAAAHGSKPNVYANRGSAEDVAMQVEAQDAVMGQDLMVSVMLINHSSSRRTVKLHLYLSVTFYTGVSGTIFKETKKEVELAPGASDRVTMPVAYKEYRPHLVDQGAMLLNVSGHVKESGQVLAKQHTFRLRTPDLSLTLLGAAVVGQECEVQIVFKNPLPVTLTNVVFRLEGSGLQRPKILNVGDIGGNETVTLRQSFVPVRPGPRQLIASLDSPQLSQVHGVIQVDVAPAPGDGGFFSDAGGDSHLGETIPMASRGGA

SEQ ID NO: 90223 - protein, 375 aa, Homo sapiens
  Payload ID: 18034
  Gene Name: transglutaminase 1
  Uniprot ID: P22735
  ENSP ID: ENSP00000439446
MKRPDLPSGFDGWQVVDATPQETSSGIFCCGPCSVESIKNGLVYMKYDTPFIFAEVNSDKVYWQRQDDGSFKIVYVEEKAIGTLIVTKAISSNMREDITYLYKHPEGSDAERKAVETAAAHGSKPNVYANRGSAEDVAMQVEAQDAVMGQDLMVSVMLINHSSSRRTVKLHLYLSVTFYTGVSGTIFKETKKEVELAPGASDRVTMPVAYKEYRPHLVDQGAMLLNVSGHVKESGQVLAKQHTFRLRTPDLSLTLLGAAVVGQECEVQIVFKNPLPVTLTNVVFRLEGSGLQRPKILNVGDIGGNETVTLRQSFVPVRPGPRQLIASLDSPQLSQVHGVIQVDVAPAPGDGGFFSDAGGDSHLGETIPMASRGGA

SEQ ID NO: 90224 - protein, 9 aa, Homo sapiens
  Payload ID: 18034
  Gene Name: transglutaminase 1
  ENSP ID: ENSP00000452690
MMDGPRSDV

SEQ ID NO: 90225 - protein, 64 aa, Homo sapiens
  Payload ID: 18034
  Gene Name: transglutaminase 1
  ENSP ID: ENSP00000452822
MMDGPRSDVGRWGGNPLQPPTTPSPEPEPEPDGRSRRGGGRSFWARCCGCCSCRNAADDDWGPE

SEQ ID NO: 90226 - protein, 50 aa, Homo sapiens
  Payload ID: 18034
  Gene Name: transglutaminase 1
  ENSP ID: ENSP00000453234
MMDGPRSDVGRWGGNPLQPPTTPSPEPEPEPDGRSRRGGGRSFWARCCGC

SEQ ID NO: 90227 - protein, 209 aa, Homo sapiens
  Payload ID: 18034
  Gene Name: transglutaminase 1
  ENSP ID: ENSP00000453337
MPYGGRGDPVNVSRVISAMVNSLDDNGVLIGNWSGDYSRGTNPSAWVGSVEILLSYLRTGYSVPYGQCWVFAGVTTTVLRCLGLATRTVTNFNSAHDTDTSLTMDIYFDENMKPLEHLNHDSVWNFHVWNDCWMKRPDLPSGFDGWQVVDATPQETSSGIFCCGPCSVESIKNGLVYMKYDTPFIFAEVNSDKVYWQRQDDGSFKIVYV

SEQ ID NO: 90228 - protein, 128 aa, Homo sapiens
  Payload ID: 18034
  Gene Name: transglutaminase 1
  ENSP ID: ENSP00000453701
YLSVTFYTGVSGTIFKETKKEVELAPGASDRVTMPVAYKEYRPHLVDQGAMLLNVSGHVKESGQVLAKQHTFRLRTPDLSLTLLGAAVVGQECEVQIVFKNPLPVTLTNVVFRLEGSGLQRPKILNVG

SEQ ID NO: 90229 - protein, 135 aa, Homo sapiens
  Payload ID: 18034
  Gene Name: transglutaminase 1
  ENSP ID: ENSP00000453840
MMDGPRSDVGRWGGNPLQPPTTPSPEPEPEPDGRSRRGGGRSFWARCCGCCSCRNAADDDWGPEPSDSRGRGSSSGTRRPGSRGSDSRRPVSRGSGVNAAGDGTIREGMLVVNGVDLLSSRSDQNRREHHTDEYE

SEQ ID NO: 90230 - protein, 42 aa, Homo sapiens
  Payload ID: 18034
  Gene Name: transglutaminase 1
  ENSP ID: ENSP00000454070
MMDGPRSDVGRWGGNPLQPPTTPSPEPEPEPDGRSRRGGGRS

SEQ ID NO: 90231 - protein, 687 aa, Homo sapiens
  Payload ID: 18035
  Gene Name: transglutaminase 2
  Uniprot ID: P21980
  ENSP ID: ENSP00000355330
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 90232 - protein, 280 aa, Homo sapiens
  Payload ID: 18035
  Gene Name: transglutaminase 2
  ENSP ID: ENSP00000362502
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVF

SEQ ID NO: 90233 - protein, 159 aa, Homo sapiens
  Payload ID: 18035
  Gene Name: transglutaminase 2
  ENSP ID: ENSP00000387642
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEY

SEQ ID NO: 90234 - protein, 693 aa, Homo sapiens
  Payload ID: 18036
  Gene Name: transglutaminase 3
  Uniprot ID: Q08188
  ENSP ID: ENSP00000370867
MAALGVQSINWQTAFNRQAHHTDKFSSQELILRRGQNFQVLMIMNKGLGSNERLEFIVSTGPYPSESAMTKAVFPLSNGSSGGWSAVLQASNGNTLTISISSPASAPIGRYTMALQIFSQGGISSVKLGTFILLFNPWLNVDSVFMGNHAEREEYVQEDAGIIFVGSTNRIGMIGWNFGQFEEDILSICLSILDRSLNFRRDAATDVASRNDPKYVGRVLSAMINSNDDNGVLAGNWSGTYTGGRDPRSWNGSVEILKNWKKSGFSPVRYGQCWVFAGTLNTALRSLGIPSRVITNFNSAHDTDRNLSVDVYYDPMGNPLDKGSDSVWNFHVWNEGWFVRSDLGPSYGGWQVLDATPQERSQGVFQCGPASVIGVREGDVQLNFDMPFIFAEVNADRITWLYDNTTGKQWKNSVNSHTIGRYISTKAVGSNARMDVTDKYKYPEGSDQERQVFQKALGKLKPNTPFAATSSMGLETEEQEPSIIGKLKVAGMLAVGKEVNLVLLLKNLSRDTKTVTVNMTAWTIIYNGTLVHEVWKDSATMSLDPEEEAEHPIKISYAQYEKYLKSDNMIRITAVCKVPDESEVVVERDIILDNPTLTLEVLNEARVRKPVNVQMLFSNPLDEPVRDCVLMVEGSGLLLGNLKIDVPTLGPKEGSRVRFDILPSRSGTKQLLADFSCNKFPAIKAMLSIDVAE

SEQ ID NO: 90235 - protein, 684 aa, Homo sapiens
  Payload ID: 18037
  Gene Name: transglutaminase 4
  Uniprot ID: P49221
  ENSP ID: ENSP00000296125
MMDASKELQVLHIDFLNQDNAVSHHTWEFQTSSPVFRRGQVFHLRLVLNQPLQSYHQLKLEFSTGPNPSIAKHTLVVLDPRTPSDHYNWQATLQNESGKEVTVAVTSSPNAILGKYQLNVKTGNHILKSEENILYLLFNPWCKEDMVFMPDEDERKEYILNDTGCHYVGAARSIKCKPWNFGQFEKNVLDCCISLLTESSLKPTDRRDPVLVCRAMCAMMSFEKGQGVLIGNWTGDYEGGTAPYKWTGSAPILQQYYNTKQAVCFGQCWVFAGILTTVLRALGIPARSVTGFDSAHDTERNLTVDTYVNENGEKITSMTHDSVWNFHVWTDAWMKRPDLPKGYDGWQAVDATPQERSQGVFCCGPSPLTAIRKGDIFIVYDTRFVFSEVNGDRLIWLVKMVNGQEELHVISMETTSIGKNISTKAVGQDRRRDITYEYKYPEGSSEERQVMDHAFLLLSSEREHRRPVKENFLHMSVQSDDVLLGNSVNFTVILKRKTAALQNVNILGSFELQLYTGKKMAKLCDLNKTSQIQGQVSEVTLTLDSKTYINSLAILDDEPVIRGFIIAEIVESKEIMASEVFTSFQYPEFSIELPNTGRIGQLLVCNCIFKNTLAIPLTDVKFSLESLGISSLQTSDHGTVQPGETIQSQIKCTPIKTGPKKFIVKLSSKQVKEINAQKIVLITK

SEQ ID NO: 90236 - protein, 91 aa, Homo sapiens
  Payload ID: 18037
  Gene Name: transglutaminase 4
  ENSP ID: ENSP00000403711
MMDASKELQVLHIDFLNQDNAVSHHTWEFQTSSPVFRRGQVFHLRLVLNQPLQSYHQLKLEFSTGHSGCHQFPQCHPGQVPTKRENWKPHP

SEQ ID NO: 90237 - protein, 684 aa, Homo sapiens; identical to SEQ ID NO: 90235
  Payload ID: 18037
  Gene Name: Transglutaminase 4
  ENSP ID: ENSP00000487307

SEQ ID NO: 90238 - protein, 91 aa, Homo sapiens; identical to SEQ ID NO: 90236
  Payload ID: 18037
  Gene Name: Transglutaminase 4
  ENSP ID: ENSP00000487489

SEQ ID NO: 90239 - protein, 638 aa, Homo sapiens
  Payload ID: 18038
  Gene Name: transglutaminase 5
  Uniprot ID: O43548
  ENSP ID: ENSP00000220419
MAQGLEVALTDLQSSRNNVRHHTEEITVDHLLVRRGQAFNLTLYFRNRSFQPGLDNIIFVVETEDAVYLDSEPQRQEYVMNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 90240 - protein, 720 aa, Homo sapiens
  Payload ID: 18038
  Gene Name: transglutaminase 5
  Uniprot ID: O43548
  ENSP ID: ENSP00000220420
MAQGLEVALTDLQSSRNNVRHHTEEITVDHLLVRRGQAFNLTLYFRNRSFQPGLDNIIFVVETGPLPDLALGTRAVFSLARHHSPSPWIAWLETNGATSTEVSLCAPPTAAVGRYLLKIHIDSFQGSVTAYQLGEFILLFNPWCPEDAVYLDSEPQRQEYVMNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 90241 - protein, 721 aa, Homo sapiens
  Payload ID: 18038
  Gene Name: transglutaminase 5
  ENSP ID: ENSP00000479638
LAAPGLEVALTDLQSSRNNVRHHTEEITVDHLLVRRGQAFNLTLYFRNRSFQPGLDNIIFVVETGPLPDLALGTRAVFSLARHHSPSPWIAWLETNGATSTEVSLCAPPTAAVGRYLLKIHIDSFQGSVTAYQLGEFILLFNPWCPEDAVYLDSEPQRQEYVMNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 90242 - protein, 719 aa, Homo sapiens
  Payload ID: 18038
  Gene Name: transglutaminase 5
  ENSP ID: ENSP00000479732
AQGLEVALTDLQSSRNNVRHHTEEITVDHLLVRRGQAFNLTLYFRNRSFQPGLDNIIFVVETGPLPDLALGTRAVFSLARHHSPSPWIAWLETNGATSTEVSLCAPPTAAVGRYLLKIHIDSFQGSVTAYQLGEFILLFNPWCPEDAVYLDSEPQRQEYVMNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 90243 - protein, 637 aa, Homo sapiens
  Payload ID: 18038
  Gene Name: transglutaminase 5
  ENSP ID: ENSP00000482542
AQGLEVALTDLQSSRNNVRHHTEEITVDHLLVRRGQAFNLTLYFRNRSFQPGLDNIIFVVETEDAVYLDSEPQRQEYVMNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 90244 - protein, 706 aa, Homo sapiens
  Payload ID: 18039
  Gene Name: transglutaminase 6
  Uniprot ID: O95932
  ENSP ID: ENSP00000202625
MAGIRVTKVDWQRSRNGAAHHTQEYPCPELVVRRGQSFSLTLELSRALDCEEILIFTMETGPRASEALHTKAVFQTSELERGEGWTAAREAQMEKTLTVSLASPPSAVIGRYLLSIRLSSHRKHSNRRLGEFVLLFNPWCAEDDVFLASEEERQEYVLSDSGIIFRGVEKHIRAQGWNYGQFEEDILNICLSILDRSPGHQNNPATDVSCRHNPIYVTRVISAMVNSNNDRGVVQGQWQGKYGGGTSPLHWRGSVAILQKWLKGRYKPVKYGQCWVFAGVLCTVLRCLGIATRVVSNFNSAHDTDQNLSVDKYVDSFGRTLEDLTEDSMWNFHVWNESWFARQDLGPSYNGWQVLDATPQEESEGVFRCGPASVTAIREGDVHLAHDGPFVFAEVNADYITWLWHEDESRERVYSNTKKIGRCISTKAVGSDSRVDITDLYKYPEGSRKERQVYSKAVNRLFGVEASGRRIWIRRAGGRCLWRDDLLEPATKPSIAGKFKVLEPPMLGHDLRLALCLANLTSRAQRVRVNLSGATILYTRKPVAEILHESHAVRLGPQEEKRIPITISYSKYKEDLTEDKKILLAAMCLVTKGEKLLVEKDITLEDFITIKVLGPAMVGVAVTVEVTVVNPLIERVKDCALMVEGSGLLQEQLSIDVPTLEPQERASVQFDITPSKSGPRQLQVDLVSPHFPDIKGFVIVHVATAK

SEQ ID NO: 90245 - protein, 625 aa, Homo sapiens
  Payload ID: 18039
  Gene Name: transglutaminase 6
  Uniprot ID: O95932
  ENSP ID: ENSP00000370831
MAGIRVTKVDWQRSRNGAAHHTQEYPCPELVVRRGQSFSLTLELSRALDCEEILIFTMETGPRASEALHTKAVFQTSELERGEGWTAAREAQMEKTLTVSLASPPSAVIGRYLLSIRLSSHRKHSNRRLGEFVLLFNPWCAEDDVFLASEEERQEYVLSDSGIIFRGVEKHIRAQGWNYGQFEEDILNICLSILDRSPGHQNNPATDVSCRHNPIYVTRVISAMVNSNNDRGVVQGQWQGKYGGGTSPLHWRGSVAILQKWLKGRYKPVKYGQCWVFAGVLCTVLRCLGIATRVVSNFNSAHDTDQNLSVDKYVDSFGRTLEDLTEDSMWNFHVWNESWFARQDLGPSYNGWQVLDATPQEESEGVFRCGPASVTAIREGDVHLAHDGPFVFAEVNADYITWLWHEDESRERVYSNTKKIGRCISTKAVGSDSRVDITDLYKYPEGSRKERQVYSKAVNRLFGVEASGRRIWIRRAGGRCLWRDDLLEPATKPSIAGKFKVLEPPMLGHDLRLALCLANLTSRAQRVRVNLSGATILYTRKPVAEILHESHAVRLGPQEEKRIPITISYSKYKEDLTEDKKILLAAMCLVTKGEKLLVEKDITLEDFITIKRAYPGASGEGLSPV

SEQ ID NO: 90246 - protein, 710 aa, Homo sapiens
  Payload ID: 18040
  Gene Name: transglutaminase 7
  Uniprot ID: Q96PF1
  ENSP ID: ENSP00000389466
MDQVATLRLESVDLQSSRNNKEHHTQEMGVKRLTVRRGQPFYLRLSFSRPFQSQNDHITFVAETGPKPSELLGTRATFFLTRVQPGNVWSASDFTIDSNSLQVSLFTPANAVIGHYTLKIEISQGQGHSVTYPLGTFILLFNPWSPEDDVYLPSEILLQEYIMRDYGFVYKGHERFITSWPWNYGQFEEDIIDICFEILNKSLYHLKNPAKDCSQRNDVVYVCRVVSAMINSNDDNGVLQGNWGEDYSKGVSPLEWKGSVAILQQWSARGGQPVKYGQCWVFASVMCTVMRCLGVPTRVVSNFRSAHNVDRNLTIDTYYDRNAEMLSTQKRDKIWNFHVWNECWMIRKDLPPGYNGWQVLDPTPQQTSSGLFCCGPASVKAIREGDVHLAYDTPFVYAEVNADEVIWLLGDGQAQEILAHNTSSIGKEISTKMVGSDQRQSITSSYKYPEGSPEERAVFMKASRKMLGPQRASLPFLDLLESGGLRDQPAQLQLHLARIPEWGQDLQLLLRIQRVPDSTHPRGPIGLVVRFCAQALLHGGGTQKPFWRHTVRMNLDFGKETQWPLLLPYSNYRNKLTDEKLIRVSGIAEVEETGRSMLVLKDICLEPPHLSIEVSERAEVGKALRVHVTLTNTLMVALSSCTMVLEGSGLINGQIAKDLGTLVAGHTLQIQLDLYPTKAGPRQLQVLISSNEVKEIKGYKDIFVTVAGAP

SEQ ID NO: 90247 - protein, 479 aa, Homo sapiens
  Payload ID: 18041
  Gene Name: trans-golgi network protein 2
  ENSP ID: ENSP00000282120
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTSKSHPELQTPKDSTGKSGAEAQTPEDSPNRSGAEAKTQKDSPSKSGSEAQTTKDVPNKSGADGQTPKDGSSKSGAEDQTPKDVPNKSGAEKQTPKDGSNKSGAEEQGPIDGPSKSGAEEQTSKDSPNKVVPEQPSRKDHSKPISNPSDNKELPKADTNQLADKGKLSPHAFKTESGEETDLISPPQEEVKSSEPTEDVEPKEAEDDDTGPEEGSPPKEEKEKMSGSASSENREGTLSDSTGSEKDDLYPNGSGNGSAESSHFFAYLVTAAILVAVLYIAHHNKRKIIAFVLEGKRSKVTRRPKASDYQRLDQKYVLILNVFPAPPKRSFFPVLTEWYIPLEKDERHQWIVLLSFQL

SEQ ID NO: 90248 - protein, 437 aa, Homo sapiens
  Payload ID: 18041
  Gene Name: trans-golgi network protein 2
  Uniprot ID: O43493
  ENSP ID: ENSP00000366603
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTSKSHPELQTPKDSTGKSGAEAQTPEDSPNRSGAEAKTQKDSPSKSGSEAQTTKDVPNKSGADGQTPKDGSSKSGAEDQTPKDVPNKSGAEKQTPKDGSNKSGAEEQGPIDGPSKSGAEEQTSKDSPNKVVPEQPSRKDHSKPISNPSDNKELPKADTNQLADKGKLSPHAFKTESGEETDLISPPQEEVKSSEPTEDVEPKEAEDDDTGPEEGSPPKEEKEKMSGSASSENREGTLSDSTGSEKDDLYPNGSGNGSAESSHFFAYLVTAAILVAVLYIAHHNKRKIIAFVLEGKRSKVTRRPKASDYQRLDQKS

SEQ ID NO: 90249 - protein, 379 aa, Homo sapiens
  Payload ID: 18041
  Gene Name: trans-golgi network protein 2
  Uniprot ID: O43493
  ENSP ID: ENSP00000381312
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTSKSHPELQTPKDSTGKSGAEAQTPEDSPNRSGAEAKTQKDSPSKSGSEAQTTKDVPNKSGADGQTPKDGSSKSGAEDQTPKDVPNKSGAEKQTPKDGSNKSGAEEQGPIDGPSKSGAEEQTSKDSPNKEEVKSSEPTEDVEPKEAEDDDTGPEEGSPPKEEKEKMSGSASSENREGTLSDSTGSEKDDLYPNGSGNGSAESSHFFAYLVTAAILVAVLYIAHHNKRKIIAFVLEGKRSKVTRRPKASDYQRLDQKS

SEQ ID NO: 90250 - protein, 453 aa, Homo sapiens
  Payload ID: 18041
  Gene Name: trans-golgi network protein 2
  Uniprot ID: O43493
  ENSP ID: ENSP00000386443
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTSKSHPELQTPKDSTGKSGAEAQTPEDSPNRSGAEAKTQKDSPSKSGSEAQTTKDVPNKSGADGQTPKDGSSKSGAEDQTPKDVPNKSGAEKQTPKDGSNKSGAEEQGPIDGPSKSGAEEQTSKDSPNKVVPEQPSRKDHSKPISNPSDNKELPKADTNQLADKGKLSPHAFKTESGEETDLISPPQEEVKSSEPTEDVEPKEAEDDDTGPEEGSPPKEEKEKMSGSASSENREGTLSDSTGSEKDDLYPNGSGNGSAESSHFFAYLVTAAILVAVLYIAHHNKRKIIAFVLEGKRSKVTRRPKASDYQRLDQKIFFPLSPNRMVYSSGKR

SEQ ID NO: 90251 - protein, 454 aa, Homo sapiens
  Payload ID: 18041
  Gene Name: trans-golgi network protein 2
  ENSP ID: ENSP00000387035
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTSKSHPELQTPKDSTGKSGAEAQTPEDSPNRSGAEAKTQKDSPSKSGSEAQTTKDVPNKSGADGQTPKDGSSKSGAEDQTPKDVPNKSGAEKQTPKDGSNKSGAEEQGPIDGPSKSGAEEQTSKDSPNKVVPEQPSRKDHSKPISNPSDNKELPKADTNQLADKGKLSPHAFKTESGEETDLISPPQEEVKSSEPTEDVEPKEAEDDDTGPEEGSPPKEEKEKMSGSASSENREGTLSDSTGSEKDDLYPNGSGNGSAESSHFFAYLVTAAILVAVLYIAHHNKRKIIAFVLEGKRSKVTRRPKASDYQRLDQKYVLILNVFPAPPKRSFFP

SEQ ID NO: 90252 - protein, 447 aa, Homo sapiens
  Payload ID: 18041
  Gene Name: trans-golgi network protein 2
  Uniprot ID: O43493
  ENSP ID: ENSP00000391190
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTSKSHPELQTPKDSTGKSGAEAQTPEDSPNRSGAEAKTQKDSPSKSGSEAQTTKDVPNKSGADGQTPKDGSSKSGAEDQTPKDVPNKSGAEKQTPKDGSNKSGAEEQGPIDGPSKSGAEEQTSKDSPNKVVPEQPSRKDHSKPISNPSDNKELPKADTNQLADKGKLSPHAFKTESGEETDLISPPQEEVKSSEPTEDVEPKEAEDDDTGPEEGSPPKEEKEKMSGSASSENREGTLSDSTGSEKDDLYPNGSGNGSAESSHFFAYLVTAAILVAVLYIAHHNKRKIIAFVLEGKRSKVTRRPKASDYQRLDQKVRKEEPGPWEG

SEQ ID NO: 90253 - protein, 213 aa, Homo sapiens
  Payload ID: 18042
  Gene Name: trans-golgi network vesicle protein 23 homolog A (S. cerevisiae)
  Uniprot ID: A6NH52
  ENSP ID: ENSP00000299866
MKQALVDDTEDVSLDFGNEEELAFRKAKIRHPLATFFHLFFRVSAIVTYVSCDWFSKSFVGCFVMVLLLLSLDFWSVKNVTGRLLVGLRWWNQIDEDGKSHWIFEARKVSPNSIAATEAEARIFWLGLIICPMIWIVFFFSTLFSLKLKWLALVVAGISLQAANLYGYILCKMGGNSDIGKVTASFLSQTVFQTACPGDFQKPGLEGLEIHQH

SEQ ID NO: 90254 - protein, 188 aa, Homo sapiens
  Payload ID: 18042
  Gene Name: trans-golgi network vesicle protein 23 homolog A (S. cerevisiae)
  Uniprot ID: A6NH52
  ENSP ID: ENSP00000411972
MKQALVDDTEDVSLDFGNEEELAFRKAKIRDRVSKLLASVILLPWPPKVLGLKNVTGRLLVGLRWWNQIDEDGKSHWIFEARKVSPNSIAATEAEARIFWLGLIICPMIWIVFFFSTLFSLKLKWLALVVAGISLQAANLYGYILCKMGGNSDIGKVTASFLSQTVFQTACPGDFQKPGLEGLEIHQH

SEQ ID NO: 90255 - protein, 37 aa, Homo sapiens
  Payload ID: 18042
  Gene Name: trans-golgi network vesicle protein 23 homolog A (S. cerevisiae)
  ENSP ID: ENSP00000458488
MKQALVDDTEDVSLDFGNEEELAFRKAKIRNTHSPMT

SEQ ID NO: 90256 - protein, 213 aa, Homo sapiens; identical to SEQ ID NO: 90253
  Payload ID: 18042
  Gene Name: trans-golgi network vesicle protein 23 homolog A (S. cerevisiae)
  Uniprot ID: A6NH52
  ENSP ID: ENSP00000460567

SEQ ID NO: 90257 - protein, 150 aa, Homo sapiens
  Payload ID: 18042
  Gene Name: trans-golgi network vesicle protein 23 homolog A (S. cerevisiae)
  ENSP ID: ENSP00000460822
VMVLLLLSLDFWSVKNVTGRLLVGLRWWNQIDEDGKSHWIFEARKVSPNSIAATEAEARIFWLGLIICPMIWIVFFFSTLFSLKLKWLALVVAGISLQAANLYGYILCKMGGNSDIGKVTASFLSQTVFQTACPGDFQKPGLEGLEIHQH

SEQ ID NO: 90258 - protein, 62 aa, Homo sapiens
  Payload ID: 18042
  Gene Name: trans-golgi network vesicle protein 23 homolog A (S. cerevisiae)
  ENSP ID: ENSP00000461067
VSPNSIAATEAEARIFWLGLIICPMIWIVFFFSTLFSLKLKWLACPGDFQKPGLEGLEIHQH

SEQ ID NO: 90259 - protein, 153 aa, Homo sapiens
  Payload ID: 18042
  Gene Name: trans-golgi network vesicle protein 23 homolog A (S. cerevisiae)
  ENSP ID: ENSP00000482095
  MOD_RES (1)..(1): Any amino acid
XDWFSKSFVGCFVMVLLLLSLDFWSVKNVTGRLLVGLRWWNQIDEDGKSHWIFEARKVSPNSIAATEAEARIFWLGLIICPMIWIVFFFSTLFSLKLKWLALVVAGISLQAANLYGYILCKMGGNSDIGKVTASFLSQTVFQTAFLSSQAEMA

SEQ ID NO: 90260 - protein, 213 aa, Homo sapiens; identical to SEQ ID NO: 90253
  Payload ID: 18042
  Gene Name: trans-golgi network vesicle protein 23 homolog A (S. cerevisiae)
  Uniprot ID: A6NH52
  ENSP ID: ENSP00000482891

SEQ ID NO: 90261 - protein, 205 aa, Homo sapiens
  Payload ID: 18043
  Gene Name: trans-golgi network vesicle protein 23 homolog B (S. cerevisiae)
  Uniprot ID: Q9NYZ1
  ENSP ID: ENSP00000305654
MLQQDSNDDTEDVSLFDAEEETTNRPRKAKIRHPVASFFHLFFRVSAIIVYLLCGLLSSSFITCMVTIILLLSCDFWAVKNVTGRLMVGLRWWNHIDEDGKSHWVFESRKESSQENKTVSEAESRIFWLGLIACPVLWVIFAFSALFSFRVKWLAVVIMGVVLQGANLYGYIRCKVRSRKHLTSMATSYFGKQFLRQNTGDDQTS

SEQ ID NO: 90262 - protein, 53 aa, Homo sapiens
  Payload ID: 18043
  Gene Name: trans-golgi network vesicle protein 23 homolog B (S. cerevisiae)
  ENSP ID: ENSP00000460239
MLQQDSNDDTEDVSLFDAEEETTNRPRKAKIRHPVASFFHLFFRVSAIIVYLL

SEQ ID NO: 90263 - protein, 37 aa, Homo sapiens
  Payload ID: 18043
  Gene Name: trans-golgi network vesicle protein 23 homolog B (S. cerevisiae)
  ENSP ID: ENSP00000460797
MLQQDSNDDTEDVSLFDAEEETTNRPRKAKIRMSQVD

SEQ ID NO: 90264 - protein, 203 aa, Homo sapiens
  Payload ID: 18043
  Gene Name: trans-golgi network vesicle protein 23 homolog B (S. cerevisiae)
  ENSP ID: ENSP00000462334
MLQQDSNDDTEDVSLFDAEEETTNRPRKAKIRHPVASFFHLFFRVSAIIVYLLCGLLSSSFITCMVTIILLLSCDFWAVKNVTGRLMVGLRWWNHIDEDGKSHWVFESRKESSQENKTVSEAESRIFWLGLIACPVLWVIFAFSALFSFRVKWLAVVIMGVVLQGANLYGYIRCKVRSRKHLTSMATSYFGKQFLRQVSVFWM

SEQ ID NO: 90265 - protein, 141 aa, Homo sapiens
  Payload ID: 18043
  Gene Name: trans-golgi network vesicle protein 23 homolog B (S. cerevisiae)
  ENSP ID: ENSP00000463400
MVTIILLLSCDFWAVKNVTGRLMVGLRWWNHIDEDGKSHWVFESRKESSQENKTVSEAESRIFWLGLIACPVLWVIFAFSALFSFRVKWLAVVIMGVVLQGANLYGYIRCKVRSRKHLTSMATSYFGKQFLRQNTGDDQTS

SEQ ID NO: 90266 - protein, 141 aa, Homo sapiens; identical to SEQ ID NO: 90265
  Payload ID: 18043
  Gene Name: trans-golgi network vesicle protein 23 homolog B (S. cerevisiae)
  ENSP ID: ENSP00000465872

SEQ ID NO: 90267 - protein, 132 aa, Homo sapiens
  Payload ID: 18043
  Gene Name: trans-golgi network vesicle protein 23 homolog B (S. cerevisiae)
  ENSP ID: ENSP00000467001
MVTIILLLSCDFWAVKNVTGRLMVGLRWWNHIDEDGKSHWVFESRKESSQENKTVSEAESRIFWLGLIACPVLWVIFAFSALFSFRVKWLAVVIMGVVLQGANLYGYIRCKVRSRKHLTSMATSYFGKQFLR

SEQ ID NO: 90268 - protein, 276 aa, Homo sapiens
  Payload ID: 18044
  Gene Name: trans-golgi network vesicle protein 23 homolog C (S. cerevisiae)
  Uniprot ID: Q96ET8
  ENSP ID: ENSP00000225576
MLQQDSNDDTEDVSLFDAEEETTNRPRKAKIRHPVASFFHLFFRVSAIIVCLLCELLSSSFITCMVTIILLLSCDFWAVKNVTGRLMVGLRWWNHIDEDGKSHWVFESRKESSQENKTVSEAESRIFWLGLIACSVLWVIFAFSALFSFTVKWLRRSRHIAQTGLKVLGSRDPPASAFQSAGITGVSRCPGHPSRKFHQVDINSFTRITDRALYWKPAPRLSSPPLRAAPGNCQQMAPARLFLSLRLWAWRGGGESPNSRGTGEPGPKFHLASGMH

SEQ ID NO: 90269 - protein, 205 aa, Homo sapiens
  Payload ID: 18044
  Gene Name: trans-golgi network vesicle protein 23 homolog C (S. cerevisiae)
  ENSP ID: ENSP00000406387
MLQQDSNDDTEDVSLFDAEEETTNRPRKAKIRHPVASFFHLFFRVSAIIVCLLCELLSSSFITCMVTIILLLSCDFWAVKNVTGRLMVGLRWWNHIDEDGKSHWVFESRKESSQENKTVSEAESRIFWLGLIACSVLWVIFAFSALFSFTVKWLAVVIMGVVLQGANLYGYIRCKVRSRKHLTSMATSYFGKQFLRQNTGDDQTS

SEQ ID NO: 90270 - protein, 110 aa, Homo sapiens
  Payload ID: 18044
  Gene Name: trans-golgi network vesicle protein 23 homolog C (S. cerevisiae)
  ENSP ID: ENSP00000409988
MVTIILLLSCDFWAVKNVTGRLMVGLRWWNHIDEDGKSHWVFESRKESSQENKTVSEAESRIFWLGLIACSVLWVIFAFSALFSFTVKWLAVVIMGVVLQGANLYGYIRC

SEQ ID NO: 90271 - protein, 205 aa, Homo sapiens; identical to SEQ ID NO: 90269
  Payload ID: 18044
  Gene Name: trans-golgi network vesicle protein 23 homolog C (S. cerevisiae)
  ENSP ID: ENSP00000413355

SEQ ID NO: 90272 - protein, 37 aa, Homo sapiens; identical to SEQ ID NO: 90263
  Payload ID: 18044
  Gene Name: trans-golgi network vesicle protein 23 homolog C (S. cerevisiae)
  ENSP ID: ENSP00000428373

SEQ ID NO: 90273 - protein, 53 aa, Homo sapiens
  Payload ID: 18044
  Gene Name: trans-golgi network vesicle protein 23 homolog C (S. cerevisiae)
  ENSP ID: ENSP00000428748
MLQQDSNDDTEDVSLFDAEEETTNRPRKAKIRHPVASFFHLFFRVSAIIVCLL

SEQ ID NO: 90274 - protein, 141 aa, Homo sapiens
  Payload ID: 18044
  Gene Name: trans-golgi network vesicle protein 23 homolog C (S. cerevisiae)
  ENSP ID: ENSP00000463371
MVTIILLLSCDFWAVKNVTGRLMVGLRWWNHIDEDGKSHWVFESRKESSQENKTVSEAESRIFWLGLIACSVLWVIFAFSALFSFTVKWLAVVIMGVVLQGANLYGYIRCKVRSRKHLTSMATSYFGKQFLRQNTGDDQTS

SEQ ID NO: 90275 - protein, 203 aa, Homo sapiens
  Payload ID: 18044
  Gene Name: trans-golgi network vesicle protein 23 homolog C (S. cerevisiae)
  Uniprot ID: Q96ET8
  ENSP ID: ENSP00000464052
MLQQDSNDDTEDVSLFDAEEETTNRPRKAKIRHPVASFFHLFFRVSAIIVCLLCELLSSSFITCMVTIILLLSCDFWAVKNVTGRLMVGLRWWNHIDEDGKSHWVFESRKESSQENKTVSEAESRIFWLGLIACSVLWVIFAFSALFSFTVKWLAVVIMGVVLQGANLYGYIRCKVRSRKHLTSMATSYFGKQFLRQVSVFWM

SEQ ID NO: 90276 - protein, 60 aa, Homo sapiens
  Payload ID: 18044
  Gene Name: trans-golgi network vesicle protein 23 homolog C (S. cerevisiae)
  ENSP ID: ENSP00000465522
ESSQENKTVSEAESRIFWLGLIACSVLWVIFAFSALFSFTVKWLVTVFGDRTFKDMIKIK

SEQ ID NO: 90277 - protein, 1119 aa, Homo sapiens
  Payload ID: 18045
  Gene Name: transient receptor potential cation channel, subfamily A, member 1
  Uniprot ID: O75762
  ENSP ID: ENSP00000262209
MKRSLRKMWRPGEKKEPQGVVYEDVPDDTEDFKESLKVVFEGSAYGLQNFNKQKKLKRCDDMDTFFLHYAAAEGQIELMEKITRDSSLEVLHEMDDYGNTPLHCAVEKNQIESVKFLLSRGANPNLRNFNMMAPLHIAVQGMNNEVMKVLLEHRTIDVNLEGENGNTAVIIACTTNNSEALQILLKKGAKPCKSNKWGCFPIHQAAFSGSKECMEIILRFGEEHGYSRQLHINFMNNGKATPLHLAVQNGDLEMIKMCLDNGAQIDPVEKGRCTAIHFAATQGATEIVKLMISSYSGSVDIVNTTDGCHETMLHRASLFDHHELADYLISVGADINKIDSEGRSPLILATASASWNIVNLLLSKGAQVDIKDNFGRNFLHLTVQQPYGLKNLRPEFMQMQQIKELVMDEDNDGCTPLHYACRQGGPGSVNNLLGFNVSIHSKSKDKKSPLHFAASYGRINTCQRLLQDISDTRLLNEGDLHGMTPLHLAAKNGHDKVVQLLLKKGALFLSDHNGWTALHHASMGGYTQTMKVILDTNLKCTDRLDEDGNTALHFAAREGHAKAVALLLSHNADIVLNKQQASFLHLALHNKRKEVVLTIIRSKRWDECLKIFSHNSPGNKCPITEMIEYLPECMKVLLDFCMLHSTEDKSCRDYYIEYNFKYLQCPLEFTKKTPTQDVIYEPLTALNAMVQNNRIELLNHPVCKEYLLMKWLAYGFRAHMMNLGSYCLGLIPMTILVVNIKPGMAFNSTGIINETSDHSEILDTTNSYLIKTCMILVFLSSIFGYCKEAGQIFQQKRNYFMDISNVLEWIIYTTGIIFVLPLFVEIPAHLQWQCGAIAVYFYWMNFLLYLQRFENCGIFIVMLEVILKTLLRSTVVFIFLLLAFGLSFYILLNLQDPFSSPLLSIIQTFSMMLGDINYRESFLEPYLRNELAHPVLSFAQLVSFTIFVPIVLMNLLIGLAVGDIAEVQKHASLKRIAMQVELHTSLEKKLPLWFLRKVDQKSTIVYPNKPRSGGMLFHIFCFLFCTGEIRQEIPNADKSLEMEILKQKYRLKDLTFLLEKQHELIKLIIQKMEIISETEDDDSHCSFQDRFKKEQMEQRNSRWNTVLRAVKAKTHHLEP

SEQ ID NO: 90278 - protein, 916 aa, Homo sapiens
  Payload ID: 18045
  Gene Name: transient receptor potential cation channel, subfamily A, member 1
  ENSP ID: ENSP00000428151
VLLEHRTIDVNLEGENGNTAVIIACTTNNSEALQILLKKGAKPCKSNKWGCFPIHQAAFSGSKECMEIILRFGEEHGYSRQLHINFMNNGKATPLHLAVQNGDLEMIKMCLDNGAQIDPVEKGRCTAIHFAATQGATEIVKLMISSYSGSVDIVNTTDGCHETMLHRASLFDHHELADYLISVGADINKIDSEGRSPLILATASASWNIVNLLLSKGAQVDIKDNFGRNFLHLTVQQPYGLKNLRPEFMQMQQIKELVMDEDNDGCTPLHYACRQGGPGSVNNLLGFNVSIHSKSKDKKSPLHFAASYGRINTCQRLLQDISDTRLLNEGDLHGMTPLHLAAKNGHDKVVQLLLKKGALFLSDHNGWTALHHASMGGYTQTMKVILDTNLKCTDRLDEDGNTALHFAAREGHAKAVALLLSHNADIVLNKQQASFLHLALHNKRKEVVLTIIRSKRWDECLKIFSHNSPGNKCPITEMIEYLPECMKVLLDFCMLHSTEDKSCRDYYIEYNFKYLQCPLEFTKKTPTQDVIYEPLTALNAMVQNNRIELLNHPVCKEYLLMKWLAYGFRAHMMNLGSYCLGLIPMTILVVNIKPGMAFNSTGIINETSDHSEILDTTNSYLIKTCMILVFLSSIFGYCKEAGQIFQQKRNYFMDISNVLEWIIYTTGIIFVLPLFVEIPAHLQWQCGAIAVYFYWMNFLLYLQRFENCGIFIVMLEVILKTLLRSTVVFIFLLLAFGLSFYILLNLQDPFSSPLLSIIQTFSMMLGDINYRESFLEPYLRNELAHPVLSFAQLVSFTIFVPIVLMNLLIGLAVGDIAEVQKHASLKRIAMQVELHTSLEKKLPLWFLRKVDQKSTIVYPNKPRSGGMLFHIFCFLFCTGEIRQEIPNADKSLEMEILKQKYRKTTCAFVLTLIPVG

SEQ ID NO: 90279 - protein, 759 aa, Homo sapiens
  Payload ID: 18046
  Gene Name: transient receptor potential cation channel, subfamily C, member 1
  Uniprot ID: P48995
  ENSP ID: ENSP00000273482
MMAALYPSTDLSGASSSSLPSSPSSSSPNEVMALKDVREVKEENTLNEKLFLLACDKGDYYMVKKILEENSSGDLNINCVDVLGRNAVTITIENENLDILQLLLDYGCQKLMERIQNPEYSTTMDVAPVILAAHRNNYEILTMLLKQDVSLPKPHAVGCECTLCSAKNKKDSLRHSRFRLDIYRCLASPALIMLTEEDPILRAFELSADLKELSLVEVEFRNDYEELARQCKMFAKDLLAQARNSRELEVILNHTSSDEPLDKRGLLEERMNLSRLKLAIKYNQKEFVSQSNCQQFLNTVWFGQMSGYRRKPTCKKIMTVLTVGIFWPVLSLCYLIAPKSQFGRIIHTPFMKFIIHGASYFTFLLLLNLYSLVYNEDKKNTMGPALERIDYLLILWIIGMIWSDIKRLWYEGLEDFLEESRNQLSFVMNSLYLATFALKVVAHNKFHDFADRKDWDAFHPTLVAEGLFAFANVLSYLRLFFMYTTSSILGPLQISMGQMLQDFGKFLGMFLLVLFSFTIGLTQLYDKGYTSKEQKDCVGIFCEQQSNDTFHSFIGTCFALFWYIFSLAHVAIFVTRFSYGEELQSFVGAVIVGTYNVVVVIVLTKLLVAMLHKSFQLIANHEDKEWKFARAKLWLSYFDDKCTLPPPFNIIPSPKTICYMISSLSKWICSHTSKGKVKRQNSLKEWRNLKQKRDENYQKVMCCLVHRYLTSMRQKMQSTDQATVENLNELRQDLSKFRNEIRDLLGFRTSKYAMFYPRN

SEQ ID NO: 90280 - protein, 65 aa, Homo sapiens
  Payload ID: 18046
  Gene Name: transient receptor potential cation channel, subfamily C, member 1
  ENSP ID: ENSP00000418708
  MOD_RES (1)..(1): Any amino acid
XAALYPSTDLSGASSSSLPSSPSSSSPNEVMALKDVREVKEENTLNEKLFLLACDKETNGTNSES

SEQ ID NO: 90281 - protein, 793 aa, Homo sapiens
  Payload ID: 18046
  Gene Name: transient receptor potential cation channel, subfamily C, member 1
  Uniprot ID: P48995
  ENSP ID: ENSP00000419313
MMAALYPSTDLSGASSSSLPSSPSSSSPNEVMALKDVREVKEENTLNEKLFLLACDKGDYYMVKKILEENSSGDLNINCVDVLGRNAVTITIENENLDILQLLLDYGCQSADALLVAIDSEVVGAVDILLNHRPKRSSRPTIVKLMERIQNPEYSTTMDVAPVILAAHRNNYEILTMLLKQDVSLPKPHAVGCECTLCSAKNKKDSLRHSRFRLDIYRCLASPALIMLTEEDPILRAFELSADLKELSLVEVEFRNDYEELARQCKMFAKDLLAQARNSRELEVILNHTSSDEPLDKRGLLEERMNLSRLKLAIKYNQKEFVSQSNCQQFLNTVWFGQMSGYRRKPTCKKIMTVLTVGIFWPVLSLCYLIAPKSQFGRIIHTPFMKFIIHGASYFTFLLLLNLYSLVYNEDKKNTMGPALERIDYLLILWIIGMIWSDIKRLWYEGLEDFLEESRNQLSFVMNSLYLATFALKVVAHNKFHDFADRKDWDAFHPTLVAEGLFAFANVLSYLRLFFMYTTSSILGPLQISMGQMLQDFGKFLGMFLLVLFSFTIGLTQLYDKGYTSKEQKDCVGIFCEQQSNDTFHSFIGTCFALFWYIFSLAHVAIFVTRFSYGEELQSFVGAVIVGTYNVVVVIVLTKLLVAMLHKSFQLIANHEDKEWKFARAKLWLSYFDDKCTLPPPFNIIPSPKTICYMISSLSKWICSHTSKGKVKRQNSLKEWRNLKQKRDENYQKVMCCLVHRYLTSMRQKMQSTDQATVENLNELRQDLSKFRNEIRDLLGFRTSKYAMFYPRN

SEQ ID NO: 90282 - protein, 759 aa, Homo sapiens; identical to SEQ ID NO: 90279
  Payload ID: 18046
  Gene Name: transient receptor potential cation channel, subfamily C, member 1
  Uniprot ID: P48995
  ENSP ID: ENSP00000481537

SEQ ID NO: 90283 - protein, 848 aa, Homo sapiens
  Payload ID: 18047
  Gene Name: transient receptor potential cation channel, subfamily C, member 3
  Uniprot ID: Q13507
  ENSP ID: ENSP00000264811
MEGSPSLRRMTVMREKGRRQAVRGPAFMFNDRGTSLTAEEERFLDAAEYGNIPVVRKMLEESKTLNVNCVDYMGQNALQLAVGNEHLEVTELLLKKENLARIGDALLLAISKGYVRIVEAILNHPGFAASKRLTLSPCEQELQDDDFYAYDEDGTRFSPDITPIILAAHCQKYEVVHMLLMKGARIERPHDYFCKCGDCMEKQRHDSFSHSRSRINAYKGLASPAYLSLSSEDPVLTALELSNELAKLANIEKEFKNDYRKLSMQCKDFVVGVLDLCRDSEEVEAILNGDLESAEPLEVHRHKASLSRVKLAIKYEVKKFVAHPNCQQQLLTIWYENLSGLREQTIAIKCLVVLVVALGLPFLAIGYWIAPCSRLGKILRSPFMKFVAHAASFIIFLGLLVFNASDRFEGITTLPNITVTDYPKQIFRVKTTQFTWTEMLIMVWVLGMMWSECKELWLEGPREYILQLWNVLDFGMLSIFIAAFTARFLAFLQATKAQQYVDSYVQESDLSEVTLPPEIQYFTYARDKWLPSDPQIISEGLYAIAVVLSFSRIAYILPANESFGPLQISLGRTVKDIFKFMVLFIMVFFAFMIGMFILYSYYLGAKVNAAFTTVEESFKTLFWSIFGLSEVTSVVLKYDHKFIENIGYVLYGIYNVTMVVVLLNMLIAMINSSYQEIEDDSDVEWKFARSKLWLSYFDDGKTLPPPFSLVPSPKSFVYFIMRIVNFPKCRRRRLQKDIEMGMGNSKSRLNLFTQSNSRVFESHSFNSILNQPTRYQQIMKRLIKRYVLKAQVDKENDEVNEGELKEIKQDISSLRYELLEDKSQATEELAILIHKLSEKLNPSMLRCE

SEQ ID NO: 90284 - protein, 921 aa, Homo sapiens
  Payload ID: 18047
  Gene Name: transient receptor potential cation channel, subfamily C, member 3
  Uniprot ID: Q13507
  ENSP ID: ENSP00000368966
MSTKVRKCKEQARVTFPAPEEEEDEGEDEGAEPQRRRRGWRGVNGGLEPRSAPSQREPHGYCPPPFSHGPDLSMEGSPSLRRMTVMREKGRRQAVRGPAFMFNDRGTSLTAEEERFLDAAEYGNIPVVRKMLEESKTLNVNCVDYMGQNALQLAVGNEHLEVTELLLKKENLARIGDALLLAISKGYVRIVEAILNHPGFAASKRLTLSPCEQELQDDDFYAYDEDGTRFSPDITPIILAAHCQKYEVVHMLLMKGARIERPHDYFCKCGDCMEKQRHDSFSHSRSRINAYKGLASPAYLSLSSEDPVLTALELSNELAKLANIEKEFKNDYRKLSMQCKDFVVGVLDLCRDSEEVEAILNGDLESAEPLEVHRHKASLSRVKLAIKYEVKKFVAHPNCQQQLLTIWYENLSGLREQTIAIKCLVVLVVALGLPFLAIGYWIAPCSRLGKILRSPFMKFVAHAASFIIFLGLLVFNASDRFEGITTLPNITVTDYPKQIFRVKTTQFTWTEMLIMVWVLGMMWSECKELWLEGPREYILQLWNVLDFGMLSIFIAAFTARFLAFLQATKAQQYVDSYVQESDLSEVTLPPEIQYFTYARDKWLPSDPQIISEGLYAIAVVLSFSRIAYILPANESFGPLQISLGRTVKDIFKFMVLFIMVFFAFMIGMFILYSYYLGAKVNAAFTTVEESFKTLFWSIFGLSEVTSVVLKYDHKFIENIGYVLYGIYNVTMVVVLLNMLIAMINSSYQEIEDDSDVEWKFARSKLWLSYFDDGKTLPPPFSLVPSPKSFVYFIMRIVNFPKCRRRRLQKDIEMGMGNSKSRLNLFTQSNSRVFESHSFNSILNQPTRYQQIMKRLIKRYVLKAQVDKENDEVNEGELKEIKQDISSLRYELLEDKSQATEELAILIHKLSEKLNPSMLRCE

SEQ ID NO: 90285 - protein, 93 aa, Homo sapiens
  Payload ID: 18047
  Gene Name: transient receptor potential cation channel, subfamily C, member 3
  ENSP ID: ENSP00000422214
MEGSPSLRRMTVMREKGRRQAVRGPAFMFNDRGTSLTAEEERFLDAAEYGNIPVVRKMLEESKTLNVNCVDYMGQNALQLAVGNEHLEVTELL

SEQ ID NO: 90286 - protein, 276 aa, Homo sapiens
  Payload ID: 18047
  Gene Name: transient receptor potential cation channel, subfamily C, member 3
  ENSP ID: ENSP00000423866
MEGSPSLRRMTVMREKGRRQAVRGPAFMFNDRGTSLTAEEERFLDAAEYGNIPVVRKMLEESKTLNVNCVDYMGQNALQLAVGNEHLEVTELLLKKENLARIGDALLLAISKGYVRIVEAILNHPGFAASKRLTLSPCEQELQDDDFYAYDEDGTRFSPDITPIILAAHCQKYEVVHMLLMKGARIERPHDYFCKCGDCMEKQRHDSFSHSRSRINAYKGLASPAYLSLSSEDPVLTALELSNELAKLANIEKEFKISEQVENSKFRLETVEKHLE

SEQ ID NO: 90287 - protein, 793 aa, Homo sapiens
  Payload ID: 18047
  Gene Name: transient receptor potential cation channel, subfamily C, member 3
  ENSP ID: ENSP00000426899
MEGSPSLRRMTVMREKGRRQAVRGPAFMFNDRGTSLTAEEERFLDAAEYGNIPVVRKMLEESKTLNVNCVDYMGQNALQLAVGNEHLEVTELLLKKENLARIGDALLLAISKGYVRIVEAILNHPGFAASKRLTLSPCEQELQDDDFYAYDEDGTRFSPDITPIILAAHCQKYEVVHMLLMKGARIERPHDYFCKCGDCMEKQRHDSFSHSRSRINAYKGLASPAYLSLSSEDPVLTALELSNELAKLANIEKEFKNDYRKLSMQCKDFVVGVLDLCRDSEEVEAILNGDLESAEPLEVHRHKASLSRVKLAIKYEVKKLGKILRSPFMKFVAHAASFIIFLGLLVFNASDRFEGITTLPNITVTDYPKQIFRVKTTQFTWTEMLIMVWVLGMMWSECKELWLEGPREYILQLWNVLDFGMLSIFIAAFTARFLAFLQATKAQQYVDSYVQESDLSEVTLPPEIQYFTYARDKWLPSDPQIISEGLYAIAVVLSFSRIAYILPANESFGPLQISLGRTVKDIFKFMVLFIMVFFAFMIGMFILYSYYLGAKVNAAFTTVEESFKTLFWSIFGLSEVTSVVLKYDHKFIENIGYVLYGIYNVTMVVVLLNMLIAMINSSYQEIEDDSDVEWKFARSKLWLSYFDDGKTLPPPFSLVPSPKSFVYFIMRIVNFPKCRRRRLQKDIEMGMGNSKSRLNLFTQSNSRVFESHSFNSILNQPTRYQQIMKRLIKRYVLKAQVDKENDEVNEGELKEIKQDISSLRYELLEDKSQATEELAILIHKLSEKLNPSMLRCE

SEQ ID NO: 90288 - protein, 804 aa, Homo sapiens
  Payload ID: 18048
  Gene Name: transient receptor potential cation channel, subfamily C, member 4
  Uniprot ID: Q9UBN4
  ENSP ID: ENSP00000342580
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIADHADIEWKFARTKLWMSYFEEGGTLPTPFNVIPSPKSLWYLIKWIWTHLCKKKMRRKPESFGTIGRRAADNLRRHHQYQEVMRNLVKRYVAAMIRDAKTEEGLTEENFKELKQDISSFRFEVLGLLRGSKLSTIQSANASKESSNSADSDEKSDSEGNSKDKKKNFSLFDLTTLIHPRSAAIASERHNISNGSALVVQEPPREKQRKVNFVTDIKNFGLFHRRSKQNAAEQNANQIFSVSEEVARQQAAGPLERNIQLESRGLASRGDLSIPGLSEQCVLVDHRERNTDTLGLQVGKRVCPFKSEKVVVEDTVPIIPKEKHAKEEDSSIDYDLNLPDTVTHEDYVTTRL

SEQ ID NO: 90289 - protein, 836 aa, Homo sapiens
  Payload ID: 18048
  Gene Name: transient receptor potential cation channel, subfamily C, member 4
  Uniprot ID: Q9UBN4
  ENSP ID: ENSP00000348025
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIADHADIEWKFARTKLWMSYFEEGGTLPTPFNVIPSPKSLWYLIKWIWTHLCKKKMRRKPESFGTIGRRAADNLRRHHQYQEVMRNLVKRYVAAMIRDAKTEEVARQQAAGPLERNIQLESRGLASRGDLSIPGLSEQCVLVDHRERNTDTLGLQVGKRVCPFKSEKVVVEDTVPIIPKEKHAKEEDSSIDYDLNLPDTVTHEDYVTTRL

SEQ ID NO: 90290 - protein, 893 aa, Homo sapiens
  Payload ID: 18048
  Gene Name: transient receptor potential cation channel, subfamily C, member 4
  Uniprot ID: Q9UBN4
  ENSP ID: ENSP00000351264
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIADHADIEWKFARTKLWMSYFEEGGTLPTPFNVIPSPKSLWYLIKWIWTHLCKKKMRRKPESFGTIGRRAADNLRRHHQYQEVMRNLVKRYVAAMIRDAKTEEGLTEENFKELKQDISSFRFEVLGLLRGSKLSTIQSANASKESSNSADSDEKSDSEEEVARQQAAGPLERNIQLESRGLASRGDLSIPGLSEQCVLVDHRERNTDTLGLQVGKRVCPFKSEKVVVEDTVPIIPKEKHAKEEDSSIDYDLNLPDTVTHEDYVTTRL

SEQ ID NO: 90291 - protein, 828 aa, Homo sapiens
  Payload ID: 18048
  Gene Name: transient receptor potential cation channel, subfamily C, member 4
  Uniprot ID: Q9UBN4
  ENSP ID: ENSP00000368995
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIARRAADNLRRHHQYQEVMRNLVKRYVAAMIRDAKTEEGLTEENFKELKQDISSFRFEVLGLLRGSKLSTIQSANASKESSNSADSDEKSDSEEEVARQQAAGPLERNIQLESRGLASRGDLSIPGLSEQCVLVDHRERNTDTLGLQVGKRVCPFKSEKVVVEDTVPIIPKEKHAKEEDSSIDYDLNLPDTVTHEDYVTTRL

SEQ ID NO: 90292 - protein, 804 aa, Homo sapiens; identical to SEQ ID NO: 90288
  Payload ID: 18048
  Gene Name: transient receptor potential cation channel, subfamily C, member 4
  Uniprot ID: Q9UBN4
  ENSP ID: ENSP00000369001

SEQ ID NO: 90293 - protein, 977 aa, Homo sapiens
  Payload ID: 18048
  Gene Name: transient receptor potential cation channel, subfamily C, member 4
  Uniprot ID: Q9UBN4
  ENSP ID: ENSP00000369027
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIADHADIEWKFARTKLWMSYFEEGGTLPTPFNVIPSPKSLWYLIKWIWTHLCKKKMRRKPESFGTIGRRAADNLRRHHQYQEVMRNLVKRYVAAMIRDAKTEEGLTEENFKELKQDISSFRFEVLGLLRGSKLSTIQSANASKESSNSADSDEKSDSEGNSKDKKKNFSLFDLTTLIHPRSAAIASERHNISNGSALVVQEPPREKQRKVNFVTDIKNFGLFHRRSKQNAAEQNANQIFSVSEEVARQQAAGPLERNIQLESRGLASRGDLSIPGLSEQCVLVDHRERNTDTLGLQVGKRVCPFKSEKVVVEDTVPIIPKEKHAKEEDSSIDYDLNLPDTVTHEDYVTTRL

SEQ ID NO: 90294 - protein, 460 aa, Homo sapiens
  Payload ID: 18048
  Gene Name: transient receptor potential cation channel, subfamily C, member 4
  ENSP ID: ENSP00000410133
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKVI

SEQ ID NO: 90295 - protein, 323 aa, Homo sapiens
  Payload ID: 18048
  Gene Name: transient receptor potential cation channel, subfamily C, member 4
  Uniprot ID: Q9UBN4
  ENSP ID: ENSP00000435969
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEASYGEKLNRCGMADFRTTSMIGGI

SEQ ID NO: 90296 - protein, 982 aa, Homo sapiens
  Payload ID: 18048
  Gene Name: transient receptor potential cation channel, subfamily C, member 4
  Uniprot ID: Q9UBN4
  ENSP ID: ENSP00000486109
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIADHADIEWKFARTKLWMSYFEEGGTLPTPFNVIPSPKSLWYLIKWIWTHLCKKKMRRKPESFGTIGVRTQHRRAADNLRRHHQYQEVMRNLVKRYVAAMIRDAKTEEGLTEENFKELKQDISSFRFEVLGLLRGSKLSTIQSANASKESSNSADSDEKSDSEGNSKDKKKNFSLFDLTTLIHPRSAAIASERHNISNGSALVVQEPPREKQRKVNFVTDIKNFGLFHRRSKQNAAEQNANQIFSVSEEVARQQAAGPLERNIQLESRGLASRGDLSIPGLSEQCVLVDHRERNTDTLGLQVGKRVCPFKSEKVVVEDTVPIIPKEKHAKEEDSSIDYDLNLPDTVTHEDYVTTRL

SEQ ID NO: 90297 - protein, 797 aa, Homo sapiens
  Payload ID: 18049
  Gene Name: transient receptor potential cation channel, subfamily C, member 4 associated protein
  Uniprot ID: Q8TEL6
  ENSP ID: ENSP00000252015
MAAAPVAAGSGAGRGRRSAATVAAWGGWGGRPRPGNILLQLRQGQLTGRGLVRAVQFTETFLTERDKQSKWSGIPQLLLKLHTTSHLHSDFVECQNILKEISPLLSMEAMAFVTEERKLTQETTYPNTYIFDLFGGVDLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQASIVFPPPGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENSSCISFSYWKETVSILLNPDRQSPSALVSYIEEPYMDIDRDFTEE

SEQ ID NO: 90298 - protein, 789 aa, Homo sapiens
  Payload ID: 18049
  Gene Name: transient receptor potential cation channel, subfamily C, member 4 associated protein
  Uniprot ID: Q8TEL6
  ENSP ID: ENSP00000400614
MAAAPVAAGSGAGRGRRSAATVAAWGGWGGRPRPGNILLQLRQGQLTGRGLVRAVQFTETFLTERDKQSKWSGIPQLLLKLHTTSHLHSDFVECQNILKEISPLLSMEAMAFVTEERKLTQETTYPNTYIFDLFGGVDLLVEILMRPTISIRGQKLKISDEMSKDCLSILYNTCVCTEGVTKRLAEKNDFVIFLFTLMTSKKTFLQTATLIEDILGVKKEMIRLDEVPNLSSLVSNFDQQQLANFCRILAVTISEMDTGNDDKHTLLAKNAQQKKSLSLGPSAAEINQAALLSIPGFVERLCKLATRKVSESTGTASFLQELEEWYTWLDNALVLDALMRVANEESEHNQGASEENGLPHTSARTQLPQSMKIMHEIMYKLEVLYVLCVLLMGRQRNQVHRMIAEFKLIPGLNNLFDKLIWRKHSASALVLHGHNQNCDCSPDITLKIQFLRLLQSFSDHHENKYLLLNNQELNELSAISLKANIPEVEAVLNTDRSLVCDGKRGLLTRLLQVMKKEPAESSFRFWQARAVESFLRGTTSYADQMFLLKRGLLEHILYCIVDSECKSRDVLQSYFDLLGELMKFNVDAFKRFNKYINTDAKFQVFLKQINSSLVDSNMLVRCVTLSLDRFENQVDMKVAEVLSECRLLAYISQVPTQMSFLFRLINIIHVQTLTQENVSCLNTSLVILMLARRKERLPLYLRLLQRMEHSKKYPGFLLNNFHNLLRFWQQHYLHKDKDSTCLENSSCISFSYWKETVSILLNPDRQSPSALVSYIEEPYMDIDRDFTEE

SEQ ID NO: 90299 - protein, 973 aa, Homo sapiens
  Payload ID: 18050
  Gene Name: transient receptor potential cation channel, subfamily C, member 5
  Uniprot ID: Q9UL62
  ENSP ID: ENSP00000262839
MAQLYYKKVNYSPYRDRIPLQIVRAETELSAEEKAFLNAVEKGDYATVKQALQEAEIYYNVNINCMDPLGRSALLIAIENENLEIMELLLNHSVYVGDALLYAIRKEVVGAVELLLSYRRPSGEKQVPTLMMDTQFSEFTPDITPIMLAAHTNNYEIIKLLVQKRVTIPRPHQIRCNCVECVSSSEVDSLRHSRSRLNIYKALASPSLIALSSEDPILTAFRLGWELKELSKVENEFKAEYEELSQQCKLFAKDLLDQARSSRELEIILNHRDDHSEELDPQKYHDLAKLKVAIKYHQKEFVAQPNCQQLLATLWYDGFPGWRRKHWVVKLLTCMTIGFLFPMLSIAYLISPRSNLGLFIKKPFIKFICHTASYLTFLFMLLLASQHIVRTDLHVQGPPPTVVEWMILPWVLGFIWGEIKEMWDGGFTEYIHDWWNLMDFAMNSLYLATISLKIVAYVKYNGSRPREEWEMWHPTLIAEALFAISNILSSLRLISLFTANSHLGPLQISLGRMLLDILKFLFIYCLVLLAFANGLNQLYFYYETRAIDEPNNCKGIRCEKQNNAFSTLFETLQSLFWSVFGLLNLYVTNVKARHEFTEFVGATMFGTYNVISLVVLLNMLIAMMNNSYQLIADHADIEWKFARTKLWMSYFDEGGTLPPPFNIIPSPKSFLYLGNWFNNTFCPKRDPDGRRRRRNLRSFTERNADSLIQNQHYQEVIRNLVKRYVAAMIRNSKTHEGLTEENFKELKQDISSFRYEVLDLLGNRKHPRSFSTSSTELSQRDDNNDGSGGARAKSKSVSFNLGCKKKTCHGPPLIRTMPRSSGAQGKSKAESSSKRSFMGPSLKKLGLLFSKFNGHMSEPSSEPMYTISDGIVQQHCMWQDIRYSQMEKGKAEACSQSEINLSEVELGEVQGAAQSSECPLACSSSLHCASSICSSNSKLLDSSEDVFETWGEACDLLMHKWGDGQEEQVTTRL

SEQ ID NO: 90300 - protein, 931 aa, Homo sapiens
  Payload ID: 18051
  Gene Name: transient receptor potential cation channel, subfamily C, member 6
  Uniprot ID: Q9Y210
  ENSP ID: ENSP00000340913
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKNDYKKLSMQCKDFVVGLLDLCRNTEEVEAILNGDVETLQSGDHGRPNLSRLKLAIKYEVKKFVAHPNCQQQLLSIWYENLSGLRQQTMAVKFLVVLAVAIGLPFLALIYWFAPCSKMGKIMRGPFMKFVAHAASFTIFLGLLVMNAADRFEGTKLLPNETSTDNAKQLFRMKTSCFSWMEMLIISWVIGMIWAECKEIWTQGPKEYLFELWNMLDFGMLAIFAASFIARFMAFWHASKAQSIIDANDTLKDLTKVTLGDNVKYYNLARIKWDPSDPQIISEGLYAIAVVLSFSRIAYILPANESFGPLQISLGRTVKDIFKFMVIFIMVFVAFMIGMFNLYSYYIGAKQNEAFTTVEESFKTLFWAIFGLSEVKSVVINYNHKFIENIGYVLYGVYNVTMVIVLLNMLIAMINSSFQEIEDDADVEWKFARAKLWFSYFEEGRTLPVPFNLVPSPKSLFYLLLKLKKWISELFQGHKKGFQEDAEMNKINEEKKLGILGSHEDLSKLSLDKKQVGHNKQPSIRSSEDFHLNSFNNPPRQYQKIMKRLIKRYVLQAQIDKESDEVNEGELKEIKQDISSLRYELLEEKSQNTEDLAELIRELGEKLSMEPNQEETNR

SEQ ID NO: 90301 - protein, 815 aa, Homo sapiens
  Payload ID: 18051
  Gene Name: transient receptor potential cation channel, subfamily C, member 6
  Uniprot ID: Q9Y210
  ENSP ID: ENSP00000343672
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKMGKIMRGPFMKFVAHAASFTIFLGLLVMNAADRFEGTKLLPNETSTDNAKQLFRMKTSCFSWMEMLIISWVIGMIWAECKEIWTQGPKEYLFELWNMLDFGMLAIFAASFIARFMAFWHASKAQSIIDANDTLKDLTKVTLGDNVKYYNLARIKWDPSDPQIISEGLYAIAVVLSFSRIAYILPANESFGPLQISLGRTVKDIFKFMVIFIMVFVAFMIGMFNLYSYYIGAKQNEAFTTVEESFKTLFWAIFGLSEVKSVVINYNHKFIENIGYVLYGVYNVTMVIVLLNMLIAMINSSFQEIEDDADVEWKFARAKLWFSYFEEGRTLPVPFNLVPSPKSLFYLLLKLKKWISELFQGHKKGFQEDAEMNKINEEKKLGILGSHEDLSKLSLDKKQVGHNKQPSIRSSEDFHLNSFNNPPRQYQKIMKRLIKRYVLQAQIDKESDEVNEGELKEIKQDISSLRYELLEEKSQNTEDLAELIRELGEKLSMEPNQEETNR

SEQ ID NO: 90302 - protein, 876 aa, Homo sapiens
  Payload ID: 18051
  Gene Name: transient receptor potential cation channel, subfamily C, member 6
  Uniprot ID: Q9Y210
  ENSP ID: ENSP00000353687
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKNDYKKLSMQCKDFVVGLLDLCRNTEEVEAILNGDVETLQSGDHGRPNLSRLKLAIKYEVKKMGKIMRGPFMKFVAHAASFTIFLGLLVMNAADRFEGTKLLPNETSTDNAKQLFRMKTSCFSWMEMLIISWVIGMIWAECKEIWTQGPKEYLFELWNMLDFGMLAIFAASFIARFMAFWHASKAQSIIDANDTLKDLTKVTLGDNVKYYNLARIKWDPSDPQIISEGLYAIAVVLSFSRIAYILPANESFGPLQISLGRTVKDIFKFMVIFIMVFVAFMIGMFNLYSYYIGAKQNEAFTTVEESFKTLFWAIFGLSEVKSVVINYNHKFIENIGYVLYGVYNVTMVIVLLNMLIAMINSSFQEIEDDADVEWKFARAKLWFSYFEEGRTLPVPFNLVPSPKSLFYLLLKLKKWISELFQGHKKGFQEDAEMNKINEEKKLGILGSHEDLSKLSLDKKQVGHNKQPSIRSSEDFHLNSFNNPPRQYQKIMKRLIKRYVLQAQIDKESDEVNEGELKEIKQDISSLRYELLEEKSQNTEDLAELIRELGEKLSMEPNQEETNR

SEQ ID NO: 90303 - protein, 853 aa, Homo sapiens
  Payload ID: 18051
  Gene Name: transient receptor potential cation channel, subfamily C, member 6
  ENSP ID: ENSP00000435574
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKNDYKKLSMQCKDFVVGLLDLCRNTEEVEAILNGDVETLQSGDHGRPNLSRLKLAIKYEVKKFVAHPNCQQQLLSIWYENLSGLRQQTMAVKFLVVLAVAIGLPFLALIYWFAPCSKMGKIMRGPFMKFVAHAASFTIFLGLLVMNAADRFEGTKLLPNETSTDNAKQLFRMKTSCFSWMEMLIISWVIARIKWDPSDPQIISEGLYAIAVVLSFSRIAYILPANESFGPLQISLGRTVKDIFKFMVIFIMVFVAFMIGMFNLYSYYIGAKQNEAFTTVEESFKTLFWAIFGLSEVKSVVINYNHKFIENIGYVLYGVYNVTMVIVLLNMLIAMINSSFQEIEDDADVEWKFARAKLWFSYFEEGRTLPVPFNLVPSPKSLFYLLLKLKKWISELFQGHKKGFQEDAEMNKINEEKKLGILGSHEDLSKLSLDKKQVGHNKQPSIRSSEDFHLNSFNNPPRQYQKIMKRLIKRYVLQAQIDKESDEVNEGELKEIKQDISSLRYELLEEKSQNTEDLAELIRELGEKLSMEPNQEETNR

SEQ ID NO: 90304 - protein, 746 aa, Homo sapiens
  Payload ID: 18052
  Gene Name: transient receptor potential cation channel, subfamily C, member 7
  Uniprot ID: Q9HCX4
  ENSP ID: ENSP00000330322
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKLGRTLRSPFMKFVAHAVSFTIFLGLLVVNASDRFEGVKTLPNETFTDYPKQIFRVKTTQFSWTEMLIMKWVLGMIWSECKEIWEEGPREYVLHLWNLLDFGMLSIFVASFTARFMAFLKATEAQLYVDQHVQDDTLHNVSLPPEVAYFTYARDKWWPSDPQIISEGLYAIAVVLSFSRIAYILPANESFGPLQISLGRTVKDIFKFMVIFIMVFVAFMIGMFNLYSYYRGAKYNPAFTTVEESFKTLFWSIFGLSEVISVVLKYDHKFIENIGYVLYGVYNVTMVVVLLNMLIAMINNSYQEIEEDADVEWKFARAKLWLSYFDEGRTLPAPFNLVPSPKSFYYLIMRIKMCLIKLCKSKAKSCENDLEMGMLNSKFKKTRYQAGMRNSENLTANNTLSKPTRYQKIMKRLIKRYVLKAQVDRENDEVNEGELKEIKQDISSLRYELLEEKSQATGELADLIQQLSEKFGKNLNKDHLRVNKGKDI

SEQ ID NO: 90305 - protein, 801 aa, Homo sapiens
  Payload ID: 18052
  Gene Name: transient receptor potential cation channel, subfamily C, member 7
  Uniprot ID: Q9HCX4
  ENSP ID: ENSP00000367720
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKFVAHPNCQQQLLTMWYENLSGLRQQSIAVKFLAVFGVSIGLPFLAIAYWIAPCSKLGRTLRSPFMKFVAHAVSFTIFLGLLVVNASDRFEGVKTLPNETFTDYPKQIFRVKTTQFSWTEMLIMKWVLGMIWSECKEIWEEGPREYVLHLWNLLDFGMLSIFVASFTARFMAFLKATEAQLYVDQHVQDDTLHNVSLPPEVAYFTYARDKWWPSDPQIISEGLYAIAVVLSFSRIAYILPANESFGPLQISLGRTVKDIFKFMVIFIMVFVAFMIGMFNLYSYYRGAKYNPAFTTVEESFKTLFWSIFGLSEVISVVLKYDHKFIENIGYVLYGVYNVTMVVVLLNMLIAMINNSYQEIEEDADVEWKFARAKLWLSYFDEGRTLPAPFNLVPSPKSFYYLIMRIKMCLIKLCKSKAKSCENDLEMGMLNSKFKKTRYQAGMRNSENLTANNTLSKPTRYQKIMKRLIKRYVLKAQVDRENDEVNEGELKEIKQDISSLRYELLEEKSQATGELADLIQQLSEKFGKNLNKDHLRVNKGKDI

SEQ ID NO: 90306 - protein, 380 aa, Homo sapiens
  Payload ID: 18052
  Gene Name: transient receptor potential cation channel, subfamily C, member 7
  ENSP ID: ENSP00000421571
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKNDYRKLSMQCKDFVVGVLDLCRDTEEVEAILNGDVNFQVWSDHHRPSLSRIKLAIKYEVKKFVAHPNCQQQLLTMWYENLSGLRQQSIAVKFLAVFGVSIGLPFLAIAYWIAPCSKVQTA

SEQ ID NO: 90307 - protein, 807 aa, Homo sapiens
  Payload ID: 18052
  Gene Name: transient receptor potential cation channel, subfamily C, member 7
  ENSP ID: ENSP00000424854
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKNDYRKLSMQCKDFVVGVLDLCRDTEEVEAILNGDVNFQVWSDHHRPSLSRIKLAIKYEVKKLGRTLRSPFMKFVAHAVSFTIFLGLLVVNASDRFEGVKTLPNETFTDYPKQIFRVKTTQFSWTEMLIMKWVLGMIWSECKEIWEEGPREYVLHLWNLLDFGMLSIFVASFTARFMAFLKATEAQLYVDQHVQDDTLHNVSLPPEVAYFTYARDKWWPSDPQIISEGLYAIAVVLSFSRIAYILPANESFGPLQISLGRTVKDIFKFMVIFIMVFVAFMIGMFNLYSYYRGAKYNPAFTTVEESFKTLFWSIFGLSEVISVVLKYDHKFIENIGYVLYGVYNVTMVVVLLNMLIAMINNSYQEIEEDADVEWKFARAKLWLSYFDEGRTLPAPFNLVPSPKSFYYLIMRIKMCLIKLCKSKAKSCENDLEMGMLNSKFKKTRYQAGMRNSENLTANNTLSKPTRYQKIMKRLIKRYVLKAQVDRENDEVNEGELKEIKQDISSLRYELLEEKSQATGELADLIQQLSEKFGKNLNKDHLRVNKGKDI

SEQ ID NO: 90308 - protein, 862 aa, Homo sapiens
  Payload ID: 18052
  Gene Name: transient receptor potential cation channel, subfamily C, member 7
  Uniprot ID: Q9HCX4
  ENSP ID: ENSP00000426070
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKNDYRKLSMQCKDFVVGVLDLCRDTEEVEAILNGDVNFQVWSDHHRPSLSRIKLAIKYEVKKFVAHPNCQQQLLTMWYENLSGLRQQSIAVKFLAVFGVSIGLPFLAIAYWIAPCSKLGRTLRSPFMKFVAHAVSFTIFLGLLVVNASDRFEGVKTLPNETFTDYPKQIFRVKTTQFSWTEMLIMKWVLGMIWSECKEIWEEGPREYVLHLWNLLDFGMLSIFVASFTARFMAFLKATEAQLYVDQHVQDDTLHNVSLPPEVAYFTYARDKWWPSDPQIISEGLYAIAVVLSFSRIAYILPANESFGPLQISLGRTVKDIFKFMVIFIMVFVAFMIGMFNLYSYYRGAKYNPAFTTVEESFKTLFWSIFGLSEVISVVLKYDHKFIENIGYVLYGVYNVTMVVVLLNMLIAMINNSYQEIEEDADVEWKFARAKLWLSYFDEGRTLPAPFNLVPSPKSFYYLIMRIKMCLIKLCKSKAKSCENDLEMGMLNSKFKKTRYQAGMRNSENLTANNTLSKPTRYQKIMKRLIKRYVLKAQVDRENDEVNEGELKEIKQDISSLRYELLEEKSQATGELADLIQQLSEKFGKNLNKDHLRVNKGKDI

SEQ ID NO: 90309 - protein, 261 aa, Homo sapiens
  Payload ID: 18052
  Gene Name: transient receptor potential cation channel, subfamily C, member 7
  ENSP ID: ENSP00000426870
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKE

SEQ ID NO: 90310 - protein, 1625 aa, Homo sapiens
  Payload ID: 18053
  Gene Name: transient receptor potential cation channel, subfamily M, member 1
  Uniprot ID: Q7Z4N2
  ENSP ID: ENSP00000256552
MGQKSWIEKTFCKRECIFVIPSMKDSNRCCCGQFTNQHIPPLPSATPSKNEEESKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 90311 - protein, 1603 aa, Homo sapiens
  Payload ID: 18053
  Gene Name: transient receptor potential cation channel, subfamily M, member 1
  Uniprot ID: Q7Z4N2
  ENSP ID: ENSP00000380897
MKDSNRCCCGQFTNQHIPPLPSATPSKNEEESKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 90312 - protein, 1642 aa, Homo sapiens
  Payload ID: 18053
  Gene Name: transient receptor potential cation channel, subfamily M, member 1
  Uniprot ID: Q7Z4N2
  ENSP ID: ENSP00000437849
MSSFKRGSLKSSTSGSQKGQKSWIEKTFCKRECIFVIPSMKDSNRCCCGQFTNQHIPPLPSATPSKNEEESKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 90313 - protein, 1390 aa, Homo sapiens
  Payload ID: 18053
  Gene Name: transient receptor potential cation channel, subfamily M, member 1
  ENSP ID: ENSP00000452946
MKDSNRCCCGQFTNQHIPPLPSATPSKNEEESKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQ

SEQ ID NO: 90314 - protein, 1526 aa, Homo sapiens
  Payload ID: 18053
  Gene Name: transient receptor potential cation channel, subfamily M, member 1
  ENSP ID: ENSP00000453119
YIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 90315 - protein, 505 aa, Homo sapiens
  Payload ID: 18053
  Gene Name: transient receptor potential cation channel, subfamily M, member 1
  ENSP ID: ENSP00000453477
MKDSNRCCCGQFTNQHIPPLPSATPSKNEEESKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTAPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQ

SEQ ID NO: 90316 - protein, 229 aa, Homo sapiens
  Payload ID: 18053
  Gene Name: transient receptor potential cation channel, subfamily M, member 1
  ENSP ID: ENSP00000453644
YIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGG

SEQ ID NO: 90317 - protein, 136 aa, Homo sapiens
  Payload ID: 18053
  Gene Name: transient receptor potential cation channel, subfamily M, member 1
  Uniprot ID: Q7Z4N2
  ENSP ID: ENSP00000453851
MKDSNRCCCGQFTNQHIPPLPSATPSKNEEESKQVETQPEKWSVAKHTQSYPTDSYGVLEFQGGGYSNKAMVRKAFRHGATRITAFIGGQSPSPKLQIPGLLHGCGSIFLDISLKNQEIYLCTWLLAMRLGNWTPL

SEQ ID NO: 90318 - protein, 300 aa, Homo sapiens
  Payload ID: 18053
  Gene Name: transient receptor potential cation channel, subfamily M, member 1
  Uniprot ID: Q7Z4N2
  ENSP ID: ENSP00000454077
MKDSNRCCCGQFTNQHIPPLPSATPSKNEEESKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGG

SEQ ID NO: 90319 - protein, 1603 aa, Homo sapiens
  Payload ID: 18053
  Gene Name: transient receptor potential cation channel, subfamily M, member 1
  ENSP ID: ENSP00000479390
TKDSNRCCCGQFTNQHIPPLPSATPSKNEEENKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 90320 - protein, 1625 aa, Homo sapiens
  Payload ID: 18053
  Gene Name: transient receptor potential cation channel, subfamily M, member 1
  ENSP ID: ENSP00000479819
MGQKSWIEKTFCKRECIFVIPSTKDSNRCCCGQFTNQHIPPLPSATPSKNEEENKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 90321 - protein, 1642 aa, Homo sapiens
  Payload ID: 18053
  Gene Name: transient receptor potential cation channel, subfamily M, member 1
  ENSP ID: ENSP00000480586
MSSFKRGSLKSSTSGSQKGQKSWIEKTFCKRECIFVIPSTKDSNRCCCGQFTNQHIPPLPSATPSKNEEENKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 90322 - protein, 229 aa, Homo sapiens; identical to SEQ ID NO: 90316
  Payload ID: 18053
  Gene Name: transient receptor potential cation channel, subfamily M, member 1
  ENSP ID: ENSP00000483610

SEQ ID NO: 90323 - protein, 1603 aa, Homo sapiens
  Payload ID: 18053
  Gene Name: transient receptor potential cation channel, subfamily M, member 1
  ENSP ID: ENSP00000483998
IKTSKRCCCGQFTNQHIPPLPSATPSKNEEENKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 90324 - protein, 1449 aa, Homo sapiens
  Payload ID: 18054
  Gene Name: transient receptor potential cation channel, subfamily M, member 2
  Uniprot ID: O94759
  ENSP ID: ENSP00000300481
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTAQALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGENPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 90325 - protein, 1503 aa, Homo sapiens
  Payload ID: 18054
  Gene Name: transient receptor potential cation channel, subfamily M, member 2
  Uniprot ID: O94759
  ENSP ID: ENSP00000300482
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQKVLVEDPERPACAPAAPRLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTAQALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGDTLEPLSTIQYNVVDGLRDRRSFHGPYTVQAGLPLNPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 90326 - protein, 1503 aa, Homo sapiens; identical to SEQ ID NO: 90325
  Payload ID: 18054
  Gene Name: transient receptor potential cation channel, subfamily M, member 2
  Uniprot ID: O94759
  ENSP ID: ENSP00000381023

SEQ ID NO: 90327 - protein, 1553 aa, Homo sapiens
  Payload ID: 18054
  Gene Name: transient receptor potential cation channel, subfamily M, member 2
  ENSP ID: ENSP00000381026
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQKVLVEDPERPACAPAAPRLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKAGLELWGSRTSSVCKSRQFLHLTVVESRGSEKAPVTTLACLQGCLGKHGRVDAMVDLLDLDPLKRSGSMEQRLASLEEQVAQTAQALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGDTLEPLSTIQYNVVDGLRDRRSFHGPYTVQAGLPLNPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 90328 - protein, 143 aa, Homo sapiens
  Payload ID: 18054
  Gene Name: transient receptor potential cation channel, subfamily M, member 2
  ENSP ID: ENSP00000393982
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYV

SEQ ID NO: 90329 - protein, 247 aa, Homo sapiens [sequence omitted]

SEQ ID NO: 90330 - protein, 1711 aa, Homo sapiens
  Payload ID: 18055
  Gene Name: transient receptor potential cation channel, subfamily M, member 3
  ENSP ID: ENSP00000350140
MGKKWRDAAEMERGCSDREDNAESRRRSRSASRGRFAESWKRLSSKQGSTKRSGLPSQQTPAQKSWIERAFYKRECVHIIPSTKDPHRCCCGRLIGQHVGLTPSISVLQNEKNESRLSRNDIQSEKWSISKHTQLSPTDAFGTIEFQGGGHSNKAMYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKREYPGFGWIYFKGNLPPDYRISLIDIGLVIEYLMGGAYRCNYTRKRFRTLYHNLFGPKRDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 90331 - protein, 1569 aa, Homo sapiens
  Payload ID: 18055
  Gene Name: transient receptor potential cation channel, subfamily M, member 3
  ENSP ID: ENSP00000350791
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRCLPFFSLDSRLFYSFWGSCQLDSVGIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKGNLPPDYRISLIDIGLVIEYLMGGAYRCNYTRKRFRTLYHNLFGPKRDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 90332 - protein, 1569 aa, Homo sapiens; identical to SEQ ID NO: 90331
  Payload ID: 18055
  Gene Name: transient receptor potential cation channel, subfamily M, member 3
  ENSP ID: ENSP00000354066

SEQ ID NO: 90333 - protein, 230 aa, Homo sapiens
  Payload ID: 18055
  Gene Name: transient receptor potential cation channel, subfamily M, member 3
  Uniprot ID: Q9HCF6
  ENSP ID: ENSP00000355395
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGG

SEQ ID NO: 90334 - protein, 123 aa, Homo sapiens
  Payload ID: 18055
  Gene Name: transient receptor potential cation channel, subfamily M, member 3
  ENSP ID: ENSP00000366301
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVSPECCRFP

SEQ ID NO: 90335 - protein, 323 aa, Homo sapiens
  Payload ID: 18055
  Gene Name: transient receptor potential cation channel, subfamily M, member 3
  ENSP ID: ENSP00000366305
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELVGNSAWVASCLHIFSHFLESHNIFSNHATFSLSGRAYSSPQAPLAPVASSPK

SEQ ID NO: 90336 - protein, 1566 aa, Homo sapiens
  Payload ID: 18055
  Gene Name: transient receptor potential cation channel, subfamily M, member 3
  ENSP ID: ENSP00000366309
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKREYPGFGWIYFKGNLPPDYRISLIDIGLVIEYLMGGAYRCNYTRKRFRTLYHNLFGPKRPKALKLLGMEDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 90337 - protein, 1707 aa, Homo sapiens
  Payload ID: 18055
  Gene Name: transient receptor potential cation channel, subfamily M, member 3
  Uniprot ID: Q9HCF6
  ENSP ID: ENSP00000366314
MPEPWGTVYFLGIAQVFSFLFSWWNLEGVMNQADAPRPLNWTIRKLCHAAFLPSVRLLKAQKSWIERAFYKRECVHIIPSTKDPHRCCCGRLIGQHVGLTPSISVLQNEKNESRLSRNDIQSEKWSISKHTQLSPTDAFGTIEFQGGGHSNKAMYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKGNLPPDYRISLIDIGLVIEYLMGGAYRCNYTRKRFRTLYHNLFGPKRPKALKLLGMEDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 90338 - protein, 1325 aa, Homo sapiens
  Payload ID: 18055
  Gene Name: transient receptor potential cation channel, subfamily M, member 3
  Uniprot ID: Q9HCF6
  ENSP ID: ENSP00000366315
MPEPWGTVYFLGIAQVFSFLFSWWNLEGVMNQADAPRPLNWTIRKLCHAAFLPSVRLLKAQKSWIERAFYKRECVHIIPSTKDPHRCCCGRLIGQHVGLTPSISVLQNEKNESRLSRNDIQSEKWSISKHTQLSPTDAFGTIEFQGGGHSNKAMYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKGNLPPDYRISLIDIGLVIEYLMGGAYRCNYTRKRFRTLYHNLFGPKRPKALKLLGMEDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAEHPLYSV

SEQ ID NO: 90339 - protein, 1556 aa, Homo sapiens
  Payload ID: 18055
  Gene Name: transient receptor potential cation channel, subfamily M, member 3
  ENSP ID: ENSP00000379576
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKREYPGFGWIYFKGNLPPDYRISLIDIGLVIEYLMGGAYRCNYTRKRFRTLYHNLFGPKRDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 90340 - protein, 275 aa, Homo sapiens
  Payload ID: 18055
  Gene Name: transient receptor potential cation channel, subfamily M, member 3
  ENSP ID: ENSP00000379579
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRCLPFFSLDSRLFYSFWGSCQLDSVGIGQGVPVVALIVEGGPNVISIVLEYLRDTPPVPVVVCDGSGRASDILAFGHKYSEEGGSKYITNLKRERKKEEESKGI

SEQ ID NO: 90341 - protein, 1566 aa, Homo sapiens
  Payload ID: 18055
  Gene Name: transient receptor potential cation channel, subfamily M, member 3
  ENSP ID: ENSP00000379581
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKGNLPPDYRISLIDIGLVIEYLMGGAYRCNYTRKRFRTLYHNLFGPKRPKALKLLGMEDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDRKQVYDSHTPKSAPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 90342 - protein, 1579 aa, Homo sapiens
  Payload ID: 18055
  Gene Name: transient receptor potential cation channel, subfamily M, member 3
  ENSP ID: ENSP00000379587
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRCLPFFSLDSRLFYSFWGSCQLDSVGIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKGNLPPDYRISLIDIGLVIEYLMGGAYRCNYTRKRFRTLYHNLFGPKRPKALKLLGMEDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 90343 - protein, 1566 aa, Homo sapiens; identical to SEQ ID NO: 90336
  Payload ID: 18055
  Gene Name: transient receptor potential cation channel, subfamily M, member 3
  ENSP ID: ENSP00000386127

SEQ ID NO: 90344 - protein, 1214 aa, Homo sapiens
  Payload ID: 18056
  Gene Name: transient receptor potential cation channel, subfamily M, member 4
  Uniprot ID: Q8TD43
  ENSP ID: ENSP00000252826
MVVPEKEQSWIPKIFKKKTCTTFIVDSTDPGGTLCQCGRPRTAHPAVAMEDAFGAAVVTVWDSDAHTTEKPTDAYGELDFTGAGRKHSNFLRLSDRTDPAAVYSLVTRTWGFRAPNLVVSVLGGSGGPVLQTWLQDLLRRGLVRAAQSTGAWIVTGGLHTGIGRHVGVAVRDHQMASTGGTKVVAMGVAPWGVVRNRDTLINPKGSFPARYRWRGDPEDGVQFPLDYNYSAFFLVDDGTHGCLGGENRFRLRLESYISQQKTGVGGTGIDIPVLLLLIDGDEKMLTRIENATQAQLPCLLVAGSGGAADCLAETLEDTLAPGSGGARQGEARDRIRRFFPKGDLEVLQAQVERIMTRKELLTVYSSEDGSEEFETIVLKALVKACGSSEASAYLDELRLAVAWNRVDIAQSELFRGDIQWRSFHLEASLMDALLNDRPEFVRLLISHGLSLGHFLTPMRLAQLYSAAPSNSLIRNLLDQASHSAGTKAPALKGGAAELRPPDVGHVLRMLLGKMCAPRYPSGGAWDPHPGQGFGESMYLLSDKATSPLSLDAGLGQAPWSDLLLWALLLNRAQMAMYFWEMGSNAVSSALGACLLLRVMARLEPDAEEAARRKDLAFKFEGMGVDLFGECYRSSEVRAARLLLRRCPLWGDATCLQLAMQADARAFFAQDGVQSLLTQKWWGDMASTTPIWALVLAFFCPPLIYTRLITFRKSEEEPTREELEFDMDSVINGEGPVGTADPAEKTPLGVPRQSGRPGCCGGRCGGRRCLRRWFHFWGAPVTIFMGNVVSYLLFLLLFSRVLLVDFQPAPPGSLELLLYFWAFTLLCEELRQGLSGGGGSLASGGPGPGHASLSQRLRLYLADSWNQCDLVALTCFLLGVGCRLTPGLYHLGRTVLCIDFMVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 90345 - protein, 1069 aa, Homo sapiens
  Payload ID: 18056
  Gene Name: transient receptor potential cation channel, subfamily M, member 4
  Uniprot ID: Q8TD43
  ENSP ID: ENSP00000407492
MVVPEKEQSWIPKIFKKKTCTTFIVDSTDPGGTLCQCGRPRTAHPAVAMEDAFGAAVVTVWDSDAHTTEKPTDAYGELDFTGAGRKHSNFLRLSDRTDPAAVYSLVTRTWGFRAPNLVVSVLGGSGGPVLQTWLQDLLRRGLVRAAQSTGAWIVTGGLHTGIGRHVGVAVRDHQMASTGGTKVVAMGVAPWGVVRNRDTLINPKGSFPARYRWRGDPEDGVQFPLDYNYSAFFLVDDGTHGCLGGENRFRLRLESYISQQKTGVGGTGIDIPVLLLLIDGDEKMLTRIENATQAQLPCLLVAGSGGAADCLAETLEDTLAPGSGGARQGEARDRIRRFFPKGDLEVLQAQVERIMTRKELLTVYSSEDGSEEFETIVLKALVKACGSSEASAYLDELRLAVAWNRVDIAQSELFRGDIQWRSFHLEASLMDALLNDRPEFVRLLISHGLSLGHFLTPMRLAQLYSAAPSNSLIRNLLDQASHSAGTKAPALKGGAAELRPPDVGHVLRMLLGKMCAPRYPSGGAWDPHPGQGFGESMYLLSDKATSPLSLDAGLGQAPWSDLLLWALLLNRAQMAMYFWEMGSNAVSSALGACLLLRVMARLEPDAEEAARRKDLAFKFEGMGVDLFGECYRSSEVRAARLLLRRCPLWGDATCLQLAMQADARAFFAQDGVQSLLTQKWWGDMASTTPIWALVLAFFCPPLIYTRLITFRKSEEEPTREELEFDMDSVINGEGPVGLTPGLYHLGRTVLCIDFMVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 90346 - protein, 103 aa, Homo sapiens
  Payload ID: 18056
  Gene Name: transient receptor potential cation channel, subfamily M, member 4
  ENSP ID: ENSP00000468989
MVVPEKEQSWIPKIFKKKTCTTFIVDSTDPGARSLRGTGGAVTRRTGSSFPWTTTTRPSSWWTTAHTAAWGARTASACAWSPTSHSRRRAWEGLELTSLSCSS

SEQ ID NO: 90347 - protein, 77 aa, Homo sapiens
  Payload ID: 18056
  Gene Name: transient receptor potential cation channel, subfamily M, member 4
  ENSP ID: ENSP00000469893
MVVPEKEQSWIPKIFKKKTCTTFIVDSTDPGSLDCHWGSAHGHRPACWCGCTGPSDGQHWGHQGGGHGCGPLGCGPE

SEQ ID NO: 90348 - protein, 216 aa, Homo sapiens
  Payload ID: 18056
  Gene Name: transient receptor potential cation channel, subfamily M, member 4
  ENSP ID: ENSP00000470229
MVVPEKEQSWIPKIFKKKTCTTFIVDSTDPGGTLCQCGRPRTAHPAVAMEDAFGAAVVTVWDSDAHTTEKPTDAYGELDFTGAGRKHSNEPGLSLGVCTRASAGMLVWLYGTIRWPALGAPRWWPWVWPPGVWSGIETPSSTPRARSLRGTGGAVTRRTGSSFPWTTTTRPSSWWTTAHTAAWGARTASACAWSPTSHSRRRAWEGLELTSLSCSS

SEQ ID NO: 90349 - protein, 51 aa, Homo sapiens
  Payload ID: 18056
  Gene Name: transient receptor potential cation channel, subfamily M, member 4
  ENSP ID: ENSP00000471236
  MOD_RES (1)..(1): Any amino acid
XRKLLTWESVHKENFLLARARDKRESDSERLKRTSQKSSSVAASWGGWPRP

SEQ ID NO: 90350 - protein, 156 aa, Homo sapiens
  Payload ID: 18056
  Gene Name: transient receptor potential cation channel, subfamily M, member 4
  ENSP ID: ENSP00000473231
MVVPEKEQSWIPKIFKKKTCTTFIVDSTDPGGTLCQCGRPRTAHPAVAMEDAFGAAVVTVWDSDAHTTEKPTDAYGELDFTGAGRKHSNGSFPARYRWRGDPEDGVQFPLDYNYSAFFLVDDGTHGCLGGENRFRLRLESYISQQKTGVGGTGIDI

SEQ ID NO: 90351 - protein, 31 aa, Homo sapiens
  Payload ID: 18056
  Gene Name: transient receptor potential cation channel, subfamily M, member 4
  ENSP ID: ENSP00000483753
MVVPEKEQSWIPKIFKKKTCTTFIVDSTDPG

SEQ ID NO: 90352 - protein, 1165 aa, Homo sapiens
  Payload ID: 18057
  Gene Name: transient receptor potential cation channel, subfamily M, member 5
  Uniprot ID: Q9NZQ8
  ENSP ID: ENSP00000155858
MQDVQGPRPGSPGDAEDRRELGLHRGEVNFGGSGKKRGKFVRVPSGVAPSVLFDLLLAEWHLPAPNLVVSLVGEEQPFAMKSWLRDVLRKGLVKAAQSTGAWILTSALRVGLARHVGQAVRDHSLASTSTKVRVVAVGMASLGRVLHRRILEEAQEDFPVHYPEDDGGSQGPLCSLDSNLSHFILVEPGPPGKGDGLTELRLRLEKHISEQRAGYGGTGSIEIPVLCLLVNGDPNTLERISRAVEQAAPWLILVGSGGIADVLAALVNQPHLLVPKVAEKQFKEKFPSKHFSWEDIVRWTKLLQNITSHQHLLTVYDFEQEGSEELDTVILKALVKACKSHSQEPQDYLDELKLAVAWDRVDIAKSEIFNGDVEWKSCDLEEVMVDALVSNKPEFVRLFVDNGADVADFLTYGRLQELYRSVSRKSLLFDLLQRKQEEARLTLAGLGTQQAREPPAGPPAFSLHEVSRVLKDFLQDACRGFYQDGRPGDRRRAEKGPAKRPTGQKWLLDLNQKSENPWRDLFLWAVLQNRHEMATYFWAMGQEGVAAALAACKILKEMSHLETEAEAARATREAKYERLALDLFSECYSNSEARAFALLVRRNRCWSKTTCLHLATEADAKAFFAHDGVQAFLTRIWWGDMAAGTPILRLLGAFLCPALVYTNLITFSEEAPLRTGLEDLQDLDSLDTEKSPLYGLQSRVEELVEAPRAQGDRGPRAVFLLTRWRKFWGAPVTVFLGNVVMYFAFLFLFTYVLLVDFRPPPQGPSGPEVTLYFWVFTLVLEEIRQGFFTDEDTHLVKKFTLYVGDNWNKCDMVAIFLFIVGVTCRMLPSAFEAGRTVLAMDFMVFTLRLIHIFAIHKQLGPKIIVVERMMKDVFFFLFFLSVWLVAYGVTTQALLHPHDGRLEWIFRRVLYRPYLQIFGQIPLDEIDEARVNCSTHPLLLEDSPSCPSLYANWLVILLLVTFLLVTNVLLMNLLIAMFSYTFQVVQGNADMFWKFQRYNLIVEYHERPALAPPFILLSHLSLTLRRVFKKEAEHKREHLERDLPDPLDQKVVTWETVQKENFLSKMEKRRRDSEGEVLRKTAHRVDFIAKYLGGLREQEKRIKCLESQINYCSVLVSSVADVLAQGGGPRSSQHCGEGSQLVAADHRGGLDGWEQPGAGQPPSDT

SEQ ID NO: 90353 - protein, 1173 aa, Homo sapiens
  Payload ID: 18057
  Gene Name: transient receptor potential cation channel, subfamily M, member 5
  ENSP ID: ENSP00000434121
MQDVQGPRPGSPGDAEDRRELGLHRGEVNFGGSGKKRGKFVRVPSGVAPSVLFDLLLAEWHLPAPNLVVSLVGEEQPFAMKSWLRDVLRKGLVKAAQSTGAWILTSALRVGLARHVGQAVRDHSLASTSTKVRVVAVGMASLGRVLHRRILEEAQEDFPVHYPEDDGGSQGPLCSLDSNLSHFILVEPGPPGKGDGLTELRLRLEKHISEQRAGYGGTGSIEIPVLCLLVNGDPNTLERISRAVEQAAPWLILVGSGGIADVLAALVNQPHLLVPKVAEKQFKEKFPSKHFSWEDIVRWTKLLQNITSHQHLLTVYDFEQEGSEELDTVILKALVKACKSHSQEPQDYLDELKLAVAWDRVDIAKSEIFNGDVEWKSCDLEEVMVDALVSNKPEFVRLFVDNGADVADFLTYGRLQELYRSVSRKSLLFDLLQRKQEEARLTLAGLGTQQAREPPAGPPAFSLHEVSRVLKDFLQDACRGFYQDGRPGDRRRAEKGPAKRPTGQKWLLDLNQKSENPWRDLFLWAVLQNRHEMATYFWAMGQEGVAAALAACKILKEMSHLETEAEAARATREAKYERLALDLFSECYSNSEARAFALLVRRNRCWSKTTCLHLATEADAKAFFAHDGVQAFLTRIWWGDMAAGTPILRLLGAFLCPALVYTNLITFSEEAPLRTGLEDLQDLDSLDTEKSPLYGLQSRVEELVEAPRAQGDRGPRAVFLLTRWRKFWGAPVTVFLGNVVMYFAFLFLFTYVLLVDFRPPPQGPSGPEVTLYFWVFTLVLEEIRQGFFTDEDTHLVKKFTLYVGDNWNKCDMVAIFLFIVGVTCRMLPSAFEAGRTVLAMDFMVFTLRLIHIFAIHKQLGPKIIVVERMMKDVFFFLFFLSVWLVAYGVTTQALLHPHDGRLEWIFRRVLYRPYLQIFGQIPLDEIDEARVNCSTHPLLLEDSPSCPSLYANWLVILLLVTFLLVTNVLLMNLLIAMFSYTFQVVQGNADMFWKFQRYNLIVEYHERPALAPPFILLSHLSLTLRRVFKKEAEHKREHLERDLPDPLDQKVVTWETVQKENFLSKMEKRRRDSEGEVLRKTAHSLTTCSCRRVDFIAKYLGGLREQEKRIKCLESQINYCSVLVSSVADVLAQGGGPRSSQHCGEGSQLVAADHRGGLDGWEQPGAGQPPSDT

SEQ ID NO: 90354 - protein, 1159 aa, Homo sapiens
  Payload ID: 18057
  Gene Name: transient receptor potential cation channel, subfamily M, member 5
  ENSP ID: ENSP00000434383
PGSPGDAEDRRELGLHRGEVNFGGSGKKRGKFVRVPSGVAPSVLFDLLLAEWHLPAPNLVVSLVGEEQPFAMKSWLRDVLRKGLVKAAQSTGAWILTSALRVGLARHVGQAVRDHSLASTSTKVRVVAVGMASLGRVLHRRILEEAQVHEDFPVHYPEDDGGSQGPLCSLDSNLSHFILVEPGPPGKGDGLTELRLRLEKHISEQRAGYGGTGSIEIPVLCLLVNGDPNTLERISRAVEQAAPWLILVGSGGIADVLAALVNQPHLLVPKVAEKQFKEKFPSKHFSWEDIVRWTKLLQNITSHQHLLTVYDFEQEGSEELDTVILKALVKACKSHSQEPQDYLDELKLAVAWDRVDIAKSEIFNGDVEWKSCDLEEVMVDALVSNKPEFVRLFVDNGADVADFLTYGRLQELYRSVSRKSLLFDLLQRKQEEARLTLAGLGTQQAREPPAGPPAFSLHEVSRVLKDFLQDACRGFYQDGRPGDRRRAEKGPAKRPTGQKWLLDLNQKSENPWRDLFLWAVLQNRHEMATYFWAMGQEGVAAALAACKILKEMSHLETEAEAARATREAKYERLALDLFSECYSNSEARAFALLVRRNRCWSKTTCLHLATEADAKAFFAHDGVQAFLTRIWWGDMAAGTPILRLLGAFLCPALVYTNLITFSEEAPLRTGLEDLQDLDSLDTEKSPLYGLQSRVEELVEAPRAQGDRGPRAVFLLTRWRKFWGAPVTVFLGNVVMYFAFLFLFTYVLLVDFRPPPQGPSGPEVTLYFWVFTLVLEEIRQGFFTDEDTHLVKKFTLYVGDNWNKCDMVAIFLFIVGVTCRMLPSAFEAGRTVLAMDFMVFTLRLIHIFAIHKQLGPKIIVVERMMKDVFFFLFFLSVWLVAYGVTTQALLHPHDGRLEWIFRRVLYRPYLQIFGQIPLDEIDEARVNCSTHPLLLEDSPSCPSLYANWLVILLLVTFLLVTNVLLMNLLIAMFSYTFQVVQGNADMFWKFQRYNLIVEYHERPALAPPFILLSHLSLTLRRVFKKEAEHKREHLERDLPDPLDQKVVTWETVQKENFLSKMEKRRRDSEGEVLRKTAHRVDFIAKYLGGLREQEKRIKCLESQINYCSVLVSSVADVLAQGGGPRSSQHCGEGSQLVAADHRGGLDGWEQPGAGQPPSDT

SEQ ID NO: 90355 - protein, 1166 aa, Homo sapiens
  Payload ID: 18057
  Gene Name: transient receptor potential cation channel, subfamily M, member 5
  ENSP ID: ENSP00000436809
MQDVQGPRPGSPGDAEDRRELGLHRGEVNFGGSGKKRGKFVRVPSGVAPSVLFDLLLAEWHLPAPNLVVSLVGEEQPFAMKSWLRDVLRKGLVKAAQSTGAWILTSALRVGLARHVGQAVRDHSLASTSTKVRVVAVGMASLGRVLHRRILEEAQEDFPVHYPEDDGGSQGPLCSLDSNLSHFILVEPGPPGKGDGLTELRLRLEKHISEQRAGYGGTGSIEIPVLCLLVNGDPNTLERISRAVEQAAPWLILVGSGGIADVLAALVNQPHLLVPKVAEKQFKEKFPSKHFSWEDIVRWTKLLQNITSHQHLLTVYDFEQEGSEELDTVILKALVKACKSHSQEPQDYLDELKLAVAWDRVDIAKSEIFNGDVEWKSCDLEEVMVDALVSNKPEFVRLFVDNGADVADFLTYGRLQELYRSVSRKSLLFDLLQRKQEEARLTLAGLGTQQAREPPAGPPAFSLHEVSRVLKDFLQDACRGFYQDGRPGDRRRAEKGPAKRPTGQKWLLDLNQKSENPWRDLFLWAVLQNRHEMATYFWAMGQEGVAAALAACKILKEMSHLETEAEAARATREAKYERLALDLFSECYSNSEARAFALLVRRNRCWSKTTCLHLATEADAKAFFAHDGVQAFLTRIWWGDMAAGTPILRLLGAFLCPALVYTNLITFSEEAPLRTGLEDLQDLDSLDTEKSPLYGLQSRVEELVEAPRAQGDRGPRAVFLLTRWRKFWGAPVTVFLGNVVMYFAFLFLFTYVLLVDFRPPPQGPSGPEVTLYFWVFTLVLEEIRQGFFTDEDTHLVKKFTLYVGDNWNKCDMVAIFLFIVGVTCRMLPSAFEAGRTVLAMDFMVFTLRLIHIFAIHKQLGPKIIVVERMMKDVFFFLFFLSVWLVAYGVTTQALLHPHDGRLEWIFRRVLYRPYLQIFGQIPLDEIDEARVNCSTHPLLLEDSPSCPSLYANWLVILLLVTFLLVTNVLLMNLLIAMFSYTFQVVQGNADMFWKFQRYNLIVEYHERPALAPPFILLSHLSLTLRRVFKKEAEHKREHLERDLPDPLDQKVVTWETVQKENFLSKMEKRRRDSEGEVLRKTAHRVDFIAKYLGGLREQEKRIKCLESQINYCSVLVSSVADVLAQGGGPRTGSQHCGEGSQLVAADHRGGLDGWEQPGAGQPPSDT

SEQ ID NO: 90356 - protein, 303 aa, Homo sapiens
  Payload ID: 18058
  Gene Name: transient receptor potential cation channel, subfamily M, member 6
  ENSP ID: ENSP00000351942
MKEQPVLERLQSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCREYHRGSVTQSGCRPAEVFHGLP

SEQ ID NO: 90357 - protein, 2022 aa, Homo sapiens
  Payload ID: 18058
  Gene Name: transient receptor potential cation channel, subfamily M, member 6
  Uniprot ID: Q9BX84
  ENSP ID: ENSP00000354006
MKEQPVLERLQSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCRSRQGVPVVGLVVEGGPNVILSVWETVKDKDPVVVCEGTGRAADLLAFTHKHLADEGMLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKHQRHSSGNRNESAESTLHSQFIRTAQPYKFKEKSIVLHKSRKKSKEQNVSDDPESTGFLYPYNDLLVWAVLMKRQKMAMFFWQHGEEATVKAVIACILYRAMAHEAKESHMVDDASEELKNYSKQFGQLALDLLEKAFKQNERMAMTLLTYELRNWSNSTCLKLAVSGGLRPFVSHTCTQMLLTDMWMGRLKMRKNSWLKIIISIILPPTILTLEFKSKAEMSHVPQSQDFQFMWYYSDQNASSSKESASVKEYDLERGHDEKLDENQHFGLESGHQHLPWTRKVYEFYSAPIVKFWFYTMAYLAFLMLFTYTVLVEMQPQPSVQEWLVSIYIFTNAIEVVREICISEPGKFTQKVKVWISEYWNLTETVAIGLFSAGFVLRWGDPPFHTAGRLIYCIDIIFWFSRLLDFFAVNQHAGPYVTMIAKMTANMFYIVIIMAIVLLSFGVARKAILSPKEPPSWSLARDIVFEPYWMIYGEVYAGEIDVCSSQPSCPPGSFLTPFLQAVYLFVQYIIMVNLLIAFFNNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLSQAKIMQTGGGYVNWAFSEGDETGVFSIKKKWQTCLPSTCDSDSSRSEQHQKQAQDSSLSDNSTRSAQSSECSEVGPWLQPNTSFWINPLRRYRPFARSHSFRFHKEEKLMKICKIKNLSGSSEIGQGAWVKAKMLTKDRRLSKKKKNTQGLQVPIITVNACSQSDQLNPEPGENSISEEEYSKNWFTVSKFSHTGVEPYIHQKMKTKEIGQCAIQISDYLKQSQEDLSKNSLWNSRSTNLNRNSLLKSSIGVDKISASLKSPQEPHHHYSAIERNNLMRLSQTIPFTPVQLFAGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQGVGENLTDPSVIKPEVKQSRGMVFGPANLGEDAIRNFIAKHHCNSCCRKLKLPDLKRNDYSPERINSTFGLEIKIESAEEPPARETGRNSPEDDMQL

SEQ ID NO: 90358 - protein, 2017 aa, Homo sapiens
  Payload ID: 18058
  Gene Name: transient receptor potential cation channel, subfamily M, member 6
  Uniprot ID: Q9BX84
  ENSP ID: ENSP00000354962
MTAPVTSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCRSRQGVPVVGLVVEGGPNVILSVWETVKDKDPVVVCEGTGRAADLLAFTHKHLADEGMLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKHQRHSSGNRNESAESTLHSQFIRTAQPYKFKEKSIVLHKSRKKSKEQNVSDDPESTGFLYPYNDLLVWAVLMKRQKMAMFFWQHGEEATVKAVIACILYRAMAHEAKESHMVDDASEELKNYSKQFGQLALDLLEKAFKQNERMAMTLLTYELRNWSNSTCLKLAVSGGLRPFVSHTCTQMLLTDMWMGRLKMRKNSWLKIIISIILPPTILTLEFKSKAEMSHVPQSQDFQFMWYYSDQNASSSKESASVKEYDLERGHDEKLDENQHFGLESGHQHLPWTRKVYEFYSAPIVKFWFYTMAYLAFLMLFTYTVLVEMQPQPSVQEWLVSIYIFTNAIEVVREICISEPGKFTQKVKVWISEYWNLTETVAIGLFSAGFVLRWGDPPFHTAGRLIYCIDIIFWFSRLLDFFAVNQHAGPYVTMIAKMTANMFYIVIIMAIVLLSFGVARKAILSPKEPPSWSLARDIVFEPYWMIYGEVYAGEIDVCSSQPSCPPGSFLTPFLQAVYLFVQYIIMVNLLIAFFNNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLSQAKIMQTGGGYVNWAFSEGDETGVFSIKKKWQTCLPSTCDSDSSRSEQHQKQAQDSSLSDNSTRSAQSSECSEVGPWLQPNTSFWINPLRRYRPFARSHSFRFHKEEKLMKICKIKNLSGSSEIGQGAWVKAKMLTKDRRLSKKKKNTQGLQVPIITVNACSQSDQLNPEPGENSISEEEYSKNWFTVSKFSHTGVEPYIHQKMKTKEIGQCAIQISDYLKQSQEDLSKNSLWNSRSTNLNRNSLLKSSIGVDKISASLKSPQEPHHHYSAIERNNLMRLSQTIPFTPVQLFAGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQGVGENLTDPSVIKPEVKQSRGMVFGPANLGEDAIRNFIAKHHCNSCCRKLKLPDLKRNDYSPERINSTFGLEIKIESAEEPPARETGRNSPEDDMQL

SEQ ID NO: 90359 - protein, 2017 aa, Homo sapiens
  Payload ID: 18058
  Gene Name: transient receptor potential cation channel, subfamily M, member 6
  Uniprot ID: Q9BX84
  ENSP ID: ENSP00000396672
MIILSKSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCRSRQGVPVVGLVVEGGPNVILSVWETVKDKDPVVVCEGTGRAADLLAFTHKHLADEGMLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKHQRHSSGNRNESAESTLHSQFIRTAQPYKFKEKSIVLHKSRKKSKEQNVSDDPESTGFLYPYNDLLVWAVLMKRQKMAMFFWQHGEEATVKAVIACILYRAMAHEAKESHMVDDASEELKNYSKQFGQLALDLLEKAFKQNERMAMTLLTYELRNWSNSTCLKLAVSGGLRPFVSHTCTQMLLTDMWMGRLKMRKNSWLKIIISIILPPTILTLEFKSKAEMSHVPQSQDFQFMWYYSDQNASSSKESASVKEYDLERGHDEKLDENQHFGLESGHQHLPWTRKVYEFYSAPIVKFWFYTMAYLAFLMLFTYTVLVEMQPQPSVQEWLVSIYIFTNAIEVVREICISEPGKFTQKVKVWISEYWNLTETVAIGLFSAGFVLRWGDPPFHTAGRLIYCIDIIFWFSRLLDFFAVNQHAGPYVTMIAKMTANMFYIVIIMAIVLLSFGVARKAILSPKEPPSWSLARDIVFEPYWMIYGEVYAGEIDVCSSQPSCPPGSFLTPFLQAVYLFVQYIIMVNLLIAFFNNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLSQAKIMQTGGGYVNWAFSEGDETGVFSIKKKWQTCLPSTCDSDSSRSEQHQKQAQDSSLSDNSTRSAQSSECSEVGPWLQPNTSFWINPLRRYRPFARSHSFRFHKEEKLMKICKIKNLSGSSEIGQGAWVKAKMLTKDRRLSKKKKNTQGLQVPIITVNACSQSDQLNPEPGENSISEEEYSKNWFTVSKFSHTGVEPYIHQKMKTKEIGQCAIQISDYLKQSQEDLSKNSLWNSRSTNLNRNSLLKSSIGVDKISASLKSPQEPHHHYSAIERNNLMRLSQTIPFTPVQLFAGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQGVGENLTDPSVIKPEVKQSRGMVFGPANLGEDAIRNFIAKHHCNSCCRKLKLPDLKRNDYSPERINSTFGLEIKIESAEEPPARETGRNSPEDDMQL

SEQ ID NO: 90360 - protein, 1865 aa, Homo sapiens
  Payload ID: 18059
  Gene Name: transient receptor potential cation channel, subfamily M, member 7
  Uniprot ID: Q96QT4
  ENSP ID: ENSP00000320239
MSQKSWIESTLTKRECVYIIPSSKDPHRCLPGCQICQQLVRCFCGRLVKQHACFTASLAMKYSDVKLGDHFNQAIEEWSVEKHTEQSPTDAYGVINFQGGSHSYRAKYVRLSYDTKPEVILQLLLKEWQMELPKLVISVHGGMQKFELHPRIKQLLGKGLIKAAVTTGAWILTGGVNTGVAKHVGDALKEHASRSSRKICTIGIAPWGVIENRNDLVGRDVVAPYQTLLNPLSKLNVLNNLHSHFILVDDGTVGKYGAEVRLRRELEKTINQQRIHARIGQGVPVVALIFEGGPNVILTVLEYLQESPPVPVVVCEGTGRAADLLAYIHKQTEEGGNLPDAAEPDIISTIKKTFNFGQNEALHLFQTLMECMKRKELITVFHIGSDEHQDIDVAILTALLKGTNASAFDQLILTLAWDRVDIAKNHVFVYGQQWLVGSLEQAMLDALVMDRVAFVKLLIENGVSMHKFLTIPRLEELYNTKQGPTNPMLFHLVRDVKQGNLPPGYKITLIDIGLVIEYLMGGTYRCTYTRKRFRLIYNSLGGNNRRSGRNTSSSTPQLRKSHESFGNRADKKEKMRHNHFIKTAQPYRPKIDTVMEEGKKKRTKDEIVDIDDPETKRFPYPLNELLIWACLMKRQVMARFLWQHGEESMAKALVACKIYRSMAYEAKQSDLVDDTSEELKQYSNDFGQLAVELLEQSFRQDETMAMKLLTYELKNWSNSTCLKLAVSSRLRPFVAHTCTQMLLSDMWMGRLNMRKNSWYKVILSILVPPAILLLEYKTKAEMSHIPQSQDAHQMTMDDSENNFQNITEEIPMEVFKEVRILDSNEGKNEMEIQMKSKKLPITRKFYAFYHAPIVKFWFNTLAYLGFLMLYTFVVLVQMEQLPSVQEWIVIAYIFTYAIEKVREIFMSEAGKVNQKIKVWFSDYFNISDTIAIISFFIGFGLRFGAKWNFANAYDNHVFVAGRLIYCLNIIFWYVRLLDFLAVNQQAGPYVMMIGKMVANMFYIVVIMALVLLSFGVPRKAILYPHEAPSWTLAKDIVFHPYWMIFGEVYAYEIDVCANDSVIPQICGPGTWLTPFLQAVYLFVQYIIMVNLLIAFFNNVYLQVKAISNIVWKYQRYHFIMAYHEKPVLPPPLIILSHIVSLFCCICKRRKKDKTSDGPKLFLTEEDQKKLHDFEEQCVEMYFNEKDDKFHSGSEERIRVTFERVEQMCIQIKEVGDRVNYIKRSLQSLDSQIGHLQDLSALTVDTLKTLTAQKASEASKVHNEITRELSISKHLAQNLIDDGPVRPSVWKKHGVVNTLSSSLPQGDLESNNPFHCNILMKDDKDPQCNIFGQDLPAVPQRKEFNFPEAGSSSGALFPSAVSPPELRQRLHGVELLKIFNKNQKLGSSSTSIPHLSSPPTKFFVSTPSQPSCKSHLETGTKDQETVCSKATEGDNTEFGAFVGHRDSMDLQRFKETSNKIKILSNNNTSENTLKRVSSLAGFTDCHRTSIPVHSKQAEKISRRPSTEDTHEVDSKAALIPDWLQDRPSNREMPSEEGTLNGLTSPFKPAMDTNYYYSAVERNNLMRLSQSIPFTPVPPRGEPVTVYRLEESSPNILNNSMSSWSQLGLCAKIEFLSKEEMGGGLRRAVKVQCTWSEHDILKSGHLYIIKSFLPEVVNTWSSIYKEDTVLHLCLREIQQQRAAQKLTFAFNQMKPKSIPYSPRFLEVFLLYCHSAGQWFAVEECMTGEFRKYNNNNGDEIIPTNTLEEIMLAFSHWTYEYTRGELLVLDLQGVGENLTDPSVIKAEEKRSCDMVFGPANLGEDAIKNFRAKHHCNSCCRKLKLPDLKRNDYTPDKIIFPQDEPSDLNLQPGNSTKESESTNSVRLML

SEQ ID NO: 90361 - protein, 535 aa, Homo sapiens
  Payload ID: 18059
  Gene Name: transient receptor potential cation channel, subfamily M, member 7
  ENSP ID: ENSP00000452873
SMHKFLTIPRLEELYNTKQGPTNPMLFHLVRDVKQGNLPPGYKITLIDIGLVIEYLMGGTYRCTYTRKRFRLIYNSLGGNNRRSGRNTSSSTPQLRKSHESFGNRADKKEKMRHNHFIKTAQPYRPKIDTVMEEGKKKRTKDEIVDIDDPETKRFPYPLNELLIWACLMKRQVMARFLWQHGEESMAKALVACKIYRSMAYEAKQSDLVDDTSEELKQYSNDFGQLAVELLEQSFRQDETMAMKLLTYELKNWSNSTCLKLAVSSRLRPFVAHTCTQMLLSDMWMGRLNMRKNSWYKVILSILVPPAILLLEYKTKAEMSHIPQSQDAHQMTMDDSENNFQNITEEIPMEVFKEVRILDSNEGKNEMEIQMKSKKLPITRKFYAFYHAPIVKFWFNTLAYLGFLMLYTFVVLVQMEQLPSVQEWIVIAYIFTYAIEKVREIFMSEAGKVNQKIKVWFSDYFNISDTIAIISFFIGFGLRFGAKWNFANAYDNHVFVAGRLIYCLNIIFWYVRLLDFLAVNQQAGPYVMMIGKMVS

SEQ ID NO: 90362 - protein, 1864 aa, Homo sapiens
  Payload ID: 18059
  Gene Name: transient receptor potential cation channel, subfamily M, member 7
  ENSP ID: ENSP00000453277
MSQKSWIESTLTKRECVYIIPSSKDPHRCLPGCQICQQLVRCFCGRLVKQHACFTASLAMKYSDVKLGDHFNQAIEEWSVEKHTEQSPTDAYGVINFQGGSHSYRAKYVRLSYDTKPEVILQLLLKEWQMELPKLVISVHGGMQKFELHPRIKQLLGKGLIKAAVTTGAWILTGGVNTGVAKHVGDALKEHASRSSRKICTIGIAPWGVIENRNDLVGRDVVAPYQTLLNPLSKLNVLNNLHSHFILVDDGTVGKYGAEVRLRRELEKTINQQRIHARIGQGVPVVALIFEGGPNVILTVLEYLQESPPVPVVVCEGTGRAADLLAYIHKQTEEGGNLPDAAEPDIISTIKKTFNFGQNEALHLFQTLMECMKRKELITVFHIGSDEHQDIDVAILTALLKGTNASAFDQLILTLAWDRVDIAKNHVFVYGQQWLVGSLEQAMLDALVMDRVAFVKLLIENGVSMHKFLTIPRLEELYNTKQGPTNPMLFHLVRDVKQGNLPPGYKITLIDIGLVIEYLMGGTYRCTYTRKRFRLIYNSLGGNNRRSGRNTSSSTPQLRKSHESFGNRADKKEKMRHNHFIKTAQPYRPKIDTVMEEGKKKRTKDEIVDIDDPETKRFPYPLNELLIWACLMKRQVMARFLWQHGEESMAKALVACKIYRSMAYEAKQSDLVDDTSEELKQYSNDFGQLAVELLEQSFRQDETMAMKLLTYELKNWSNSTCLKLAVSSRLRPFVAHTCTQMLLSDMWMGRLNMRKNSWYKVILSILVPPAILLLEYKTKAEMSHIPQSQDAHQMTMDDSENNFQNITEEIPMEVFKEVRILDSNEGKNEMEIQMKSKKLPITRKFYAFYHAPIVKFWFNTLAYLGFLMLYTFVVLVQMEQLPSVQEWIVIAYIFTYAIEKVREIFMSEAGKVNQKIKVWFSDYFNISDTIAIISFFIGFGLRFGAKWNFANAYDNHVFVAGRLIYCLNIIFWYVRLLDFLAVNQQAGPYVMMIGKMVANMFYIVVIMALVLLSFGVPRKAILYPHEAPSWTLAKDIVFHPYWMIFGEVYAYEIDVCANDSVIPQICGPGTWLTPFLQAVYLFVQYIIMVNLLIAFFNNVYLQVKAISNIVWKYQRYHFIMAYHEKPVLPPPLIILSHIVSLFCCICKRRKKDKTSDGPKLFLTEEDQKKLHDFEEQCVEMYFNEKDDKFHSGSEERIRVTFERVEQMCIQIKEVGDRVNYIKRSLQSLDSQIGHLQDLSALTVDTLKTLTAQKASEASKVHNEITRELSISKHLAQNLIDDGPVRPSVWKKHGVVNTLSSSLPQGDLESNNPFHCNILMKDDKDPQCNIFGQDLPAVPQRKEFNFPEAGSSSGALFPSAVSPPELRQRLHGVELLKIFNKNQKLGSSSTSIPHLSSPPTKFFVSTPSQPSCKSHLETGTKDQETVCSKATEGDNTEFGAFVGHRDSMDLQRFKETSNKIKILSNNNTSENTLKRVSSLAGFTDCHRTSIPVHSKQEKISRRPSTEDTHEVDSKAALIPDWLQDRPSNREMPSEEGTLNGLTSPFKPAMDTNYYYSAVERNNLMRLSQSIPFTPVPPRGEPVTVYRLEESSPNILNNSMSSWSQLGLCAKIEFLSKEEMGGGLRRAVKVQCTWSEHDILKSGHLYIIKSFLPEVVNTWSSIYKEDTVLHLCLREIQQQRAAQKLTFAFNQMKPKSIPYSPRFLEVFLLYCHSAGQWFAVEECMTGEFRKYNNNNGDEIIPTNTLEEIMLAFSHWTYEYTRGELLVLDLQGVGENLTDPSVIKAEEKRSCDMVFGPANLGEDAIKNFRAKHHCNSCCRKLKLPDLKRNDYTPDKIIFPQDEPSDLNLQPGNSTKESESTNSVRLML

SEQ ID NO: 90363 - protein, 234 aa, Homo sapiens
  Payload ID: 18059
  Gene Name: transient receptor potential cation channel, subfamily M, member 7
  ENSP ID: ENSP00000454066
  MOD_RES (1)..(1): Any amino acid
XGLRRAVKVQCTWSEHDILKSGHLYIIKSFLPEVVNTWSSIYKEDTVLHLCLREIQQQRAAQKLTFAFNQMKPKSIPYSPRFLEVFLLYCHSAGQWFAVEECMTGEFRKYNNNNGDEIIPTNTLEEIMLAFSHWTYEYTRGELLVLDLQGVGENLTDPSVIKAEEKRSCDMVFGPANLGEDAIKNFRAKHHCNSCCRKLKLPEMRSHCVTQAGLELTSSNPQCLSLTKCWDYQC

SEQ ID NO: 90364 - protein, 1104 aa, Homo sapiens
  Payload ID: 18060
  Gene Name: transient receptor potential cation channel, subfamily M, member 8
  Uniprot ID: Q7Z2W7
  ENSP ID: ENSP00000323926
MSFRAARLSMRNRRNDTLDSTRTLYSSASRSTDLSYSESDLVNFIQANFKKRECVFFTKDSKATENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEGYFLAQYLMDDFTRDPLYILDNNHTHLLLVDNGCHGHPTVEAKLRNQLEKYISERTIQDSNYGGKIPIVCFAQGGGKETLKAINTSIKNKIPCVVVEGSGQIADVIASLVEVEDALTSSAVKEKLVRFLPRTVSRLPEEETESWIKWLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQNFLSKQWYGEISRDTKNWKIILCLFIIPLVGCGFVSFRKKPVDKHKKLLWYYVAFFTSPFVVFSWNVVFYIAFLLLFAYVLLMDFHSVPHPPELVLYSLVFVLFCDEVRQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 90365 - protein, 192 aa, Homo sapiens
  Payload ID: 18060
  Gene Name: transient receptor potential cation channel, subfamily M, member 8
  ENSP ID: ENSP00000347956
MKSFLPVHTIVLIRENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEVPVGQEEVC

SEQ ID NO: 90366 - protein, 165 aa, Homo sapiens
  Payload ID: 18060
  Gene Name: transient receptor potential cation channel, subfamily M, member 8
  Uniprot ID: Q7Z2W7
  ENSP ID: ENSP00000386771
MEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEVPVGQEEVC

SEQ ID NO: 90367 - protein, 139 aa, Homo sapiens
  Payload ID: 18060
  Gene Name: transient receptor potential cation channel, subfamily M, member 8
  ENSP ID: ENSP00000390609
GRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGKPDLAQMETAWRRHLLPEPTPRAAPETALQKHARETESNITEYHV

SEQ ID NO: 90368 - protein, 325 aa, Homo sapiens
  Payload ID: 18060
  Gene Name: transient receptor potential cation channel, subfamily M, member 8
  ENSP ID: ENSP00000396745
MSFRAARLSMRNRRNDTLDSTRTLYSSASRSTDLSYSESDLVNFIQANFKKRECVFFTKDSKATENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEGYFLAQYLMDDFTRDPLYILDNNHTHLLLVDNGCHGHPTVEAKLRNQLEKYISERTIQDSNYGGKIPIVCFAQGGGKETLKSRRFGRRISVT

SEQ ID NO: 90369 - protein, 753 aa, Homo sapiens
  Payload ID: 18060
  Gene Name: transient receptor potential cation channel, subfamily M, member 8
  ENSP ID: ENSP00000404423
MDDFTRDPLYILDNNHTHLLLVDNGCHGHPTVEAKLRNQLEKYISERTIQDSNYGGKIPIVCFAQGGGKETLKAINTSIKNKIPCVVVEGSGQIADVIASLVEVEDALTSSAVKEKLVRFLPRTVSRLPEEETESWIKWLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 90370 - protein, 376 aa, Homo sapiens
  Payload ID: 18060
  Gene Name: transient receptor potential cation channel, subfamily M, member 8
  ENSP ID: ENSP00000414198
TECYSSDEDLAEQLLVYSCEAWGGSNCLELAVEATDQHFIAQPGVQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKIILRNADEQFCYRLLNERFSDPWVHGG

SEQ ID NO: 90371 - protein, 779 aa, Homo sapiens
  Payload ID: 18061
  Gene Name: transient receptor potential cation channel, subfamily V, member 1
  ENSP ID: ENSP00000311692
MKKWSSTDLGAAADPLQKDTCPDPLDGDPNSRPPPAKPQLSTAKSRTRLFGKGDSEEAFPVDCPHEEGELDSCPTITVSPVITIQRPGDGPTGARLLSQDSVAASTEKTLRLYDRRSIFEAVAQNNCQDLESLLLFLQKSKKHLTDNEFKDPETGKTCLLKAMLNLHDGQNTTIPLLLEIARQTDSLKELVNASYTDSYYKGQTALHIAIERRNMALVTLLVENGADVQAAAHGDFFKKTKGRPGFYFGELPLSLAACTNQLGIVKFLLQNSWQTADISARDSVGNTVLHALVEVADNTADNTKFVTSMYNEILMLGAKLHPTLKLEELTNKKGMTPLALAAGTGKIGNRHDMLLVEPLNRLLQDKWDRFVKRIFYFNFLVYCLYMIIFTMAAYYRPVDGLPPFKMEKTGDYFRVTGEILSVLGGVYFFFRGIQYFLQRRPSMKTLFVDSYSEMLFFLQSLFMLATVVLYFSHLKEYVASMVFSLALGWTNMLYYTRGFQQMGIYAVMIEKMILRDLCRFMFVYIVFLFGFSTAVVTLIEDGKNDSLPSESTSHRWRGPACRPPDSSYNSLYSTCLELFKFTIGMGDLEFTENYDFKAVFIILLLAYVILTYILLLNMLIALMGETVNKIAQESKNIWKLQRAITILDTEKSFLKCMRKAFRSGKLLQVGYTPDGKDDYRWCFRVDEVNWTTWNTNVGIINEDPGNCEGVKRTLSFSLRSSRVSGRHWKNFALVPLLREASARDRQSAQPEEVYLRQFSGSLKPEDAEVFKSPAASGEK

SEQ ID NO: 90372 - protein, 839 aa, Homo sapiens [sequence omitted]

SEQ ID NO: 90373 - protein, 839 aa, Homo sapiens [sequence omitted]

SEQ ID NO: 90374 - protein, 850 aa, Homo sapiens
  Payload ID: 18061
  Gene Name: transient receptor potential cation channel, subfamily V, member 1
  ENSP ID: ENSP00000409627
MKKWSSTDLGAAADPLQKDTCPDPLDGDPNSRPPPAKPQLSTAKSRTRLFGKGDSEEAFPVDCPHEEGELDSCPTITVSPVITIQRPGDGPTGARLLSQDSVAASTEKTLRLYDRRSIFEAVAQNNCQDLESLLLFLQKSKKHLTDNEFKDPETGKTCLLKAMLNLHDGQNTTIPLLLEIARQTDSLKELVNASYTDSYYKGQTALHIAIERRNMALVTLLVENGADVQAAAHGDFFKKTKGRPGFYFGELPLSLAACTNQLGIVKFLLQNSWQTADISARDSVGNTVLHALVEVADNTADNTKFVTSMYNEILMLGAKLHPTLKLEELTNKKGMTPLALAAGTGKIGVIENGPPLSFMVLAYILQREIQEPECRHLSRKFTEWAYGPVHSSLYDLSCIDTCEKNSVLEVIAYSSSETPNRHDMLLVEPLNRLLQDKWDRFVKRIFYFNFLVYCLYMIIFTMAAYYRPVDGLPPFKMEKTGDYFRVTGEILSVLGGVYFFFRGIQYFLQRRPSMKTLFVDSYSEMLFFLQSLFMLATVVLYFSHLKEYVASMVFSLALGWTNMLYYTRGFQQMGIYAVMIEKMILRDLCRFMFVYIVFLFGFSTAVVTLIEDGKNDSLPSESTSHRWRGPACRPPDSSYNSLYSTCLELFKFTIGMGDLEFTENYDFKAVFIILLLAYVILTYILLLNMLIALMGETVNKIAQESKNIWKLQRAITILDTEKSFLKCMRKAFRSGKLLQVGYTPDGKDDYRWCFRVDEVNWTTWNTNVGIINEDPGNCEGVKRTLSFSLRSSRVSGRHWKNFALVPLLREASARDRQSAQPEEVYLRQFSGSLKPEDAEVFKSPAASGEK

SEQ ID NO: 90375 - protein, 829 aa, Homo sapiens
  Payload ID: 18061
  Gene Name: transient receptor potential cation channel, subfamily V, member 1
  ENSP ID: ENSP00000459042
MKKWSSTDLGAAADPLQKDTCPDPLDGDPNSRPPPAKPQLSTAKSRTRLFGKGDSEEAFPVDCPHEEGELDSCPTITVSPVITIQRPGDGPTGARLLSQDSVAASTEKTLRLYDRRSIFEAVAQNNCQDLESLLLFLQKSKKHLTDNEFKDPETGKTCLLKAMLNLHDGQNTTIPLLLEIARQTDSLKELVNASYTDSYYKGQTALHIAIERRNMALVTLLVENGADVQAAAHGDFFKKTKGRPGFYFGELPLSLAACTNQLGIVKFLLQNSWQTADISARDSVGNTVLHALVEVADNTADNTKFVTSMYNEILMLGAKLHPTLKLEELTNKKGMTPLALAAGTGKIGVLAYILQREIQEPECRHLSRKFTEWAYGPVHSSLYDLSCIDTCEKNSVLENRHDMLLVEPLNRLLQDKWDRFVKRIFYFNFLVYCLYMIIFTMAAYYRPVDGLPPFKMEKTGDYFRVTGEILSVLGGVYFFFRGIQYFLQRRPSMKTLFVDSYSEMLFFLQSLFMLATVVLYFSHLKEYVASMVFSLALGWTNMLYYTRGFQQMGIYAVMIEKMILRDLCRFMFVYIVFLFGFSTAVVTLIEDGKNDSLPSESTSHRWRGPACRPPDSSYNSLYSTCLELFKFTIGMGDLEFTENYDFKAVFIILLLAYVILTYILLLNMLIALMGETVNKIAQESKNIWKLQRAITILDTEKSFLKCMRKAFRSGKLLQVGYTPDGKDDYRWCFRVDEVNWTTWNTNVGIINEDPGNCEGVKRTLSFSLRSSRVSGRHWKNFALVPLLREASARDRQSAQPEEVYLRQFSGSLKPEDAEVFKSPAASGEK

SEQ ID NO: 90376 - protein, 839 aa, Homo sapiens [sequence omitted]

SEQ ID NO: 90377 - protein, 839 aa, Homo sapiens [sequence omitted]

SEQ ID NO: 90378 - protein, 764 aa, Homo sapiens
  Payload ID: 18062
  Gene Name: transient receptor potential cation channel, subfamily V, member 2
  Uniprot ID: Q9Y5S1
  ENSP ID: ENSP00000342222
MTSPSSSPVFRLETLDGGQEDGSEADRGKLDFGSGLPPMESQFQGEDRKFAPQIRVNLNYRKGTGASQPDPNRFDRDRLFNAVSRGVPEDLAGLPEYLSKTSKYLTDSEYTEGSTGKTCLMKAVLNLKDGVNACILPLLQIDRDSGNPQPLVNAQCTDDYYRGHSALHIAIEKRSLQCVKLLVENGANVHARACGRFFQKGQGTCFYFGELPLSLAACTKQWDVVSYLLENPHQPASLQATDSQGNTVLHALVMISDNSAENIALVTSMYDGLLQAGARLCPTVQLEDIRNLQDLTPLKLAAKEGKIEIFRHILQREFSGLSHLSRKFTEWCYGPVRVSLYDLASVDSCEENSVLEIIAFHCKSPHRHRMVVLEPLNKLLQAKWDLLIPKFFLNFLCNLIYMFIFTAVAYHQPTLKKQAAPHLKAEVGNSMLLTGHILILLGGIYLLVGQLWYFWRRHVFIWISFIDSYFEILFLFQALLTVVSQVLCFLAIEWYLPLLVSALVLGWLNLLYYTRGFQHTGIYSVMIQKVILRDLLRFLLIYLVFLFGFAVALVSLSQEAWRPEAPTGPNATESVQPMEGQEDEGNGAQYRGILEASLELFKFTIGMGELAFQEQLHFRGMVLLLLLAYVLLTYILLLNMLIALMSETVNSVATDSWSIWKLQKAISVLEMENGYWWCRKKQRAGVMLTVGTKPDGSPDERWCFRVEEVNWASWEQTLPTLCEDPSGAGVPRTLENPVLASPPKEDEDGASEENYVPVQLLQSN

SEQ ID NO: 90379 - protein, 266 aa, Homo sapiens
  Payload ID: 18062
  Gene Name: transient receptor potential cation channel, subfamily V, member 2
  ENSP ID: ENSP00000390014
  MOD_RES (1)..(1): Any amino acid
XDFSLGVPSWWCLICFNIGPSVGPSQPDPNRFDRDRLFNAVSRGVPEDLAGLPEYLSKTSKYLTDSEYTEGSTGKTCLMKAVLNLKDGVNACILPLLQIDRDSGNPQPLVNAQCTDDYYRGHSALHIAIEKRSLQCVKLLVENGANVHARACGRFFQKGQGTCFYFGELPLSLAACTKQWDVVSYLLENPHQPASLQATDSQGNTVLHALVMISDNSAENIALVTSMYDGLLQAGARLCPTVQLEDIRNLQDLTPLKLAAKEGKIE

SEQ ID NO: 90380 - protein, 77 aa, Homo sapiens
  Payload ID: 18062
  Gene Name: transient receptor potential cation channel, subfamily V, member 2
  ENSP ID: ENSP00000464850
  MOD_RES (1)..(1): Any amino acid
XEILFLFQALLTVVSQVLCFLAIEWYLPLLVSALVLGWLNLLYYTRGFQHTGIYSVMIQKGGGGELGFMGADAAYAV

SEQ ID NO: 90381 - protein, 138 aa, Homo sapiens
  Payload ID: 18062
  Gene Name: transient receptor potential cation channel, subfamily V, member 2
  ENSP ID: ENSP00000465609
EDEGNGAQYRGILEASLELFKFTIGMGELAFQEQLHFRGMVLLLLLAYVLLTYILLLNMLIALMSETVNSVATDSWSIWKLQKAISVLEMENGYWWCRKKQRAGVMLTVGTKPDGSPDERWCFRNSREPCPGFPSQGG

SEQ ID NO: 90382 - protein, 96 aa, Homo sapiens
  Payload ID: 18062
  Gene Name: transient receptor potential cation channel, subfamily V, member 2
  ENSP ID: ENSP00000466130
  MOD_RES (1)..(1): Any amino acid
XNGAQYRGILEASLELFKFTIGMGELAFQEQLHFRGMVLLLLLAYVLLTYILLLNMLIALMSETVNSVATDSWSIWKLQGGGGELGFMGADAAYAV

SEQ ID NO: 90383 - protein, 90 aa, Homo sapiens
  Payload ID: 18062
  Gene Name: transient receptor potential cation channel, subfamily V, member 2
  ENSP ID: ENSP00000467593
ALMSETVNSVATDSWSIWKLQKAISVLEMENGYWWCRKKQRAGVMLTVGTKPDGSPDERWCFRQTSELLCCPQGGGGELGFMGADAAYAV

SEQ ID NO: 90384 - protein, 791 aa, Homo sapiens
  Payload ID: 18063
  Gene Name: transient receptor potential cation channel, subfamily V, member 3
  Uniprot ID: Q8NET8
  ENSP ID: ENSP00000301365
MKAHPKEMVPLMGKRVAAPSGNPAILPEKRPAEITPTKKSAHFFLEIEGFEPNPTVAKTSPPVFSKPMDSNIRQCISGNCDDMDSPQSPQDDVTETPSNPNSPSAQLAKEEQRRKKRRLKKRIFAAVSEGCVEELVELLVELQELCRRRHDEDVPDFLMHKLTASDTGKTCLMKALLNINPNTKEIVRILLAFAEENDILGRFINAEYTEEAYEGQTALNIAIERRQGDIAALLIAAGADVNAHAKGAFFNPKYQHEGFYFGETPLALAACTNQPEIVQLLMEHEQTDITSRDSRGNNILHALVTVAEDFKTQNDFVKRMYDMILLRSGNWELETTRNNDGLTPLQLAAKMGKAEILKYILSREIKEKRLRSLSRKFTDWAYGPVSSSLYDLTNVDTTTDNSVLEITVYNTNIDNRHEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVFFIQAVLVILSVFLYLFAYKEYLACLVLAMALGWANMLYYTRGFQSMGMYSVMIQKVILHDVLKFLFVYIVFLLGFGVALASLIEKCPKDNKDCSSYGSFSDAVLELFKLTIGLGDLNIQQNSKYPILFLFLLITYVILTFVLLLNMLIALMGETVENVSKESERIWRLQRARTILEFEKMLPEWLRSRFRMGELCKVAEDDFRLCLRINEVKWTEWKTHVSFLNEDPGPVRRTADFNKIQDSSRNNSKTTLNAFEEVEEFPETSV

SEQ ID NO: 90385 - protein, 339 aa, Homo sapiens
  Payload ID: 18063
  Gene Name: transient receptor potential cation channel, subfamily V, member 3
  ENSP ID: ENSP00000371338
  MOD_RES (1)..(1): Any amino acid
XGDIAALLIAAGADVNAHAKGAFFNPKYQHEGFYFGETPLALAACTNQPEIVQLLMEHEQTDITSRDSRGNNILHALVTVAEDFKTQNDFVKRMYDMILLRSGNWELETTRNNDGLTPLQLAAKMGKAEILKYILSREIKEKRLRSLSRKFTDWAYGPVSSSLYDLTNVDTTTDNSVLEITVYNTNIDNRHEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVLVPRLPRAGHGPGLGEHALLYAGFPVHGHVQRHDPEGHFA

SEQ ID NO: 90386 - protein, 55 aa, Homo sapiens
  Payload ID: 18063
  Gene Name: transient receptor potential cation channel, subfamily V, member 3
  ENSP ID: ENSP00000458187
MKAHPKEMVPLMGKRVAAPSGNPAILPEKRPAEITPTKKSRHRVLPHWPQTPDLN

SEQ ID NO: 90387 - protein, 55 aa, Homo sapiens; identical to SEQ ID NO: 90386
  Payload ID: 18063
  Gene Name: transient receptor potential cation channel, subfamily V, member 3
  ENSP ID: ENSP00000458239

SEQ ID NO: 90388 - protein, 765 aa, Homo sapiens
  Payload ID: 18063
  Gene Name: transient receptor potential cation channel, subfamily V, member 3
  Uniprot ID: Q8NET8
  ENSP ID: ENSP00000460215
MKAHPKEMVPLMGKRVAAPSGNPAILPEKRPAEITPTKKSAHFFLEIEGFEPNPTVAKTSPPVFSKPMDSNIRQCISGNCDDMDSPQSPQDDVTETPSNPNSPSAQLAKEEQRRKKRRLKKRIFAAVSEGCVEELVELLVELQELCRRRHDEDVPDFLMHKLTASDTGKTCLMKALLNINPNTKEIVRILLAFAEENDILGRFINAEYTEEAYEGQTALNIAIERRQGDIAALLIAAGADVNAHAKGAFFNPKYQHEGFYFGETPLALAACTNQPEIVQLLMEHEQTDITSRDSRGNNILHALVTVAEDFKTQNDFVKRMYDMILLRSGNWELETTRNNDGLTPLQLAAKMGKAEILKYILSREIKEKRLRSLSRKFTDWAYGPVSSSLYDLTNVDTTTDNSVLEITVYNTNIDNRHEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVFFIQAVLVILSVFLYLFAYKEYLACLVLAMALGWANMLYYTRGFQSMGMYSVMIQKVILHDVLKFLFVYIVFLLGFGVALASLIEKCPKDNKDCSSYGSFSDAVLELFKLTIGLGDLNIQQNSKYPILFLFLLITYVILTFVLLLNMLIALMGETVENVSKESERIWRLQRARTILEFEKMLPEWLRSRFRMGELCKVAEDDFRLCLRINEVKWTEWKTHVSFLNEDPGPVRRTGTVAVR

SEQ ID NO: 90389 - protein, 146 aa, Homo sapiens
  Payload ID: 18063
  Gene Name: transient receptor potential cation channel, subfamily V, member 3
  ENSP ID: ENSP00000460856
  MOD_RES (1)..(1): Any amino acid
XEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVFLGLADREVSQRQQGLQLLRQLQRRSAGTLQAHHRPG

SEQ ID NO: 90390 - protein, 790 aa, Homo sapiens
  Payload ID: 18063
  Gene Name: transient receptor potential cation channel, subfamily V, member 3
  Uniprot ID: Q8NET8
  ENSP ID: ENSP00000461518
MKAHPKEMVPLMGKRVAAPSGNPAILPEKRPAEITPTKKSAHFFLEIEGFEPNPTVAKTSPPVFSKPMDSNIRQCISGNCDDMDSPQSPQDDVTETPSNPNSPSAQLAKEEQRRKKRRLKKRIFAAVSEGCVEELVELLVELQELCRRRHDEDVPDFLMHKLTASDTGKTCLMKALLNINPNTKEIVRILLAFAEENDILGRFINAEYTEEAYEGQTALNIAIERRQGDIAALLIAAGADVNAHAKGAFFNPKYQHEGFYFGETPLALAACTNQPEIVQLLMEHEQTDITSRDSRGNNILHALVTVAEDFKTQNDFVKRMYDMILLRSGNWELETTRNNDGLTPLQLAAKMGKAEILKYILSREIKEKRLRSLSRKFTDWAYGPVSSSLYDLTNVDTTTDNSVLEITVYNTNIDNRHEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVFFIQAVLVILSVFLYLFAYKEYLACLVLAMALGWANMLYYTRGFQSMGMYSVMIQKVILHDVLKFLFVYIVFLLGFGVALASLIEKCPKDNKDCSSYGSFSDAVLELFKLTIGLGDLNIQQNSKYPILFLFLLITYVILTFVLLLNMLIALMGETVENVSKESERIWRLQRARTILEFEKMLPEWLRSRFRMGELCKVAEDDFRLCLRINEVKWTEWKTHVSFLNEDPGPVRRTDFNKIQDSSRNNSKTTLNAFEEVEEFPETSV

SEQ ID NO: 90391 - protein, 775 aa, Homo sapiens
  Payload ID: 18063
  Gene Name: transient receptor potential cation channel, subfamily V, member 3
  ENSP ID: ENSP00000483947
MSHHTWPSPALNLDFATYLLRDLGAHFFLEIEGFEPNPTVAKTSPPVFSKPMDSNIRQCISGNCDDMDSPQSPQDDVTETPSNPNSPSAQLAKEEQRRKKRRLKKRIFAAVSEGCVEELVELLVELQELCRRRHDEDVPDFLMHKLTASDTGKTCLMKALLNINPNTKEIVRILLAFAEENDILGRFINAEYTEEAYEGQTALNIAIERRQGDIAALLIAAGADVNAHAKGAFFNPKYQHEGFYFGETPLALAACTNQPEIVQLLMEHEQTDITSRDSRGNNILHALVTVAEDFKTQNDFVKRMYDMILLRSGNWELETTRNNDGLTPLQLAAKMGKAEILKYILSREIKEKRLRSLSRKFTDWAYGPVSSSLYDLTNVDTTTDNSVLEITVYNTNIDNRHEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVFFIQAVLVILSVFLYLFAYKEYLACLVLAMALGWANMLYYTRGFQSMGMYSVMIQKVILHDVLKFLFVYIVFLLGFGVALASLIEKCPKDNKDCSSYGSFSDAVLELFKLTIGLGDLNIQQNSKYPILFLFLLITYVILTFVLLLNMLIALMGETVENVSKESERIWRLQRARTILEFEKMLPEWLRSRFRMGELCKVAEDDFRLCLRINEVKWTEWKTHVSFLNEDPGPVRRTADFNKIQDSSRNNSKTTLNAFEEVEEFPETSV

SEQ ID NO: 90392 - protein, 871 aa, Homo sapiens
  Payload ID: 18064
  Gene Name: transient receptor potential cation channel, subfamily V, member 4
  Uniprot ID: Q9HBA0
  ENSP ID: ENSP00000261740
MADSSEGPRAGPGEVAELPGDESGTPGGEAFPLSSLANLFEGEDGSLSPSPADASRPAGPGDGRPNLRMKFQGAFRKGVPNPIDLLESTLYESSVVPGPKKAPMDSLFDYGTYRHHSSDNKRWRKKIIEKQPQSPKAPAPQPPPILKVFNRPILFDIVSRGSTADLDGLLPFLLTHKKRLTDEEFREPSTGKTCLPKALLNLSNGRNDTIPVLLDIAERTGNMREFINSPFRDIYYRGQTALHIAIERRCKHYVELLVAQGADVHAQARGRFFQPKDEGGYFYFGELPLSLAACTNQPHIVNYLTENPHKKADMRRQDSRGNTVLHALVAIADNTRENTKFVTKMYDLLLLKCARLFPDSNLEAVLNNDGLSPLMMAAKTGKIGIFQHIIRREVTDEDTRHLSRKFKDWAYGPVYSSLYDLSSLDTCGEEASVLEILVYNSKIENRHEMLAVEPINELLRDKWRKFGAVSFYINVVSYLCAMVIFTLTAYYQPLEGTPPYPYRTTVDYLRLAGEVITLFTGVLFFFTNIKDLFMKKCPGVNSLFIDGSFQLLYFIYSVLVIVSAALYLAGIEAYLAVMVFALVLGWMNALYFTRGLKLTGTYSIMIQKILFKDLFRFLLVYLLFMIGYASALVSLLNPCANMKVCNEDQTNCTVPTYPSCRDSETFSTFLLDLFKLTIGMGDLEMLSSTKYPVVFIILLVTYIILTFVLLLNMLIALMGETVGQVSKESKHIWKLQWATTILDIERSFPVFLRKAFRSGEMVTVGKSSDGTPDRRWCFRVDEVNWSHWNQNLGIINEDPGKNETYQYYGFSHTVGRLRRDRWSSVVPRVVELNKNSNPDEVVVPLDSMGNPRCDGHQQGYPRKWRTDDAPL

SEQ ID NO: 90393 - protein, 871 aa, Homo sapiens; identical to SEQ ID NO: 90392
  Payload ID: 18064
  Gene Name: transient receptor potential cation channel, subfamily V, member 4
  Uniprot ID: Q9HBA0
  ENSP ID: ENSP00000406191

SEQ ID NO: 90394 - protein, 552 aa, Homo sapiens
  Payload ID: 18064
  Gene Name: transient receptor potential cation channel, subfamily V, member 4
  ENSP ID: ENSP00000437449
MADSSEGPRAGPGEVAELPGDESGTPGGEAFPLSSLANLFEGEDGSLSPSPADASRPAGPGDGRPNLRMKFQGAFRKGVPNPIDLLESTLYESSVVPGPKKAPMDSLFDYGTYRHHSSDNKRWRKKIIEKQPQSPKAPAPQPPPILKVFNRPILFDIVSRGSTADLDGLLPFLLTHKKRLTDEEFREPSTGKTCLPKALLNLSNGRNDTIPVLLDIAERTGNMREFINSPFRDIYYRGQTALHIAIERRCKHYVELLVAQGADVHAQARGRFFQPKDEGGYFYFGELPLSLAACTNQPHIVNYLTENPHKKADMRRQDSRGNTVLHALVAIADNTRENTKFVTKMYDLLLLKCARLFPDSNLEAVLNNDGLSPLMMAAKTGKIGIFQHIIRREVTDEDTRHLSRKFKDWAYGPVYSSLYDLSSLDTCGEEASVLEILVYNSKIENRHEMLAVEPINELLRDKWRKFGAVSFYINVVSYLCAMVIFTLTAYYQPLEGTPPYPYRTTVDYLRLAGEVITLFTGVLFFFTNIKDLFMKKCPGVNSLFIDGSFQLL

SEQ ID NO: 90395 - protein, 824 aa, Homo sapiens
  Payload ID: 18064
  Gene Name: transient receptor potential cation channel, subfamily V, member 4
  Uniprot ID: Q9HBA0
  ENSP ID: ENSP00000442167
MADSSEGPRAGPGEVAELPGDESGTPGGEAFPLSSLANLFEGEDGSLSPSPADASRPAGPGDGRPNLRMKFQGAFRKGVPNPIDLLESTLYESSVVPGPKKAPMDSLFDYGTYRHHSSDNKRWRKKIIEKQPQSPKAPAPQPPPILKVFNRPILFDIVSRGSTADLDGLLPFLLTHKKRLTDEEFREPSTGKTCLPKALLNLSNGRNDTIPVLLDIAERTGNMREFINSPFRDIYYRGELPLSLAACTNQPHIVNYLTENPHKKADMRRQDSRGNTVLHALVAIADNTRENTKFVTKMYDLLLLKCARLFPDSNLEAVLNNDGLSPLMMAAKTGKIGIFQHIIRREVTDEDTRHLSRKFKDWAYGPVYSSLYDLSSLDTCGEEASVLEILVYNSKIENRHEMLAVEPINELLRDKWRKFGAVSFYINVVSYLCAMVIFTLTAYYQPLEGTPPYPYRTTVDYLRLAGEVITLFTGVLFFFTNIKDLFMKKCPGVNSLFIDGSFQLLYFIYSVLVIVSAALYLAGIEAYLAVMVFALVLGWMNALYFTRGLKLTGTYSIMIQKILFKDLFRFLLVYLLFMIGYASALVSLLNPCANMKVCNEDQTNCTVPTYPSCRDSETFSTFLLDLFKLTIGMGDLEMLSSTKYPVVFIILLVTYIILTFVLLLNMLIALMGETVGQVSKESKHIWKLQWATTILDIERSFPVFLRKAFRSGEMVTVGKSSDGTPDRRWCFRVDEVNWSHWNQNLGIINEDPGKNETYQYYGFSHTVGRLRRDRWSSVVPRVVELNKNSNPDEVVVPLDSMGNPRCDGHQQGYPRKWRTDDAPL

SEQ ID NO: 90396 - protein, 811 aa, Homo sapiens
  Payload ID: 18064
  Gene Name: transient receptor potential cation channel, subfamily V, member 4
  Uniprot ID: Q9HBA0
  ENSP ID: ENSP00000442738
MADSSEGPRAGPGEVAELPGDESGTPGGEAFPLSSLANLFEGEDGSLSPSPADASRPAGPGDGRPNLRMKFQGAFRKGVPNPIDLLESTLYESSVVPGPKKAPMDSLFDYGTYRHHSSDNKRWRKKIIEKQPQSPKAPAPQPPPILKVFNRPILFDIVSRGSTADLDGLLPFLLTHKKRLTDEEFREPSTGKTCLPKALLNLSNGRNDTIPVLLDIAERTGNMREFINSPFRDIYYRGQTALHIAIERRCKHYVELLVAQGADVHAQARGRFFQPKDEGGYFYFGELPLSLAACTNQPHIVNYLTENPHKKADMRRQDSRGNTVLHALVAIADNTRENTKFVTKMYDLLLLKCARLFPDSNLEAVLNNDGLSPLMMAAKTGKIGNRHEMLAVEPINELLRDKWRKFGAVSFYINVVSYLCAMVIFTLTAYYQPLEGTPPYPYRTTVDYLRLAGEVITLFTGVLFFFTNIKDLFMKKCPGVNSLFIDGSFQLLYFIYSVLVIVSAALYLAGIEAYLAVMVFALVLGWMNALYFTRGLKLTGTYSIMIQKILFKDLFRFLLVYLLFMIGYASALVSLLNPCANMKVCNEDQTNCTVPTYPSCRDSETFSTFLLDLFKLTIGMGDLEMLSSTKYPVVFIILLVTYIILTFVLLLNMLIALMGETVGQVSKESKHIWKLQWATTILDIERSFPVFLRKAFRSGEMVTVGKSSDGTPDRRWCFRVDEVNWSHWNQNLGIINEDPGKNETYQYYGFSHTVGRLRRDRWSSVVPRVVELNKNSNPDEVVVPLDSMGNPRCDGHQQGYPRKWRTDDAPL

SEQ ID NO: 90397 - protein, 764 aa, Homo sapiens
  Payload ID: 18064
  Gene Name: transient receptor potential cation channel, subfamily V, member 4
  Uniprot ID: Q9HBA0
  ENSP ID: ENSP00000443611
MADSSEGPRAGPGEVAELPGDESGTPGGEAFPLSSLANLFEGEDGSLSPSPADASRPAGPGDGRPNLRMKFQGAFRKGVPNPIDLLESTLYESSVVPGPKKAPMDSLFDYGTYRHHSSDNKRWRKKIIEKQPQSPKAPAPQPPPILKVFNRPILFDIVSRGSTADLDGLLPFLLTHKKRLTDEEFREPSTGKTCLPKALLNLSNGRNDTIPVLLDIAERTGNMREFINSPFRDIYYRGELPLSLAACTNQPHIVNYLTENPHKKADMRRQDSRGNTVLHALVAIADNTRENTKFVTKMYDLLLLKCARLFPDSNLEAVLNNDGLSPLMMAAKTGKIGNRHEMLAVEPINELLRDKWRKFGAVSFYINVVSYLCAMVIFTLTAYYQPLEGTPPYPYRTTVDYLRLAGEVITLFTGVLFFFTNIKDLFMKKCPGVNSLFIDGSFQLLYFIYSVLVIVSAALYLAGIEAYLAVMVFALVLGWMNALYFTRGLKLTGTYSIMIQKILFKDLFRFLLVYLLFMIGYASALVSLLNPCANMKVCNEDQTNCTVPTYPSCRDSETFSTFLLDLFKLTIGMGDLEMLSSTKYPVVFIILLVTYIILTFVLLLNMLIALMGETVGQVSKESKHIWKLQWATTILDIERSFPVFLRKAFRSGEMVTVGKSSDGTPDRRWCFRVDEVNWSHWNQNLGIINEDPGKNETYQYYGFSHTVGRLRRDRWSSVVPRVVELNKNSNPDEVVVPLDSMGNPRCDGHQQGYPRKWRTDDAPL

SEQ ID NO: 90398 - protein, 837 aa, Homo sapiens
  Payload ID: 18064
  Gene Name: transient receptor potential cation channel, subfamily V, member 4
  Uniprot ID: Q9HBA0
  ENSP ID: ENSP00000444336
MADSSEGPRAGPGEVAELPGDESGTPGDGRPNLRMKFQGAFRKGVPNPIDLLESTLYESSVVPGPKKAPMDSLFDYGTYRHHSSDNKRWRKKIIEKQPQSPKAPAPQPPPILKVFNRPILFDIVSRGSTADLDGLLPFLLTHKKRLTDEEFREPSTGKTCLPKALLNLSNGRNDTIPVLLDIAERTGNMREFINSPFRDIYYRGQTALHIAIERRCKHYVELLVAQGADVHAQARGRFFQPKDEGGYFYFGELPLSLAACTNQPHIVNYLTENPHKKADMRRQDSRGNTVLHALVAIADNTRENTKFVTKMYDLLLLKCARLFPDSNLEAVLNNDGLSPLMMAAKTGKIGIFQHIIRREVTDEDTRHLSRKFKDWAYGPVYSSLYDLSSLDTCGEEASVLEILVYNSKIENRHEMLAVEPINELLRDKWRKFGAVSFYINVVSYLCAMVIFTLTAYYQPLEGTPPYPYRTTVDYLRLAGEVITLFTGVLFFFTNIKDLFMKKCPGVNSLFIDGSFQLLYFIYSVLVIVSAALYLAGIEAYLAVMVFALVLGWMNALYFTRGLKLTGTYSIMIQKILFKDLFRFLLVYLLFMIGYASALVSLLNPCANMKVCNEDQTNCTVPTYPSCRDSETFSTFLLDLFKLTIGMGDLEMLSSTKYPVVFIILLVTYIILTFVLLLNMLIALMGETVGQVSKESKHIWKLQWATTILDIERSFPVFLRKAFRSGEMVTVGKSSDGTPDRRWCFRVDEVNWSHWNQNLGIINEDPGKNETYQYYGFSHTVGRLRRDRWSSVVPRVVELNKNSNPDEVVVPLDSMGNPRCDGHQQGYPRKWRTDDAPL

SEQ ID NO: 90399 - protein, 729 aa, Homo sapiens
  Payload ID: 18065
  Gene Name: transient receptor potential cation channel, subfamily V, member 5
  ENSP ID: ENSP00000265310
MGGFLPKAEGPGSQLQKLLPSFLVREQDWDQHLDKLHMLQQKRILESPLLRASKENDLSVLRQLLLDCTCDVRQRGALGETALHIAALYDNLEAALVLMEAAPELVFEPTTCEAFAGQTALHIAVVNQNVNLVRALLTRRASVSARATGTAFRHSPRNLIYFGEHPLSFAACVNSEEIVRLLIEHGADIRAQDSLGNTVLHILILQPNKTFACQMYNLLLSYDGHGDHLQPLDLVPNHQGLTPFKLAGVEGNTVMFQHLMQKRRHIQWTYGPLTSILYDLTEIDSWGEELSFLELVVSSDKREARQILEQTPVKELVSFKWNKYGRPYFCILAALYLLYMICFTTCCVYRPLKFRGGNRTHSRDITILQQKLLQEAYETREDIIRLVGELVSIVGAVIILLLEIPDIFRVGASRYFGKTILGGPFHVIIITYASLVLVTMVMRLTNTNGEVVPMSFALVLGWCSVMYFTRGFQMLGPFTIMIQKMIFGDLMRFCWLMAVVILGFASAFYIIFQTEDPTSLGQFYDYPMALFTTFELFLTVIDAPANYDVDLPFMFSIVNFAFTIIATLLMLNLFIAMMGDTHWRVAQERDELWRAQVVATTVMLERKLPRCLWPRSGICGCEFGLGDRWFLRVENHNDQNPLRVLRYVEVFKNSDKEDDQEHPSEKQPSGAESGTLARASLALPTSSLSRTASQSSSHRGWEILRQNTLGHLNLGLNLSEGDGEEVYHF

SEQ ID NO: 90400 - protein, 674 aa, Homo sapiens
  Payload ID: 18065
  Gene Name: transient receptor potential cation channel, subfamily V, member 5
  ENSP ID: ENSP00000406361
KAEGPGSQLQKLLPSFLVREQDWDQHLDKLHMLQQKRILESPLLRASKENDLSVLRQLLLDCTCDVRQRGALGETALHIAALYDNLEAALVLMEAAPELVFEPTTCEAFAGQTALHIAVVNQNVNLVRALLTRRASVSARATGTAFRHSPRNLIYFGEHPLSFAACVNSEEIVRLLIEHGADIRAQDSLGNTVLHILILQPNKTFACQMYNLLLSYDGHGDHLQPLDLVPNHQGLTPFKLAGVEGNTVARQILEQTPVKELVSFKWNKYGRPYFCILAALYLLYMICFTTCCVYRPLKFRGGNRTHSRDITILQQKLLQEAYETREDIIRLVGELVSIVGAVIILLLEIPDIFRVGASRYFGKTILGGPFHVIIITYASLVLVTMVMRLTNTNGEVVPMSFALVLGWCSVMYFTRGFQMLGPFTIMIQKMIFGDLMRFCWLMAVVILGFASAFYIIFQTEDPTSLGQFYDYPMALFTTFELFLTVIDAPANYDVDLPFMFSIVNFAFTIIATLLMLNLFIAMMGDTHWRVAQERDELWRAQVVATTVMLERKLPRCLWPRSGICGCEFGLGDRWFLRVENHNDQNPLRVLRYVEVFKNSDKEDDQEHPSEKQPSGAESGTLARASLALPTSSLSRTASQSSSHRGWEILRQNTLGHLNLGLNLSEGDGEEVYHF

SEQ ID NO: 90401 - protein, 381 aa, Homo sapiens
  Payload ID: 18065
  Gene Name: transient receptor potential cation channel, subfamily V, member 5
  Uniprot ID: Q9NQA5
  ENSP ID: ENSP00000406572
MGGFLPKAEGPGSQLQKLLPSFLVREQDWDQHLDKLHMLQQKRILESPLLRASKENDLSVLRQLLLDCTCDVRQRGALGETALHIAALYDNLEAALVLMEAAPELVFEPTTCEAFAGQTALHIAVVNQNVNLVRALLTRRASVSARATGTAFRHSPRNLIYFGEHPLSFAACVNSEEIVRLLIEHGADIRAQDSLGNTVLHILILQPNKTFACQMYNLLLSYDGHGDHLQPLDLVPNHQGLTPFKLAGVEGNTVMFQHLMQKRRHIQWTYGPLTSILYDLTEIDSWGEELSFLELVVSSDKREARQILEQTPVKELVSFKWNKYGRPYFCILAALYLLYMICFTTCCVYRPLKFRGGNRTHSRDITILQQKLLQVILLRRG

SEQ ID NO: 90402 - protein, 729 aa, Homo sapiens; identical to SEQ ID NO: 90399
  Payload ID: 18065
  Gene Name: transient receptor potential cation channel, subfamily V, member 5
  ENSP ID: ENSP00000483049

SEQ ID NO: 90403 - protein, 674 aa, Homo sapiens; identical to SEQ ID NO: 90400
  Payload ID: 18065
  Gene Name: transient receptor potential cation channel, subfamily V, member 5
  ENSP ID: ENSP00000488246

SEQ ID NO: 90404 - protein, 381 aa, Homo sapiens; identical to SEQ ID NO: 90401
  Payload ID: 18065
  Gene Name: transient receptor potential cation channel, subfamily V, member 5
  ENSP ID: ENSP00000488418

SEQ ID NO: 90405 - protein, 765 aa, Homo sapiens
  Payload ID: 18066
  Gene Name: transient receptor potential cation channel, subfamily V, member 6
  Uniprot ID: Q9H1D0
  ENSP ID: ENSP00000352358
TGPLQGDGGPALGGADVAPRLSPVRVWPRPQAPKEPALHPMGLSLPKEKGLILCLWSKFCRWFQRRESWAQSRDEQNLLQQKRIWESPLLLAAKDNDVQALNKLLKYEDCKVHQRGAMGETALHIAALYDNLEAAMVLMEAAPELVFEPMTSELYEGQTALHIAVVNQNMNLVRALLARRASVSARATGTAFRRSPCNLIYFGEHPLSFAACVNSEEIVRLLIEHGADIRAQDSLGNTVLHILILQPNKTFACQMYNLLLSYDRHGDHLQPLDLVPNHQGLTPFKLAGVEGNTVMFQHLMQKRKHTQWTYGPLTSTLYDLTEIDSSGDEQSLLELIITTKKREARQILDQTPVKELVSLKWKRYGRPYFCMLGAIYLLYIICFTMCCIYRPLKPRTNNRTSPRDNTLLQQKLLQEAYMTPKDDIRLVGELVTVIGAIIILLVEVPDIFRMGVTRFFGQTILGGPFHVLIITYAFMVLVTMVMRLISASGEVVPMSFALVLGWCNVMYFARGFQMLGPFTIMIQKMIFGDLMRFCWLMAVVILGFASAFYIIFQTEDPEELGHFYDYPMALFSTFELFLTIIDGPANYNVDLPFMYSITYAAFAIIATLLMLNLLIAMMGDTHWRVAHERDELWRAQIVATTVMLERKLPRCLWPRSGICGREYGLGDRWFLRVEDRQDLNRQRIQRYAQAFHTRGSEDLDKDSVEKLELGCPFSPHLSLPMPSVSRSTSRSSANWERLRQGTLRRDLRGIINRGLEDGESWEYQI

SEQ ID NO: 90406 - protein, 122 aa, Homo sapiens
  Payload ID: 18066
  Gene Name: transient receptor potential cation channel, subfamily V, member 6
  ENSP ID: ENSP00000411100
MTPKDDIRLVGELVTVIGAIIILLVEVPDIFRMGVTRFFGQTILGGPFHVLIITYAFMVLVTMVMRLISASGEVVPMSFALVLGWCNVMYFARGFQMLGPFTIMIQKMIFGDLMRFCWLMAV

SEQ ID NO: 90407 - protein, 56 aa, Homo sapiens
  Payload ID: 18066
  Gene Name: transient receptor potential cation channel, subfamily V, member 6
  ENSP ID: ENSP00000415917
MPGAMGETALHIAALYDNLEAAMVLMEAAPELVFEPMTSELYEGQTALHIAVVNQN

SEQ ID NO: 90408 - protein, 526 aa, Homo sapiens
  Payload ID: 18066
  Gene Name: transient receptor potential cation channel, subfamily V, member 6
  ENSP ID: ENSP00000479084
MNLVRALLARRASVSARATGTAFRRSPCNLIYFGEHPLSFAACVNSEEIVRLLIEHGADIRAQDSLGNTVLHILILQPNKTFACQMYNLLLSYDRHGDHLQPLDLVPNHQGLTPFKLAGVEGNTVMFQHLMQKRKHTQWTYGPLTSTLYDLTEIDSSGDEQSLLELIITTKKREARQILDQTPVKELVSLKWKRYGRPYFCMLGAIYLLYIICFTMCCIYRPLKPRTNNRTSPRDNTLLQQKLLQEAYMTPKDDIRLVGELVTVIGAIIILLVEVPDIFRMGVTRFFGQTILGGPFHVLIITYAFMVLVTMVMRLISASGEVVPMSFALVLGWCNVMYFARGFQMLGPFTIMIQKMIFGDLMRFCWLMAVVILGFASAFYIIFQTEDPEELGHFYDYPMALFSTFELFLTIIDGPANYNVDLPFMYSITYAAFAIIATLLMLNLLIAMMGDTHWRVAHERDELWRAQIVATTVMLERKLPRCLWPRSGICGREYGLGDRWFLRVEDRQDLNRQRIQRYAQAFHPGL

SEQ ID NO: 90409 - protein, 725 aa, Homo sapiens
  Payload ID: 18066
  Gene Name: transient receptor potential cation channel, subfamily V, member 6
  ENSP ID: ENSP00000479828
MGLSLPKEKGLILCLWSKFCRWFQRRESWAQSRDEQNLLQQKRIWESPLLLAAKDNDVQALNKLLKYEDCKVHQRGAMGETALHIAALYDNLEAAMVLMEAAPELVFEPMTSELYEGQTALHIAVVNQNMNLVRALLARRASVSARATGTAFRRSPRNLIYFGEHPLSFAACVNSEEIVRLLIEHGADIRAQDSLGNTVLHILILQPNKTFACQMYNLLLSYDRHGDHLQPLDLVPNHQGLTPFKLAGVEGNTVMFQHLMQKRKHTQWTYGPLTSTLYDLTEIDSSGDEQSLLELIITTKKREARQILDQTPVKELVSLKWKRYGRPYFCMLGAIYLLYIICFTMCCIYRPLKPRTNNRTSPRDNTLLQQKLLQEAYVTPKDDIRLVGELVTVIGAIIILLVEVPDIFRMGVTRFFGQTILGGPFHVLIITYAFMVLVTMVMRLISASGEVVPMSFALVLGWCNVMYFARGFQMLGPFTIMIQKMIFGDLMRFCWLMAVVILGFASAFYIIFQTEDPEELGHFYDYPMALFSTFELFLTIIDGPANYNVDLPFMYSITYAAFAIIATLLMLNLLIAMMGDTHWRVAHERDELWRAQVVATTVMLERKLPRCLWPRSGICGREYGLGDRWFLRVEDRQDLNRQRIQRYAQAFHTRGSEDLDKDSVEKLELGCPFSPHLSLPTPSVSRSTSRSSANWERLRQGTLRRDLRGIINRGLEDGESWEYQI

SEQ ID NO: 90410 - protein, 20 aa, Homo sapiens
  Payload ID: 18066
  Gene Name: transient receptor potential cation channel, subfamily V, member 6
  ENSP ID: ENSP00000487762
  MOD_RES (1)..(1): Any amino acid
XALNKLLKYEDCKVHQREAI

SEQ ID NO: 90411 - protein, 90 aa, Homo sapiens
  Payload ID: 18066
  Gene Name: transient receptor potential cation channel, subfamily V, member 6
  ENSP ID: ENSP00000488490
MGVTRFFGQTILGGPFHVLIITYAFMVLVTMVMRLISASGEVVPMSFALVLGWCNVMYFARGFQMLGPFTIMIQKMIFGDLMRFCWLMAV

SEQ ID NO: 90412 - protein, 55 aa, Homo sapiens
  Payload ID: 18067
  Gene Name: transition protein 1 (during histone to protamine replacement)
  Uniprot ID: P09430
  ENSP ID: ENSP00000236979
MSTSRKLKSHGMRRSKSRSPHKGVKRGGSKRKYRKGNLKSRKRGDDANRNYRSHL

SEQ ID NO: 90413 - protein, 138 aa, Homo sapiens
  Payload ID: 18068
  Gene Name: transition protein 2 (during histone to protamine replacement)
  Uniprot ID: Q05952
  ENSP ID: ENSP00000325738
MDTQTHSLPITHTQLHSNSQPQSRTCTRHCQTFSQSCRQSHRGSRSQSSSQSPASHRNPTGAHSSSGHQSQSPNTSPPPKRHKKTMNSHHSPMRPTILHCRCPKNRKNLEGKLKKKKMAKRIQQVYKTKTRSSGWKSN

SEQ ID NO: 90414 - protein, 457 aa, Homo sapiens
  Payload ID: 18069
  Gene Name: transketolase
  ENSP ID: ENSP00000296289
MAFASIYKLDNLVAILDINRLGQSDPAPLQHQMDIYQKRCEAFGWHAIIVDGHSVEELCKAFGQAKHQPTAIIAKTFKGRGITGVEDKESWHGKPLPKNMAEQIIQEIYSQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 90415 - protein, 631 aa, Homo sapiens
  Payload ID: 18069
  Gene Name: transketolase
  Uniprot ID: P29401
  ENSP ID: ENSP00000391481
MESYHKPDQQKLQALKDTANRLRISSIQATTAAGSGHPTSCCSAAEIMAVLFFHTMRYKSQDPRNPHNDRFVLSKGHAAPILYAVWAEAGFLAEAELLNLRKISSDLDGHPVPKQAFTDVATGSLGQGLGAACGMAYTGKYFDKASLPSSWDYSYRVYCLLGDGELSEGSVWEAMAFASIYKLDNLVAILDINRLGQSDPAPLQHQMDIYQKRCEAFGWHAIIVDGHSVEELCKAFGQAKHQPTAIIAKTFKGRGITGVEDKESWHGKPLPKNMAEQIIQEIYSQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 90416 - protein, 623 aa, Homo sapiens
  Payload ID: 18069
  Gene Name: transketolase
  Uniprot ID: P29401
  ENSP ID: ENSP00000405455
MESYHKPDQQKLQALKDTANRLRISSIQATTAAGSGHPTSCCSAAEIMAVLFFHTMRYKSQDPRNPHNDRFVLSKGHAAPILYAVWAEAGFLAEAELLNLRKISSDLDGHPVPKQAFTDVATGSLGQGLGAACGMAYTGKYFDKASYRVYCLLGDGELSEGSVWEAMAFASIYKLDNLVAILDINRLGQSDPAPLQHQMDIYQKRCEAFGWHAIIVDGHSVEELCKAFGQAKHQPTAIIAKTFKGRGITGVEDKESWHGKPLPKNMAEQIIQEIYSQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 90417 - protein, 153 aa, Homo sapiens
  Payload ID: 18069
  Gene Name: transketolase
  ENSP ID: ENSP00000413503
MESYHKPDQQKLQALKDTANRLRISSIQATTAAGSGHPTSCCSAAEIMAVLFFHTMRYKSQDPRNPHNDRFVLSKGHAAPILYAVWAEAGFLAEAELLNLRKISSDLDGHPVPKQAFTDVATGSLGQGLGAACGMAYTGKYFDKARHQSPGPE

SEQ ID NO: 90418 - protein, 81 aa, Homo sapiens
  Payload ID: 18069
  Gene Name: transketolase
  ENSP ID: ENSP00000417312
MESYHKPDQQKLQALKDTANRLRISSIQATTAAGSGCSVFSHDREFIEIPPHVMLQRRRDHGCPLFPHHALQVPGPPESAQ

SEQ ID NO: 90419 - protein, 623 aa, Homo sapiens; identical to SEQ ID NO: 90416
  Payload ID: 18069
  Gene Name: transketolase
  Uniprot ID: P29401
  ENSP ID: ENSP00000417773

SEQ ID NO: 90420 - protein, 334 aa, Homo sapiens
  Payload ID: 18069
  Gene Name: transketolase
  ENSP ID: ENSP00000418340
MESYHKPDQQKLQALKDTANRLRISSIQATTAAGSGHPTSCCSAAEIMAVLFFHTMRYKSQDPRNPHNDRFVLSKGHAAPILYAVWAEAGFLAEAELLNLRKISSDLDGHPVPKQAFTDVATGSLGQGLGAACGMAYTGKYFDKASYRVYCLLGDGELSEGSVWEAMAFASIYKLDNLVAILDINRLGQSDPAPLQHQMDIYQKRCEAFGWHAIIVDGHSVEELCKAFGQAKHQPTAIIAKTFKGRGITGVEDKESWHGKPLPKNMAEQIIQEIYSQIQSKKKILATPPQEDAPSVDIANIRMPSLPSYKVGDKVQNSHPQGLRAGTGQAGPCQ

SEQ ID NO: 90421 - protein, 540 aa, Homo sapiens
  Payload ID: 18070
  Gene Name: transketolase-like 1
  Uniprot ID: P51854
  ENSP ID: ENSP00000358928
MSVLFFYIMRYKQSDPENPDNDRFVLAKRLSFVDVATGWLGQGLGVACGMAYTGKYFDRASYRVFCLMSDGESSEGSVWEAMAFASYYSLDNLVAIFDVNRLGHSGALPAEHCINIYQRRCEAFGWNTYVVDGRDVEALCQVFWQASQVKHKPTAVVAKTFKGRGTPSIEDAESWHAKPMPRERADAIIKLIESQIQTSRNLDPQPPIEDSPEVNITDVRMTSPPDYRVGDKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 90422 - protein, 596 aa, Homo sapiens
  Payload ID: 18070
  Gene Name: transketolase-like 1
  Uniprot ID: P51854
  ENSP ID: ENSP00000358931
MADAEARAEFPEEARPDRGTLQVLQDMASRLRIHSIRATCSTSSGHPTSCSSSSEIMSVLFFYIMRYKQSDPENPDNDRFVLAKRLSFVDVATGWLGQGLGVACGMAYTGKYFDRASYRVFCLMSDGESSEGSVWEAMAFASYYSLDNLVAIFDVNRLGHSGALPAEHCINIYQRRCEAFGWNTYVVDGRDVEALCQVFWQASQVKHKPTAVVAKTFKGRGTPSIEDAESWHAKPMPRERADAIIKLIESQIQTSRNLDPQPPIEDSPEVNITDVRMTSPPDYRVGDKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 90423 - protein, 127 aa, Homo sapiens
  Payload ID: 18070
  Gene Name: transketolase-like 1
  ENSP ID: ENSP00000399763
MADAEARAEFPEEARPDRGTLQVLQDMASRLRIHSIRATCSTSSGHPTSCSSSSEIMSVLFFYIMRYKQSDPENPDNDRFVLAKRLSFVDVATGWLGQGLGVACGTLMWWTAGTWRHCARYSGRLLR

SEQ ID NO: 90424 - protein, 197 aa, Homo sapiens
  Payload ID: 18070
  Gene Name: transketolase-like 1
  ENSP ID: ENSP00000401111
MAFLIHNAPESSSACGKATDEFKHVKEYSCQRHKGNLPRVHGALRHPTSCSSSSEIMSVLFFYIMRYKQSDPENPDNDRFVLAKRLSFVDVATGWLGQGLGVACGMAYTGKYFDRASYRVFCLMSDGESSEGSVWEAMAFASYYSLDNLVAIFDVNRLGHSGALPAEHCINIYQRRCEAFGWNTYVVDGRDVEALCQ

SEQ ID NO: 90425 - protein, 175 aa, Homo sapiens
  Payload ID: 18070
  Gene Name: transketolase-like 1
  ENSP ID: ENSP00000416552
  MOD_RES (1)..(1): Any amino acid
XEAQRKLAPSPRCSAVRSWPHCAQGEGCHPTSCSSSSEIMSVLFFYIMRYKQSDPENPDNDRFVLAKRLSFVDVATGWLGQGLGVACGMAYTGKYFDRASYRVFCLMSDGESSEGSVWEAMAFASYYSLDNLVAIFDVNRLGHSGALPAEHCINIYQRRCEAFGWNTYVVDGRDV

SEQ ID NO: 90426 - protein, 626 aa, Homo sapiens
  Payload ID: 18071
  Gene Name: transketolase-like 2
  Uniprot ID: Q9H0I9
  ENSP ID: ENSP00000280605
MMANDAKPDVKTVQVLRDTANRLRIHSIRATCASGSGQLTSCCSAAEVVSVLFFHTMKYKQTDPEHPDNDRFILSRGHAAPILYAAWVEVGDISESDLLNLRKLHSDLERHPTPRLPFVDVATGSLGQGLGTACGMAYTGKYLDKASYRVFCLMGDGESSEGSVWEAFAFASHYNLDNLVAVFDVNRLGQSGPAPLEHGADIYQNCCEAFGWNTYLVDGHDVEALCQAFWQASQVKNKPTAIVAKTFKGRGIPNIEDAENWHGKPVPKERADAIVKLIESQIQTNENLIPKSPVEDSPQISITDIKMTSPPAYKVGDKIATQKTYGLALAKLGRANERVIVLSGDTMNSTFSEIFRKEHPERFIECIIAEQNMVSVALGCATRGRTIAFAGAFAAFFTRAFDQLRMGAISQANINLIGSHCGVSTGEDGVSQMALEDLAMFRSIPNCTVFYPSDAISTEHAIYLAANTKGMCFIRTSQPETAVIYTPQENFEIGQAKVVRHGVNDKVTVIGAGVTLHEALEAADHLSQQGISVRVIDPFTIKPLDAATIISSAKATGGRVITVEDHYREGGIGEAVCAAVSREPDILVHQLAVSGVPQRGKTSELLDMFGISTRHIIAAVTLTLMK

SEQ ID NO: 90427 - protein, 203 aa, Homo sapiens
  Payload ID: 18072
  Gene Name: translation machinery associated 16 homolog
  Uniprot ID: Q96EY4
  ENSP ID: ENSP00000351380
MPKAPKGKSAGREKKVIHPYSRKAAQITREAHKQEKKEKLKNEKALRLNLVGEKLQWFQNHLDPQKKRYSKKDACELIERYLNRFSSELEQIELHNSIRDRQGRRHCSRETVIKQTMERERQQFEGYGLEIPDILNASNLKTFREWDFDLKKLPNIKMRKICANDAIPKTCKRKTIITVDQDLGELELNDESSDSDEEMTAVA

SEQ ID NO: 90428 - protein, 144 aa, Homo sapiens
  Payload ID: 18072
  Gene Name: translation machinery associated 16 homolog
  ENSP ID: ENSP00000423375
MPKAPKGKSAGREKKVIHPYSRKAAQITREAHKQEKKEKLKNEKALRLNLVGEKLQWFQNHLDPQKKRYSKKDACELIERYLNRFSSELEQIELHNSIRDRQGRRHCSRETVIKQTMERERQQFEGYGLEIPDILNASNLKTFR

SEQ ID NO: 90429 - protein, 101 aa, Homo sapiens
  Payload ID: 18072
  Gene Name: translation machinery associated 16 homolog
  ENSP ID: ENSP00000423901
MPKAPKGKSAGREKKVIHPYSRKAAQITREAHKQEKKEKLKNEKALRLNLVGEKLQWFQNHLDPQKKRYSKKDACELIERIRENVIRSLYTFLDYRLLFIF

SEQ ID NO: 90430 - protein, 242 aa, Homo sapiens
  Payload ID: 18072
  Gene Name: translation machinery associated 16 homolog
  ENSP ID: ENSP00000425347
  MOD_RES (1)..(1): Any amino acid
XGRKRVASPPGLQSPASHSAPGRVQPPAASSLPPLPASTQPKAPKGKSAGREKKVIHPYSRKAAQITREAHKQEKKEKLKNEKALRLNLVGEKLQWFQNHLDPQKKRYSKKDACELIERYLNRFSSELEQIELHNSIRDRQGRRHCSRETVIKQTMERERQQFEGYGLEIPDILNASNLKTFREWDFDLKKLPNIKMRKICANDAIPKTCKRKTIITVDQDLGELELNDESSDSDEEMTAVA

SEQ ID NO: 90431 - protein, 88 aa, Homo sapiens
  Payload ID: 18072
  Gene Name: translation machinery associated 16 homolog
  ENSP ID: ENSP00000426933
MPKAPKGKSAGREKKVIHPYSRKAAQITREAHKQEKKEKLKNEKALRLNLVGEKLQWFQNHLDPQKKRYSKKDACELIERDSRHSKCK

SEQ ID NO: 90432 - protein, 64 aa, Homo sapiens
  Payload ID: 18073
  Gene Name: translation machinery associated 7 homolog
  Uniprot ID: Q9Y2S6
  ENSP ID: ENSP00000397843
MSGREGGKKKPLKQPKKQAKEMDEEDKAFKQKQKEEQKKLEELKAKAAGKGPLATGGIKKSGKK

SEQ ID NO: 90433 - protein, 297 aa, Homo sapiens
  Payload ID: 18074
  Gene Name: translational activator of mitochondrially encoded cytochrome c oxidase I
  Uniprot ID: Q9BSH4
  ENSP ID: ENSP00000258975
MSAWAAASLSRAAARCLLARGPGVRAAPPRDPRPSHPEPRGCGAAPGRTLHFTAAVPAGHNKWSKVRHIKGPKDVERSRIFSKLCLNIRLAVKEGGPNPEHNSNLANILEVCRSKHMPKSTIETALKMEKSKDTYLLYEGRGPGGSSLLIEALSNSSHKCQADIRHILNKNGGVMAVGARHSFDKKGVIVVEVEDREKKAVNLERALEMAIEAGAEDVKETEDEEERNVFKFICDASSLHQVRKKLDSLGLCSVSCALEFIPNSKVQLAEPDLEQAAHLIQALSNHEDVIHVYDNIE

SEQ ID NO: 90434 - protein, 228 aa, Homo sapiens
  Payload ID: 18075
  Gene Name: translin
  Uniprot ID: Q15631
  ENSP ID: ENSP00000374332
MSVSEIFVELQGFLAAEQDIREEIRKVVQSLEQTAREILTLLQGVHQGAGFQDIPKRCLKAREHFGTVKTHLTSLKTKFPAEQYYRFHEHWRFVLQRLVFLAAFVVYLETETLVTREAVTEILGIEPDREKGFHLDVEDYLSGVLILASELSRLSVNSVTAGDYSRPLHISTFINELDSGFRLLNLKNDSLRKRYDGLKYDVKKVEEVVYDLSIRGFNKETAAACVEK

SEQ ID NO: 90435 - protein, 223 aa, Homo sapiens
  Payload ID: 18075
  Gene Name: translin
  ENSP ID: ENSP00000387263
MPVIPAFWEAEAARSPEEIRKVVQSLEQTAREILTLLQGVHQGAGFQDIPKRCLKAREHFGTVKTHLTSLKTKFPAEQYYRFHEHWRFVLQRLVFLAAFVVYLETETLVTREAVTEILGIEPDREKGFHLDVEDYLSGVLILASELSRLSVNSVTAGDYSRPLHISTFINELDSGFRLLNLKNDSLRKRYDGLKYDVKKVEEVVYDLSIRGFNKETAAACVEK

SEQ ID NO: 90436 - protein, 185 aa, Homo sapiens
  Payload ID: 18075
  Gene Name: translin
  ENSP ID: ENSP00000399735
  MOD_RES (1)..(1): Any amino acid
XEVVPRDWERRESRGGATWGVTRSGGRGEIRKVVQSLEQTAREILTLLQGVHQGAGFQDIPKRCLKAREHFGTVKTHLTSLKTKFPAEQYYRFHEHWRFVLQRLVFLAAFVVYLETETLVTREAVTEILGIEPDREKGFHLDVEDYLSGVLILASELSRLSVNSVTAGDYSRPLHISTFINELDS

SEQ ID NO: 90437 - protein, 148 aa, Homo sapiens
  Payload ID: 18075
  Gene Name: translin
  Uniprot ID: Q15631
  ENSP ID: ENSP00000437728
MSVSEIFVELQGFLAAEQDIREEIRKVVQSLEQTAREILTLLQGVHQGAGFQDIPKRCLKAREHFGTVKTHLTSLKTKFPAEQYYRFHEHWRFVLQRLVFLAAFVVYLETETLVTREAVTEILGIEAVCQQRDCWRLLPTPPHLHLHQ

SEQ ID NO: 90438 - protein, 92 aa, Homo sapiens
  Payload ID: 18075
  Gene Name: translin
  ENSP ID: ENSP00000487702
MSVSEIFVELQGFLAAEQDIREEIRKVVQSLEQTAREILTLLQGVHQGAGFQDSKFFVLYPIISLLFRGRVSIQKTFYNEKWLSCFMFQRGV

SEQ ID NO: 90439 - protein, 36 aa, Homo sapiens
  Payload ID: 18075
  Gene Name: translin
  ENSP ID: ENSP00000487808
MSVSEIFVELQGFLAAEQDIREASPLPSPFPLPFHA

SEQ ID NO: 90440 - protein, 36 aa, Homo sapiens; identical to SEQ ID NO: 90439
  Payload ID: 18075
  Gene Name: translin
  ENSP ID: ENSP00000487833

SEQ ID NO: 90441 - protein, 36 aa, Homo sapiens; identical to SEQ ID NO: 90439
  Payload ID: 18075
  Gene Name: translin
  ENSP ID: ENSP00000488237

SEQ ID NO: 90442 - protein, 290 aa, Homo sapiens
  Payload ID: 18076
  Gene Name: translin-associated factor X
  Uniprot ID: Q99598
  ENSP ID: ENSP00000355599
MSNKEGSGGFRKRKHDNFPHNQRREGKDVNSSSPVMLAFKSFQQELDARHDKYERLVKLSRDITVESKRTIFLLHRITSAPDMEDILTESEIKLDGVRQKIFQVAQELSGEDMHQFHRAITTGLQEYVEAVSFQHFIKTRSLISMDEINKQLIFTTEDNGKENKTPSSDAQDKQFGTWRLRVTPVDYLLGVADLTGELMRMCINSVGNGDIDTPFEVSQFLRQVYDGFSFIGNTGPYEVSKKLYTLKQSLAKVENACYALKVRGSEIPKHMLADVFSVKTEMIDQEEGIS

SEQ ID NO: 90443 - protein, 163 aa, Homo sapiens
  Payload ID: 18076
  Gene Name: translin-associated factor X
  ENSP ID: ENSP00000397537
MSNKEGSGGFRKRKHDNFPHNQRREGKDVNSSSPVMLAFKSFQQELDARHDKYERLVKLSRDITVESKRTIFLLHRITSSQYLDHSAPDMEDILTESEIKLDGVRQKIFQVAQELSGEDMHQFHRAITTGLQEYVEAVSFQHFIKTRSLISMDEINKQLIFTT

SEQ ID NO: 90444 - protein, 658 aa, Homo sapiens
  Payload ID: 18077
  Gene Name: translin-associated factor X interacting protein 1
  Uniprot ID: Q2TAA8
  ENSP ID: ENSP00000373485
MGGHLSPWPTYTSGQTILQNRKPCSDDYRKRVGSCQQHPFRTAKPQYLEELENYLRKELLLLDLGTDSTQELRLQPYREIFEFFIEDFKTYKPLLSSIKNAYEGMLAHQREKIRALEPLKAKLVTVNEDCNERILAMRAEEKYEISLLKKEKMNLLKLIDKKNEEKISLQSEVTKLRKNLAEEYLHYLSERDACKILIADLNELRYQREDMSLAQSPGIWGEDPVKLTLALKMTRQDLTRTQMELNNMKANFGDVVPRRDFEMQEKTNKDLQEQLDTLRASYEEVRKEHEILMQLHMSTLKERDQFFSELQEIQRTSTPRPDWTKCKDVVAGGPERWQMLAEGKNSDQLVDVLLEEIGSGLLREKDFFPGLGYGEAIPAFLRFDGLVENKKPSKKDVVNLLKDAWKERLAEEQKETFPDFFFNFLEHRFGPSDAMAWAYTIFENIKIFHSNEVMSQFYAVLMGKRSENVYVTQKETVAQLLKEMTNADSQNEGLLTMEQFNTVLKSTFPLKTEEQIQELMEAGGWHPSSSNADLLNYRSLFMEDEEGQSEPFVQKLWEQYMDEKDEYLQQLKQELGIELHEEVTLPKLRGGLMTIDPSLDKQTVNTYMSQAFQLPESEMPEEGDEKEEAVVEILQTALERLQVIDIRRVGPREPEPAS

SEQ ID NO: 90445 - protein, 428 aa, Homo sapiens
  Payload ID: 18077
  Gene Name: translin-associated factor X interacting protein 1
  ENSP ID: ENSP00000397147
RYHSFSSASRLQPRPSGVTIDESFLTEDKSTQNRKLLQKRRTLVTKLRKNLAEEYLHYLSERDACKILIADLNELRYQREDMSLAQSPGIWGEDPVKLTLALKMTRQDLTRTQMELNNMKANFGDVVPRRDFEMQEKTNKDLQEQLDTLRASYEEVRKEHEILMQLHMSTLKERDQFFSELQEIQRTSTPRPDWTKCKDVVAGGPERWQMLAEGKNSDQLVDVLLEEIGSGLLREKDFFPGLGYGEAIPAFLRFDGLVENKKPSKKDVVNLLKDAWKERLAEEQKETFPDFFFNFLEHRFGPSDAMAWAYTIFENIKIFHSNEVMSQFYAVLMGKRSENVYVTQKETVAQLLKEMTNADSQNEGLLTMEQFNTVLKSTFPLKTEEQIQELMEAGGWHPSSSNADLLNYRSLFMEDEEGQSEPFVQKLW

SEQ ID NO: 90446 - protein, 643 aa, Homo sapiens
  Payload ID: 18077
  Gene Name: translin-associated factor X interacting protein 1
  ENSP ID: ENSP00000411472
MACQQSRYHSFSSASRLQPRPSGVTIDESFLTEDKSTQNRKLLQKRRTLELPAAPLSHCQAPVLGGTGKLPTQGAPPAGPGHRFHPGTKAAAHQREKIRALEPLKAKLVTVNEDCNERILAMRAEEKYEISLLKKEKMNLLKLIDKKNEEKISLQSEVTKLRKNLAEEYLHYLSERDACKILIADLNELRYQREDMSLAQSPGIWGEDPVKLTLALKMTRQDLTRTQMELNNMKANFGDVVPRRDFEMQEKTNKDLQEQLDTLRASYEEVRKEHEILMQLHMSTLKERDQFFSELQEIQRTSTPRPDWTKCKDVVAGGPERWQMLAEGKNSDQLVDVLLEEIGSGLLREKDFFPGLGYGEAIPAFLRFDGLVENKKPSKKDVVNLLKDAWKERLAEEQKETFPDFFFNFLEHRFGPSDAMAWAYTIFENIKIFHSNEVMSQFYAVLMGKRSENVYVTQKETVAQLLKEMTNADSQNEGLLTMEQFNTVLKSTFPLKTEEQIQELMEAGGWHPSSSNADLLNYRSLFMEDEEGQSEPFVQKLWEQYMDEKDEYLQQLKQELGIELHEEVTLPKLRGGLMTIDPSLDKQTVNTYMSQAFQLPESEMPEEGDEKEEAVVEILQTALERLQVIDIRRVGPREPEPAS

SEQ ID NO: 90447 - protein, 171 aa, Homo sapiens
  Payload ID: 18077
  Gene Name: translin-associated factor X interacting protein 1
  ENSP ID: ENSP00000454989
MACQQSRYHSFSSASRLQPRPSGVTIDESFLTEDKSTQNRKLLQKRRTLTGQFSMGGHLSPWPTYTSGQTILQNRKPCSDDYRKRVGSCQQHPFRTAKPQYLEELENYLRKELLLLDLGTDSTQELRLQVTKLRKNLAEEYLHYLSERDACKILIADLNELRYQREDMSLA

SEQ ID NO: 90448 - protein, 97 aa, Homo sapiens
  Payload ID: 18077
  Gene Name: translin-associated factor X interacting protein 1
  ENSP ID: ENSP00000455011
MACQQSRYHSFSSASRLQPRPSGVTIDESFLTEDKSTQNRKLLQKRRTLELPAAPLSHCQAPVLGGTGKLPTQGAPPAGPGHRFHPGTKAAALQRDL

SEQ ID NO: 90449 - protein, 141 aa, Homo sapiens
  Payload ID: 18077
  Gene Name: translin-associated factor X interacting protein 1
  ENSP ID: ENSP00000455640
MACQQSRYHSFSSASRLQPRPSGVTIDESFLTEDKSTQNRKLLQKRRTLTGQFSMGGHLSPWPTYTSGQTILQNRKPCSDDYRKRVGSCQQHPFRTAKPQYLEELENYLRKELLLLDLGTDSTQELRLQPTKGRRFGLWSP

SEQ ID NO: 90450 - protein, 712 aa, Homo sapiens
  Payload ID: 18077
  Gene Name: translin-associated factor X interacting protein 1
  ENSP ID: ENSP00000457241
MACQQSRYHSFSSASRLQPRPSGVTIDESFLTEDKSTQNRKLLQKRRTLTGQFSMGGHLSPWPTYTSGQTILQNRKPCSDDYRKRVGSCQQHPFRTAKPQYLEELENYLRKELLLLDLGTDSTQELRLQPYREIFEFFIEDFKTYKPLLSSIKNAYEGMLAHQREKIRALEPLKAKLVTVNEDCNERILAMRAEEKYEISLLKKEKMNLLKLIDKKNEEKISLQSEVTKLRKNLAEEYLHYLSERDACKILIADLNELRYQREDMSLAQSPGIWGEDPVKLTLALKMTRQDLTRTQMELNNMKANFGDVVPRRDFEMQEKTNKDLQEQLDTLRASYEEVRKEHEILMQLHMSTLKERDQFFSELQEIQRTSTPRPDWTKCKDVVAGGPERWQMLAEGKNSDQLVDVLLEEIGSGLLREKDFFPGLGYGEAIPAFLRFDGLVENKKPSKKDVVNLLKDAWKERLAEEQKETFPDFFFNFLEHRFGPSDAMAWAYTIFENIKIFHSNEVMSQFYAVLMGKRSENVYVTQKETVAQLLKEMTNADSQNEGLLTMEQFNTVLKSTFPLKTEEQIQELMEAGGWHPSSSNADLLNYRSLFMEDEEGQSEPFVQKLWEQYMDEKDEYLQQLKQELGIELHEEVTLPKLRGGLMTIDPSLDKQTVNTYMSQAFQLPESEMPEEGDEKEEAVVEILQTALERLQVIDIRRVGPREPEPAS

SEQ ID NO: 90451 - protein, 61 aa, Homo sapiens
  Payload ID: 18077
  Gene Name: translin-associated factor X interacting protein 1
  ENSP ID: ENSP00000458938
MACQQSRYHSFSSASRLQPRPSGVTIDESFLTEDKSTQNRKLLQKRRTLPTKGRRFGLWSP

SEQ ID NO: 90452 - protein, 79 aa, Homo sapiens
  Payload ID: 18077
  Gene Name: translin-associated factor X interacting protein 1
  ENSP ID: ENSP00000463792
MRAEEKYEISLLKKEKMNLLKLIDKKNEEKISLQSEVTKLRKNLAEEYLHYLSERDACKILIADLNELRYQREDMSLAQ

SEQ ID NO: 90453 - protein, 123 aa, Homo sapiens
  Payload ID: 18077
  Gene Name: translin-associated factor X interacting protein 1
  ENSP ID: ENSP00000464527
  MOD_RES (1)..(1): Any amino acid
XQLKQELGIELHEEVTLPKLRGGLMTIDPSLDKQTVNTYMSQAFQLPESEMPEEGDEKEEAVVEILQTALERLQRGELSPKASRGKPNLTWRSQGSISQIPQKGTHVYSSAGWRSAGQARPLH

SEQ ID NO: 90454 - protein, 33 aa, Homo sapiens
  Payload ID: 18077
  Gene Name: translin-associated factor X interacting protein 1
  ENSP ID: ENSP00000464694
MRAEEKYEISLLKKEKMNLLKLIDKKNEEKISL

SEQ ID NO: 90455 - protein, 90 aa, Homo sapiens
  Payload ID: 18078
  Gene Name: translocase of inner mitochondrial membrane 10 homolog (yeast)
  Uniprot ID: P62072
  ENSP ID: ENSP00000257245
MDPLRAQQLAAELEVEMMADMYNRMTSACHRKCVPPHYKEAELSKGESVCLDRCVSKYLDIHERMGKKLTELSMQDEELMKRVQQSSGPA

SEQ ID NO: 90456 - protein, 90 aa, Homo sapiens; identical to SEQ ID NO: 90455
  Payload ID: 18078
  Gene Name: translocase of inner mitochondrial membrane 10 homolog (yeast)
  Uniprot ID: P62072
  ENSP ID: ENSP00000433627

SEQ ID NO: 90457 - protein, 90 aa, Homo sapiens; identical to SEQ ID NO: 90455
  Payload ID: 18078
  Gene Name: translocase of inner mitochondrial membrane 10 homolog (yeast)
  Uniprot ID: P62072
  ENSP ID: ENSP00000435678

SEQ ID NO: 90458 - protein, 103 aa, Homo sapiens; identical to SEQ ID NO: 51883
  Payload ID: 18079
  Gene Name: translocase of inner mitochondrial membrane 10 homolog B (yeast)
  Uniprot ID: Q9Y5J6
  ENSP ID: ENSP00000254616

SEQ ID NO: 90459 - protein, 71 aa, Homo sapiens; identical to SEQ ID NO: 51882
  Payload ID: 18079
  Gene Name: translocase of inner mitochondrial membrane 10 homolog B (yeast)
  ENSP ID: ENSP00000433087

SEQ ID NO: 90460 - protein, 71 aa, Homo sapiens; identical to SEQ ID NO: 51882
  Payload ID: 18079
  Gene Name: translocase of inner mitochondrial membrane 10 homolog B (yeast)
  ENSP ID: ENSP00000436579

SEQ ID NO: 90461 - protein, 103 aa, Homo sapiens; identical to SEQ ID NO: 51883
  Payload ID: 18079
  Gene Name: translocase of inner mitochondrial membrane 10 homolog B (yeast)
  Uniprot ID: Q9Y5J6
  ENSP ID: ENSP00000436948

SEQ ID NO: 90462 - protein, 95 aa, Homo sapiens
  Payload ID: 18080
  Gene Name: translocase of inner mitochondrial membrane 13 homolog (yeast)
  Uniprot ID: Q9Y5L4
  ENSP ID: ENSP00000215570
MEGGFGSDFGGSGSGKLDPGLIMEQVKVQIAVANAQELLQRMTDKCFRKCIGKPGGSLDNSEQKCIAMCMDRYMDAWNTVSRAYNSRLQRERANM

SEQ ID NO: 90463 - protein, 80 aa, Homo sapiens
  Payload ID: 18080
  Gene Name: translocase of inner mitochondrial membrane 13 homolog (yeast)
  ENSP ID: ENSP00000464881
MEGGFGSDFGGSGSGKLDPGLIMEQRMTDKCFRKCIGKPGGSLDNSEQKCIAMCMDRYMDAWNTVSRAYNSRLQRERANM

SEQ ID NO: 90464 - protein, 171 aa, Homo sapiens
  Payload ID: 18081
  Gene Name: translocase of inner mitochondrial membrane 17 homolog A (yeast)
  Uniprot ID: Q99595
  ENSP ID: ENSP00000356256
MEEYAREPCPWRIVDDCGGAFTMGTIGGGIFQAIKGFRNSPVGVNHRLRGSLTAIKTRAPQLGGSFAVWGGLFSMIDCSMVQVRGKEDPWNSITSGALTGAILAARNGPVAMVGSAAMGGILLALIEGAGILLTRFASAQFPNGPQFAEDPSQLPSTQLPSSPFGDYRQYQ

SEQ ID NO: 90465 - protein, 172 aa, Homo sapiens
  Payload ID: 18082
  Gene Name: translocase of inner mitochondrial membrane 17 homolog B (yeast)
  Uniprot ID: O60830
  ENSP ID: ENSP00000365766
MEEYAREPCPWRIVDDCGGAFTMGVIGGGVFQAIKGFRNAPVGIRHRLRGSANAVRIRAPQIGGSFAVWGGLFSTIDCGLVRLRGKEDPWNSITSGALTGAVLAARSGPLAMVGSAMMGGILLALIEGVGILLTRYTAQQFRNAPPFLEDPSQLPPKDGTPAPGYPSYQQYH

SEQ ID NO: 90466 - protein, 222 aa, Homo sapiens
  Payload ID: 18082
  Gene Name: translocase of inner mitochondrial membrane 17 homolog B (yeast)
  Uniprot ID: O60830
  ENSP ID: ENSP00000379999
MEEYAREPCPWRIVDDCGGAFTMGVIGGGVFQAIKGFRNAPVCRLLSEAPLFIYSCSRSVSPTVNVSSERAESRPTLFMAVSLHMAWCLAHIGIRHRLRGSANAVRIRAPQIGGSFAVWGGLFSTIDCGLVRLRGKEDPWNSITSGALTGAVLAARSGPLAMVGSAMMGGILLALIEGVGILLTRYTAQQFRNAPPFLEDPSQLPPKDGTPAPGYPSYQQYH

SEQ ID NO: 90467 - protein, 56 aa, Homo sapiens
  Payload ID: 18082
  Gene Name: translocase of inner mitochondrial membrane 17 homolog B (yeast)
  ENSP ID: ENSP00000476861
MEEYAREPCPWRIVDDCGGAFTMGVIGGGVFQAIKGFRNAPVRRGFNVLLRLVSNS

SEQ ID NO: 90468 - protein, 192 aa, Homo sapiens
  Payload ID: 18082
  Gene Name: translocase of inner mitochondrial membrane 17 homolog B (yeast)
  ENSP ID: ENSP00000477027
MIAVEPSLWVSSVAESSRPSRVSAMPLLSVSPTVNVSSERAESRPTLFMAVSLHMAWCLAHIGIRHRLRGSANAVRIRAPQIGGSFAVWGGLFSTIDCGLVRLRGKEDPWNSITSGALTGAVLAARSGPLAMVGSAMMGGILLALIEGVGILLTRYTAQQFRNAPPFLEDPSQLPPKDGTPAPGYPSYQQYH

SEQ ID NO: 90469 - protein, 222 aa, Homo sapiens; identical to SEQ ID NO: 90466
  Payload ID: 18082
  Gene Name: translocase of inner mitochondrial membrane 17 homolog B (yeast)
  Uniprot ID: O60830
  ENSP ID: ENSP00000477073

SEQ ID NO: 90470 - protein, 159 aa, Homo sapiens
  Payload ID: 18082
  Gene Name: translocase of inner mitochondrial membrane 17 homolog B (yeast)
  ENSP ID: ENSP00000477085
MRGHNQRSPWRIVDDCGGAFTMGVIGGGVFQAIKGFRNAPVCRLLSEAPLFIYSCSRSVSPTVNVSSERAESRPTLFMAVSLHMAWCLAHIGIRHRLRGSANAVRIRAPQIGGSFAVWGGLFSTIDCGLVRLRGKEDPWNSITSGALTGAVLAARSGPL

SEQ ID NO: 90471 - protein, 248 aa, Homo sapiens
  Payload ID: 18083
  Gene Name: translocase of inner mitochondrial membrane 21 homolog (yeast)
  Uniprot ID: Q9BVV7
  ENSP ID: ENSP00000169551
MICTFLRAVQYTEKLHRSSAKRLLLPYIVLNKACLKTEPSLRCGLQYQKKTLRPRCILGVTQKTIWTQGPSPRKAKEDGSKQVSVHRSQRGGTAVPTSQKVKEAGRDFTYLIVVLFGISITGGLFYTIFKELFSSSSPSKIYGRALEKCRSHPEVIGVFGESVKGYGEVTRRGRRQHVRFTEYVKDGLKHTCVKFYIEGSEPGKQGTVYAQVKENPGSGEYDFRYIFVEIESYPRRTIIIEDNRSQDD

SEQ ID NO: 90472 - protein, 172 aa, Homo sapiens
  Payload ID: 18083
  Gene Name: translocase of inner mitochondrial membrane 21 homolog (yeast)
  ENSP ID: ENSP00000462028
MICTFLRAVQYTEKLHRSSAKRLLLPYIVLNKACLKTEPSLRCGLQYQKKTLRPRCILGVTQKTIWTQGPSPRKAKEDGSKQVSVHRSQRGGTAVPTSQKVKEAGRDFTYLIVVLFGISITGGLFYTIFKELFSSSSPSKIYGRALEKCRSHPEGCSSHRPRSNVIARICSP

SEQ ID NO: 90473 - protein, 127 aa, Homo sapiens
  Payload ID: 18083
  Gene Name: translocase of inner mitochondrial membrane 21 homolog (yeast)
  ENSP ID: ENSP00000464228
  MOD_RES (1)..(1): Any amino acid
XIVVLFGISITGGLFYTIFKELFSSSSPSKIYGRALEKCRSHPEVIGVFGESVKGYGEVTRRGRRQHVRFTEYVKDGLKHTCVKFYIEGSEPGKQGTVYAQVKEVWESWDVGSEVLSAVLFKFWKGK

SEQ ID NO: 90474 - protein, 194 aa, Homo sapiens
  Payload ID: 18084
  Gene Name: translocase of inner mitochondrial membrane 22 homolog (yeast)
  Uniprot ID: Q9Y584
  ENSP ID: ENSP00000320236
MAAAAPNAGGSAPETAGSAEAPLQYSLLLQYLVGDKRQPRLLEPGSLGGIPSPAKSEEQKMIEKAMESCAFKAALACVGGFVLGGAFGVFTAGIDTNVGFDPKDPYRTPTAKEVLKDMGQRGMSYAKNFAIVGAMFSCTECLIESYRGTSDWKNSVISGCITGGAIGFRAGLKAGAIGCGGFAAFSAAIDYYLR

SEQ ID NO: 90475 - protein, 194 aa, Homo sapiens; identical to SEQ ID NO: 90474
  Payload ID: 18084
  Gene Name: translocase of inner mitochondrial membrane 22 homolog (yeast)
  Uniprot ID: Q9Y584
  ENSP ID: ENSP00000478463

SEQ ID NO: 90476 - protein, 194 aa, Homo sapiens; identical to SEQ ID NO: 90474
  Payload ID: 18084
  Gene Name: translocase of inner mitochondrial membrane 22 homolog (yeast)
  Uniprot ID: Q9Y584
  ENSP ID: ENSP00000482204

SEQ ID NO: 90477 - protein, 209 aa, Homo sapiens
  Payload ID: 18085
  Gene Name: translocase of inner mitochondrial membrane 23 homolog (yeast)
  Uniprot ID: O14925
  ENSP ID: ENSP00000464522
MEGGGGSGNKTTGGLAGFFGAGGAGYSHADLAGVPLTGMNPLSPYLNVDPRYLVQDTDEFILPTGANKTRGRFELAFFTIGGCCMTGAAFGAMNGLRLGLKETQNMAWSKPRNVQILNMVTRQGALWANTLGSLALLYSAFGVIIEKTRGAEDDLNTVAAGTMTGMLYKCTGGLRGIARGGLTGLTLTSLYALYNNWEHMKGSLLQQSL

SEQ ID NO: 90478 - protein, 188 aa, Homo sapiens
  Payload ID: 18086
  Gene Name: translocase of inner mitochondrial membrane 23 homolog B (yeast)
  Uniprot ID: Q5SRD1
  ENSP ID: ENSP00000363211
MEGGGGSGDKTTGVLAGFFGAGEAGYSHADLAGVPLTGMNPLCPYLNVDPRYLVQDTDEFILPTGANKTWGRFELAFFTIGGCCMTGAAFGAMNGLRLGLKETQNMAWSKPGNVQILNMVTRQGALWANTLGSLALLYSAFGVIIEKTRGAEDDLNTVAAGTMTGMLYKCTVSEMALDSPFCVLLSGS

SEQ ID NO: 90479 - protein, 140 aa, Homo sapiens
  Payload ID: 18086
  Gene Name: translocase of inner mitochondrial membrane 23 homolog B (yeast)
  ENSP ID: ENSP00000389331
MEGGGGSGDKTTGVLAGFFGAGEAGYSHADLAGVPLTGMNPLCPYLNVDPRYLVQDTDEFILPTGANKTWGRFELAFFTIGGCCMTALLYSAFGVIIEKTRGAEDDLNTVAAGTMTGMLYKCTVSEMALDSPFCVLLSGS

SEQ ID NO: 90480 - protein, 38 aa, Homo sapiens
  Payload ID: 18086
  Gene Name: translocase of inner mitochondrial membrane 23 homolog B (yeast)
  ENSP ID: ENSP00000470535
MEGGGGSGDKTTGVLAGFFGAGEAGYSHADLAGVPRYR

SEQ ID NO: 90481 - protein, 99 aa, Homo sapiens
  Payload ID: 18086
  Gene Name: translocase of inner mitochondrial membrane 23 homolog B (yeast)
  ENSP ID: ENSP00000473724
MEGGGGSGDKTTGVLAGFFGAGEAGYSHADLAGVPQSGPRSVTHVGVRWHDYSSLKPGTPELKQSSPLSLLSSWESSNWYEPSVSLFKCGSTIPRAGYR

SEQ ID NO: 90482 - protein, 452 aa, Homo sapiens
  Payload ID: 18087
  Gene Name: translocase of inner mitochondrial membrane 44 homolog (yeast)
  Uniprot ID: O43615
  ENSP ID: ENSP00000270538
MAAAALRSGWCRCPRRCLGSGIQFLSSHNLPHGSTYQMRRPGGELPLSKSYSSGNRKGFLSGLLDNVKQELAKNKEMKESIKKFRDEARRLEESDVLQEARRKYKTIESETVRTSEVLRKKLGELTGTVKESLHEVSKSDLGRKIKEGVEEAAKTAKQSAESVSKGGEKLGRTAAFRALSQGVESVKKEIDDSVLGQTGPYRRPQRLRKRTEFAGDKFKEEKVFEPNEEALGVVLHKDSKWYQQWKDFKENNVVFNRFFEMKMKYDESDNAFIRASRALTDKVTDLLGGLFSKTEMSEVLTEILRVDPAFDKDRFLKQCENDIIPNVLEAMISGELDILKDWCYEATYSQLAHPIQQAKALGLQFHSRILDIDNVDLAMGKMMEQGPVLIITFQAQLVMVVRNPKGEVVEGDPDKVLRMLYVWALCRDQDELNPYAAWRLLDISASSTEQIL

SEQ ID NO: 90483 - protein, 133 aa, Homo sapiens
  Payload ID: 18087
  Gene Name: translocase of inner mitochondrial membrane 44 homolog (yeast)
  ENSP ID: ENSP00000469273
LFSKTEMSEVLTEILRVDPAFDKDRFLKQCENDIIPNVLEAMISGELDILKDWCYEALAMGKMMEQGPVLIITFQAQLVMVVRNPKGEVVEGDPDKVLRMLYVWALCRDQDELNPYAAWRLLDISASSTEQIL

SEQ ID NO: 90484 - protein, 273 aa, Homo sapiens
  Payload ID: 18087
  Gene Name: translocase of inner mitochondrial membrane 44 homolog (yeast)
  ENSP ID: ENSP00000469389
MAAAALRSGWCRCPRSKSYSSGNRKGFLSGLLDNVKQELAKNKEMKESIKKFRDEARRLEESDVLQEARRKYKTIESETVRTSEVLRKKLGELTGTVKESLHEVSKSDLGRKIKEGVEEAAKTAKQSAESVSKGGEKLGRTAAFRALSQGVESVKKEIDDSVLGQTGPYRRPQRLRKRTEFAGDKFKEEKVFEPNEEALGVVLHKDSKWYQQWKDFKENNVVFNRFFEMKMKYDESDNAFIRASRALTDKVTDLLGGLFSKTEMSEVLTEILR

SEQ ID NO: 90485 - protein, 139 aa, Homo sapiens
  Payload ID: 18087
  Gene Name: translocase of inner mitochondrial membrane 44 homolog (yeast)
  ENSP ID: ENSP00000471596
MAAAALRSGWCRCPRRCLGSGIQFLSSHNLPHGSTYQMRRPGGELPLSKSYSSGNRKGFLSGLLDNVKQELAKNKEMKESIKKFRDEARRLEESDVLQEARRKYEEVAVSRERATVLQPRQRRHCLKKKKKKKDTALFT

SEQ ID NO: 90486 - protein, 126 aa, Homo sapiens
  Payload ID: 18087
  Gene Name: translocase of inner mitochondrial membrane 44 homolog (yeast)
  ENSP ID: ENSP00000472916
  MOD_RES (1)..(1): Any amino acid
XRSGWCRCPRRCLGSGIQFLSSHNLPHGSTYQMRRPGGELPLSKSYSSGNRKGFLSGLLDNVKQELAKNKEMKESIKKFRDEARRLEESDVLQEARRKYKTIESETVRTSEVLRKKLGELTGTVKE

SEQ ID NO: 90487 - protein, 456 aa, Homo sapiens
  Payload ID: 18088
  Gene Name: translocase of inner mitochondrial membrane 50 homolog (S. cerevisiae)
  Uniprot ID: Q3ZCQ8
  ENSP ID: ENSP00000318115
MASALSLGNKCDPFLRCVLCRGGGALQGPRGRGPDDFESQLSPPGSARRLVRSKRACGNPPDAFGLSRASVHPPLPRVSIGCSSGPGRAKRERVGGAAWRQRKMAASAAVFSRLRSGLRLGSRGLCTRLATPPRRAPDQAAEIGSRGSTKAQGPQQQPGSEGPSYAKKVALWLAGLLGAGGTVSVVYIFGNNPVDENGAKIPDEFDNDPILVQQLRRTYKYFKDYRQMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 90488 - protein, 456 aa, Homo sapiens; identical to SEQ ID NO: 90487
  Payload ID: 18088
  Gene Name: translocase of inner mitochondrial membrane 50 homolog (S. cerevisiae)
  Uniprot ID: Q3ZCQ8
  ENSP ID: ENSP00000445806

SEQ ID NO: 90489 - protein, 111 aa, Homo sapiens
  Payload ID: 18088
  Gene Name: translocase of inner mitochondrial membrane 50 homolog (S. cerevisiae)
  ENSP ID: ENSP00000469052
  MOD_RES (1)..(1): Any amino acid
XLRSGLRLGSRGLCTRLATPPRRAPDQAAEIGSRGSTKAQGPQQQPGSEGPSYAKKVALWLAGLLGAGGTVSVVYIFGNNPVDENGAKIPDEFDNETEFHHVGQDGLDLTS

SEQ ID NO: 90490 - protein, 257 aa, Homo sapiens
  Payload ID: 18088
  Gene Name: translocase of inner mitochondrial membrane 50 homolog (S. cerevisiae)
  ENSP ID: ENSP00000470896
  MOD_RES (1)..(1): Any amino acid
XAASAAVFSRLRSGLRLGSRGLCTRLATPPRRAPDQAAEIGSRGSTKAQGPQQQPGSEGPSYAKKVALWLAGLLGAGGTVSVVYIFGNNPVDENGAKMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLK

SEQ ID NO: 90491 - protein, 227 aa, Homo sapiens
  Payload ID: 18088
  Gene Name: translocase of inner mitochondrial membrane 50 homolog (S. cerevisiae)
  ENSP ID: ENSP00000470994
  MOD_RES (1)..(1): Any amino acid
XQVILEQEGPGTLESQSGRGSYFLCGVGGGEAAEIGSRGSTKAQGPQQQPGSEGPSYAKKVALWLAGLLGAGGTVSVVYIFGNNPVDENGAKIPDEFDNDPILVQQLRRTYKYFKDYRQMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVK

SEQ ID NO: 90492 - protein, 104 aa, Homo sapiens
  Payload ID: 18088
  Gene Name: translocase of inner mitochondrial membrane 50 homolog (S. cerevisiae)
  ENSP ID: ENSP00000471142
  MOD_RES (1)..(1): Any amino acid
XKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 90493 - protein, 256 aa, Homo sapiens
  Payload ID: 18088
  Gene Name: translocase of inner mitochondrial membrane 50 homolog (S. cerevisiae)
  ENSP ID: ENSP00000472184
MAASAAVFSRLRSGLRLGSRGLCTRLATPPRRAPDQAAEIGSRGSTKAQGPQQQPGSEGPSYAKKVALWLAGLLGAGGTVSVVYIFDPILVQQLRRTYKYFKDYRQMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDR

SEQ ID NO: 90494 - protein, 141 aa, Homo sapiens
  Payload ID: 18088
  Gene Name: translocase of inner mitochondrial membrane 50 homolog (S. cerevisiae)
  ENSP ID: ENSP00000472476
MAASAAVFSRLRSGLRLGSRGLCTRLATPPRRAPDQAAEIGSRGSTKAQGPQQQPGSEGPSYAKKVALWLAGLLGAGGTVSVVYIFGNNPVDENGAKIPDEFDNDDHRAHQPLPSPRPSAGTVLPATLHARFGAHRRPLAS

SEQ ID NO: 90495 - protein, 157 aa, Homo sapiens
  Payload ID: 18088
  Gene Name: translocase of inner mitochondrial membrane 50 homolog (S. cerevisiae)
  ENSP ID: ENSP00000472524
MAASAAVFSRLRSGLRLGSRGLCTRLATPPRRAPDQDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 90496 - protein, 200 aa, Homo sapiens
  Payload ID: 18088
  Gene Name: translocase of inner mitochondrial membrane 50 homolog (S. cerevisiae)
  ENSP ID: ENSP00000472723
MAASAAVFSRLRSGLRLGSRGLCTRLATPPRRAPDQETTRWTKMVPRFLMSSTMMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGN

SEQ ID NO: 90497 - protein, 116 aa, Homo sapiens
  Payload ID: 18088
  Gene Name: translocase of inner mitochondrial membrane 50 homolog (S. cerevisiae)
  ENSP ID: ENSP00000472904
  MOD_RES (1)..(1): Any amino acid
XLATPPRRAPDQAAEIGSRGSTKAQGPQQQPGSEGPSYAKKVALWLAGLLGAGGTVSVVYIFGNNPVDENGAKVRGKETEALPGVLVCGFLMSSTMIQFWYSSCAGHTNISKIIDR

SEQ ID NO: 90498 - protein, 117 aa, Homo sapiens
  Payload ID: 18088
  Gene Name: translocase of inner mitochondrial membrane 50 homolog (S. cerevisiae)
  ENSP ID: ENSP00000472920
  MOD_RES (1)..(1): Any amino acid
XLATPPRRAPDQAAEIGSRGSTKAQGPQQQPGSEGPSYAKKVALWLAGLLGAGGTVSVVYIFGNNPVDENGAKIPDEFDNDDHRAHQPLPSPRPSAGTVLPATLHARFGAHRRPLAS

SEQ ID NO: 90499 - protein, 353 aa, Homo sapiens
  Payload ID: 18088
  Gene Name: translocase of inner mitochondrial membrane 50 homolog (S. cerevisiae)
  Uniprot ID: Q3ZCQ8
  ENSP ID: ENSP00000475531
MAASAAVFSRLRSGLRLGSRGLCTRLATPPRRAPDQAAEIGSRGSTKAQGPQQQPGSEGPSYAKKVALWLAGLLGAGGTVSVVYIFGNNPVDENGAKIPDEFDNDPILVQQLRRTYKYFKDYRQMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 90500 - protein, 97 aa, Homo sapiens
  Payload ID: 18089
  Gene Name: translocase of inner mitochondrial membrane 8 homolog A (yeast)
  Uniprot ID: O60220
  ENSP ID: ENSP00000361993
MDSSSSSSAAGLGAVDPQLQHFIEVETQKQRFQQLVHQMTELCWEKCMDKPGPKLDSRAEACFVNCVERFIDTSQFILNRLEQTQKSKPVFSESLSD

SEQ ID NO: 90501 - protein, 32 aa, Homo sapiens
  Payload ID: 18090
  Gene Name: translocase of inner mitochondrial membrane 8 homolog B (yeast)
  ENSP ID: ENSP00000421964
MAELGEADEAELQRLVAAEQQKAQFTAQATCP

SEQ ID NO: 90502 - protein, 83 aa, Homo sapiens
  Payload ID: 18090
  Gene Name: translocase of inner mitochondrial membrane 8 homolog B (yeast)
  Uniprot ID: Q9Y5J9
  ENSP ID: ENSP00000422122
MAELGEADEAELQRLVAAEQQKAQFTAQVHHFMELCWDKCVEKPGNRLDSRTENCLSSCVDRFIDTTLAITSRFAQIVQKGGQ

SEQ ID NO: 90503 - protein, 98 aa, Homo sapiens
  Payload ID: 18090
  Gene Name: translocase of inner mitochondrial membrane 8 homolog B (yeast)
  ENSP ID: ENSP00000438455
MRKHSCRKVASLRRTMAELGEADEAELQRLVAAEQQKAQFTAQVHHFMELCWDKCVEKPGNRLDSRTENCLSSCVDRFIDTTLAITSRFAQIVQKGGQ

SEQ ID NO: 90504 - protein, 89 aa, Homo sapiens
  Payload ID: 18091
  Gene Name: translocase of inner mitochondrial membrane 9 homolog (yeast)
  Uniprot ID: Q9Y5J7
  ENSP ID: ENSP00000378588
MAAQIPESDQIKQFKEFLGTYNKLTETCFLDCVKDFTTREVKPEETTCSEHCLQKYLKMTQRISMRFQEYHIQQNEALAAKAGLLGQPR

SEQ ID NO: 90505 - protein, 44 aa, Homo sapiens
  Payload ID: 18091
  Gene Name: translocase of inner mitochondrial membrane 9 homolog (yeast)
  ENSP ID: ENSP00000450624
MAAQIPESDQIKQFKEFLGTYNKLTETCFLDCVKDFTTREVKPE

SEQ ID NO: 90506 - protein, 89 aa, Homo sapiens; identical to SEQ ID NO: 90504
  Payload ID: 18091
  Gene Name: translocase of inner mitochondrial membrane 9 homolog (yeast)
  Uniprot ID: Q9Y5J7
  ENSP ID: ENSP00000450638

SEQ ID NO: 90507 - protein, 89 aa, Homo sapiens; identical to SEQ ID NO: 90504
  Payload ID: 18091
  Gene Name: translocase of inner mitochondrial membrane 9 homolog (yeast)
  Uniprot ID: Q9Y5J7
  ENSP ID: ENSP00000451006

SEQ ID NO: 90508 - protein, 89 aa, Homo sapiens; identical to SEQ ID NO: 90504
  Payload ID: 18091
  Gene Name: translocase of inner mitochondrial membrane 9 homolog (yeast)
  Uniprot ID: Q9Y5J7
  ENSP ID: ENSP00000451198

SEQ ID NO: 90509 - protein, 66 aa, Homo sapiens
  Payload ID: 18091
  Gene Name: translocase of inner mitochondrial membrane 9 homolog (yeast)
  ENSP ID: ENSP00000452091
MAAQIPESDQIKQFKEFLGTYNKLTETCFLDCVKDFTTREVKPEEEYHIQQNEALAAKAGLLGQPR

SEQ ID NO: 90510 - protein, 175 aa, Homo sapiens
  Payload ID: 18092
  Gene Name: translocase of inner mitochondrial membrane domain containing 1
  ENSP ID: ENSP00000264244
MEVPPPAPRSFLCRALCLFPRVFAAEAVTADSEVLEERQKRLPYVPEPYYPESGWDRLRELFGKDEQQRISKDLANICKTAATAGIIGWVYGGIPAFIHAKQQYIEQSQAEIYHNRFDAVQSAHRAATRGFIRYGWRWGWRTAVFVTIFNTVNTSLNVYRNKDALSHFVIAGALL

SEQ ID NO: 90511 - protein, 71 aa, Homo sapiens
  Payload ID: 18092
  Gene Name: translocase of inner mitochondrial membrane domain containing 1
  ENSP ID: ENSP00000417083
MEVPPPAPRSFLCRALCLFPRVFAAEAVTADSEVLEERQKRLPYVPEPYYPESGWDRLRELFGKDCHGKSF

SEQ ID NO: 90512 - protein, 65 aa, Homo sapiens
  Payload ID: 18092
  Gene Name: translocase of inner mitochondrial membrane domain containing 1
  ENSP ID: ENSP00000417205
MEVPPPAPRSFLCRALCLFPRVFAAEAVTADSEVLEERQKRLPYVPEPYYPESGWDRLRELFGKE

SEQ ID NO: 90513 - protein, 285 aa, Homo sapiens
  Payload ID: 18092
  Gene Name: translocase of inner mitochondrial membrane domain containing 1
  Uniprot ID: Q9NPL8
  ENSP ID: ENSP00000418803
MEVPPPAPRSFLCRALCLFPRVFAAEAVTADSEVLEERQKRLPYVPEPYYPESGWDRLRELFGKDEQQRISKDLANICKTAATAGIIGWVYGGIPAFIHAKQQYIEQSQAEIYHNRFDAVQSAHRAATRGFIRYGWRWGWRTAVFVTIFNTVNTSLNVYRNKDALSHFVIAGAVTGSLFRINVGLRGLVAGGIIGALLGTPVGGLLMAFQKYSGETVQERKQKDRKALHELKLEEWKGRLQVTEHLPEKIESSLQEDEPENDAKKIEALLNLPRNPSVIDKQDKD

SEQ ID NO: 90514 - protein, 90 aa, Homo sapiens
  Payload ID: 18092
  Gene Name: translocase of inner mitochondrial membrane domain containing 1
  ENSP ID: ENSP00000418846
MEVPPPAPRSFLCRALCLFPRVFAAEAVTADSEVLEERQKRLPYVPEPYYPESGWDRLRELFGKDNLHIVLPHEASFVMAGAGVGELQCL

SEQ ID NO: 90515 - protein, 151 aa, Homo sapiens
  Payload ID: 18092
  Gene Name: translocase of inner mitochondrial membrane domain containing 1
  ENSP ID: ENSP00000419510
MEVPPPAPRSFLCRALCLFPRVFAAEAVTADSEVLEERQKRLPYVPEPYYPESGWDRLRELFGKDTPVGGLLMAFQKYSGETVQERKQKDRKALHELKLEEWKGRLQVTEHLPEKIESSLQEDEPENDAKKIEALLNLPRNPSVIDKQDKD

SEQ ID NO: 90516 - protein, 150 aa, Homo sapiens
  Payload ID: 18092
  Gene Name: translocase of inner mitochondrial membrane domain containing 1
  ENSP ID: ENSP00000420122
MEVPPPAPRSFLCRALCLFPRVFAAEAVTADSEVLEERQKRLPYVPEPYYPESGWDRLRELFGKDTVNTSLNVYRNKDALSHFVIAGAVTGSLFRINVGLRGLVAGGIIGALLGTPVGGLLMAFQKYSGETVQERKQKDRKALHELKLEE

SEQ ID NO: 90517 - protein, 38 aa, Homo sapiens
  Payload ID: 18092
  Gene Name: translocase of inner mitochondrial membrane domain containing 1
  ENSP ID: ENSP00000420812
  MOD_RES (1)..(1): Any amino acid
XTADSEVLEERQKRLPYVPEPYYPESGWDRLRELFGKE

SEQ ID NO: 90518 - protein, 145 aa, Homo sapiens
  Payload ID: 18093
  Gene Name: translocase of outer mitochondrial membrane 20 homolog (yeast)
  Uniprot ID: Q15388
  ENSP ID: ENSP00000355566
MVGRNSAIAAGVCGALFIGYCIYFDRKRRSDPNFKNRLRERRKKQKLAKERAGLSKLPDLKDAEAVQKFFLEEIQLGEELLAQGEYEKGVDHLTNAIAVCGQPQQLLQVLQQTLPPPVFQMLLTKLPTISQRIVSAQSLAEDDVE

SEQ ID NO: 90519 - protein, 152 aa, Homo sapiens
  Payload ID: 18094
  Gene Name: translocase of outer mitochondrial membrane 20 homolog (yeast)-like
  Uniprot ID: Q6UXN7
  ENSP ID: ENSP00000354204
MPSVRSLLRLLAAAAACGAFAFLGYCIYLNRKRRGDPAFKRRLRDKRRAEPQKAEEQGTQLWDPTKNKKLQELFLQEVRMGELWLSRGEHRMGIQHLGNALLVCEQPRELLKVFKHTLPPKVFEMLLHKIPLICQQFEADMNEQDCLEDDPD

SEQ ID NO: 90520 - protein, 74 aa, Homo sapiens
  Payload ID: 18094
  Gene Name: translocase of outer mitochondrial membrane 20 homolog (yeast)-like
  ENSP ID: ENSP00000451683
MPSVRSLLRLLAAAAACGAFAFLGYCIYLNRKRRGDPAFKRRLRDKRRAEPQKAEEQGTQESTEWGFNTSAMPF

SEQ ID NO: 90521 - protein, 142 aa, Homo sapiens
  Payload ID: 18095
  Gene Name: translocase of outer mitochondrial membrane 22 homolog (yeast)
  Uniprot ID: Q9NS69
  ENSP ID: ENSP00000216034
MAAAVAAAGAGEPQSPDELLPKGDAEKPEEELEEDDDEELDETLSERLWGLTEMFPERVRSAAGATFDLSLFVAQKMYRFSRAALWIGTTSFMILVLPVVFETEKLQMEQQQQLQQRQILLGPNTGLSGGMPGALPSLPGKI

SEQ ID NO: 90522 - protein, 309 aa, Homo sapiens
  Payload ID: 18096
  Gene Name: translocase of outer mitochondrial membrane 34
  Uniprot ID: Q15785
  ENSP ID: ENSP00000361900
MAPKFPDSVEELRAAGNESFRNGQYAEASALYGRALRVLQAQGSSDPEEESVLYSNRAACHLKDGNCRDCIKDCTSALALVPFSIKPLLRRASAYEALEKYPMAYVDYKTVLQIDDNVTSAVEGINRMTRALMDSLGPEWRLKLPSIPLVPVSAQKRWNSLPSENHKEMAKSKSKETTATKNRVPSAGDVEKARVLKEEGNELVKKGNHKKAIEKYSESLLCSNLESATYSNRALCYLVLKQYTEAVKDCTEALKLDGKNVKAFYRRAQAHKALKDYKSSFADISNLLQIEPRNGPAQKLRQEVKQNLH

SEQ ID NO: 90523 - protein, 361 aa, Homo sapiens
  Payload ID: 18097
  Gene Name: translocase of outer mitochondrial membrane 40 homolog (yeast)
  Uniprot ID: O96008
  ENSP ID: ENSP00000252487
MGNVLAASSPPAGPPPPPAPALVGLPPPPPSPPGFTLPPLGGSLGAGTSTSRSSERTPGAATASASGAAEDGACGCLPNPGTFEECHRKCKELFPIQMEGVKLTVNKGLSNHFQVNHTVALSTIGESNYHFGVTYVGTKQLSPTEAFPVLVGDMDNSGSLNAQVIHQLGPGLRSKMAIQTQQSKFVNWQVDGEYRGSDFTAAVTLGNPDVLVGSGILVAHYLQSITPCLALGGELVYHRRPGEEGTVMSLAGKYTLNNWLATVTLGQAGMHATYYHKASDQLQVGVEFEASTRMQDTSVSFGYQLDLPKANLLFKGSVDSNWIVGATLEKKLPPLPLTLALGAFLNHRKNKFQCGFGLTIG

SEQ ID NO: 90524 - protein, 361 aa, Homo sapiens; identical to SEQ ID NO: 90523
  Payload ID: 18097
  Gene Name: translocase of outer mitochondrial membrane 40 homolog (yeast)
  Uniprot ID: O96008
  ENSP ID: ENSP00000385184

SEQ ID NO: 90525 - protein, 361 aa, Homo sapiens; identical to SEQ ID NO: 90523
  Payload ID: 18097
  Gene Name: translocase of outer mitochondrial membrane 40 homolog (yeast)
  Uniprot ID: O96008
  ENSP ID: ENSP00000410339

SEQ ID NO: 90526 - protein, 214 aa, Homo sapiens
  Payload ID: 18097
  Gene Name: translocase of outer mitochondrial membrane 40 homolog (yeast)
  ENSP ID: ENSP00000465032
MGNVLAASSPPAGPPPPPAPALVGLPPPPPSPPGFTLPPLGGSLGAGTSTSRSSERTPGAATASASGAAEDGACGCLPNPGTFEECHRKCKELFPIQMEGVKLTVNKGLSNHFQVNHTVALSTIGESNYHFGVTYVGTKQLSPTEAFPVLVGDMDNSGSLNAQVIHQLGPGLRSKMAIQTQQSKFVNWQVDGEYRGSDFTAAVTLGNPDVLVGS

SEQ ID NO: 90527 - protein, 168 aa, Homo sapiens
  Payload ID: 18097
  Gene Name: translocase of outer mitochondrial membrane 40 homolog (yeast)
  ENSP ID: ENSP00000465608
  MOD_RES (1)..(1): Any amino acid
XQVIHQLGPGLRSKMAIQTQQSKFVNWQVDGEYRGSDFTAAVTLGNPDVLVGSGILVAHYLQSITPCLALGGELVYHRRPGEEGTVMSLAGKYTLNNWLATVTLGQAGMHATYYHKASDQLQVGVEFEASTRMQDTSVSFGYQLDLPKANLLFKGKGLGSPTRETGRR

SEQ ID NO: 90528 - protein, 36 aa, Homo sapiens
  Payload ID: 18097
  Gene Name: translocase of outer mitochondrial membrane 40 homolog (yeast)
  ENSP ID: ENSP00000465611
MGNVLAASSPPAGPPPPPAPALVGLPPPPPSPPGFT

SEQ ID NO: 90529 - protein, 329 aa, Homo sapiens
  Payload ID: 18097
  Gene Name: translocase of outer mitochondrial membrane 40 homolog (yeast)
  Uniprot ID: O96008
  ENSP ID: ENSP00000466084
MGNVLAASSPPAGPPPPPAPALVGLPPPPPSPPGFTLPPLGGSLGAGTSTSRSSERTPGAATASASGAAEDGACGCLPNPGTFEECHRKCKELFPIQMEGVKLTVNKGLSNHFQVNHTVALSTIGESNYHFGVTYVGTKQLSPTEAFPVLVGDMDNSGSLNAQVIHQLGPGLRSKMAIQTQQSKFVNWQVDGEYRGSDFTAAVTLGNPDVLVGSGILVAHYLQSITPCLALGGELVYHRRPGEEGTVMSLAGKYTLNNWLATVTLGQAGMHATYYHKASDQLQVGVEFEASTRMQDTSVSFGYQLDLPKANLLFKGKGLGSPTRETGRR

SEQ ID NO: 90530 - protein, 308 aa, Homo sapiens
  Payload ID: 18098
  Gene Name: translocase of outer mitochondrial membrane 40 homolog (yeast)-like
  Uniprot ID: Q969M1
  ENSP ID: ENSP00000356966
MGNTLGLAPMGTLPRRSPRREEPLPNPGSFDELHRLCKDVFPAQMEGVKLVVNKVLSSHFQVAHTIHMSALGLPGYHLHAAYAGDWQLSPTEVFPTVVGDMDSSGSLNAQVLLLLAERLRAKAVFQTQQAKFLTWQFDGEYRGDDYTATLTLGNPDLIGESVIMVAHFLQSLTHRLVLGGELVYHRRPGEEGAILTLAGKYSAVHWVATLNVGSGGAHASYYHRANEQVQVGVEFEANTRLQDTTFSFGYHLTLPQANMVFRGLVDSNWCVGAVLEKKMPPLPVTLALGAFLNHWRNRFHCGFSITVG

SEQ ID NO: 90531 - protein, 308 aa, Homo sapiens; identical to SEQ ID NO: 90530
  Payload ID: 18098
  Gene Name: translocase of outer mitochondrial membrane 40 homolog (yeast)-like
  Uniprot ID: Q969M1
  ENSP ID: ENSP00000356967

SEQ ID NO: 90532 - protein, 274 aa, Homo sapiens
  Payload ID: 18098
  Gene Name: translocase of outer mitochondrial membrane 40 homolog (yeast)-like
  Uniprot ID: Q969M1
  ENSP ID: ENSP00000443233
MGNTLGLAPMGTLPRRSPRREEPLPNPGSFDELHRLCKDVFPAQMEGVKLVVNKVLSSHFQVAHTIHMSALGLPGYHLHAAYAGDWQLSPTETQQAKFLTWQFDGEYRGDDYTATLTLGNPDLIGESVIMVAHFLQSLTHRLVLGGELVYHRRPGEEGAILTLAGKYSAVHWVATLNVGSGGAHASYYHRANEQVQVGVEFEANTRLQDTTFSFGYHLTLPQANMVFRGLVDSNWCVGAVLEKKMPPLPVTLALGAFLNHWRNRFHCGFSITVG

SEQ ID NO: 90533 - protein, 51 aa, Homo sapiens
  Payload ID: 18099
  Gene Name: translocase of outer mitochondrial membrane 5 homolog (yeast)
  Uniprot ID: Q8N4H5
  ENSP ID: ENSP00000313584
MFRIEGLAPKLDPEEMKRKMREDVISSIRNFLIYVALLRVTPFILKKLDSI

SEQ ID NO: 90534 - protein, 85 aa, Homo sapiens
  Payload ID: 18099
  Gene Name: translocase of outer mitochondrial membrane 5 homolog (yeast)
  Uniprot ID: Q8N4H5
  ENSP ID: ENSP00000367004
MFRIEGLAPKLDPEEMKRKMREDVISSIRNFLIYVALLRVSECLPGCDCETSGELTDGHPLTLRGHRGLRTELNAPFILKKLDSI

SEQ ID NO: 90535 - protein, 98 aa, Homo sapiens
  Payload ID: 18099
  Gene Name: translocase of outer mitochondrial membrane 5 homolog (yeast)
  ENSP ID: ENSP00000384411
MFRIEGLAPKLDPEEMKRKMREDVISSIRNFLIYVALLRVSECLPGCDCETSGELTDGHPLTLRGHRGLRTELNGSGEQGGSIYLKEIGQHMKTGHHI

SEQ ID NO: 90536 - protein, 92 aa, Homo sapiens
  Payload ID: 18099
  Gene Name: translocase of outer mitochondrial membrane 5 homolog (yeast)
  Uniprot ID: Q8N4H5
  ENSP ID: ENSP00000438204
MFRIEGLAPKLDPEEMKRKMREDVISSIRNFLIYVALLRVSECLPGCDCETSGELTDGHPLTLRGHRGLRTELNGSGEQGGCALKATGICAV

SEQ ID NO: 90537 - protein, 71 aa, Homo sapiens
  Payload ID: 18099
  Gene Name: translocase of outer mitochondrial membrane 5 homolog (yeast)
  ENSP ID: ENSP00000438585
EDVISSIRNFLIYVALLRVSECLPGCDCETSGELTDGHPLTLRGHRGLRTELNGSGEQGGCALKATGICAV

SEQ ID NO: 90538 - protein, 74 aa, Homo sapiens
  Payload ID: 18100
  Gene Name: translocase of outer mitochondrial membrane 6 homolog (yeast)
  Uniprot ID: Q96B49
  ENSP ID: ENSP00000381856
MASSTVPVSAAGSANETPEIPDNVGDWLRGVYRFATDRNDFRRNLILNLGLFAAGVWLARNLSDIDLMAPQPGV

SEQ ID NO: 90539 - protein, 74 aa, Homo sapiens; identical to SEQ ID NO: 90538
  Payload ID: 18100
  Gene Name: translocase of outer mitochondrial membrane 6 homolog (yeast)
  Uniprot ID: Q96B49
  ENSP ID: ENSP00000381859

SEQ ID NO: 90540 - protein, 55 aa, Homo sapiens
  Payload ID: 18101
  Gene Name: translocase of outer mitochondrial membrane 7 homolog (yeast)
  Uniprot ID: Q9P0U1
  ENSP ID: ENSP00000351214
MVKLSKEAKQRLQQLFKGSQFAIRWGFIPLVIYLGFKRGADPGMPEPTVLSLLWG

SEQ ID NO: 90541 - protein, 125 aa, Homo sapiens
  Payload ID: 18101
  Gene Name: translocase of outer mitochondrial membrane 7 homolog (yeast)
  ENSP ID: ENSP00000361970
MVKLSKEAKQRLQQLFKGSQFAIRWGFIPLVIYLGFKRGADPGMPEPTVLRVWWLTPVISALWKAKVGRSWEDCLKLGVQDQPGQRSETHLYQKKKTYFGDKGLFGLLDLEAISGQHGRCVLWLG

SEQ ID NO: 90542 - protein, 51 aa, Homo sapiens
  Payload ID: 18101
  Gene Name: translocase of outer mitochondrial membrane 7 homolog (yeast)
  ENSP ID: ENSP00000385203
MIIIIVVGCLCFLTCTMKGLDDFYYCPHFTGFKRGADPGMPEPTVLSLLWG

SEQ ID NO: 90543 - protein, 55 aa, Homo sapiens [sequence omitted]

SEQ ID NO: 90544 - protein, 608 aa, Homo sapiens
  Payload ID: 18102
  Gene Name: translocase of outer mitochondrial membrane 70 homolog A (S. cerevisiae)
  Uniprot ID: O94826
  ENSP ID: ENSP00000284320
MAASKPVEAAVVAAAVPSSGSGVGGGGTAGPGTGGLPRWQLALAVGAPLLLGAGAIYLWSRQQRRREARGRGDASGLKRNSERKTPEGRASPAPGSGHPEGPGAHLDMNSLDRAQAAKNKGNKYFKAGKYEQAIQCYTEAISLCPTEKNVDLSTFYQNRAAAFEQLQKWKEVAQDCTKAVELNPKYVKALFRRAKAHEKLDNKKECLEDVTAVCILEGFQNQQSMLLADKVLKLLGKEKAKEKYKNREPLMPSPQFIKSYFSSFTDDIISQPMLKGEKSDEDKDKEGEALEVKENSGYLKAKQYMEEENYDKIISECSKEIDAEGKYMAEALLLRATFYLLIGNANAAKPDLDKVISLKEANVKLRANALIKRGSMYMQQQQPLLSTQDFNMAADIDPQNADVYHHRGQLKILLDQVEEAVADFDECIRLRPESALAQAQKCFALYRQAYTGNNSSQIQAAMKGFEEVIKKFPRCAEGYALYAQALTDQQQFGKADEMYDKCIDLEPDNATTYVHKGLLQLQWKQDLDRGLELISKAIEIDNKCDFAYETMGTIEVQRGNMEKAIDMFNKAINLAKSEMEMAHLYSLCDAAHAQTEVAKKYGLKPPTL

SEQ ID NO: 90545 - protein, 2363 aa, Homo sapiens
  Payload ID: 18103
  Gene Name: translocated promoter region, nuclear basket protein
  Uniprot ID: P12270
  ENSP ID: ENSP00000356448
MAAVLQQVLERTELNKLPKSVQNKLEKFLADQQSEIDGLKGRHEKFKVESEQQYFEIEKRLSHSQERLVNETRECQSLRLELEKLNNQLKALTEKNKELEIAQDRNIAIQSQFTRTKEELEAEKRDLIRTNERLSQELEYLTEDVKRLNEKLKESNTTKGELQLKLDELQASDVSVKYREKRLEQEKELLHSQNTWLNTELKTKTDELLALGREKGNEILELKCNLENKKEEVSRLEEQMNGLKTSNEHLQKHVEDLLTKLKEAKEQQASMEEKFHNELNAHIKLSNLYKSAADDSEAKSNELTRAVEELHKLLKEAGEANKAIQDHLLEVEQSKDQMEKEMLEKIGRLEKELENANDLLSATKRKGAILSEEELAAMSPTAAAVAKIVKPGMKLTELYNAYVETQDQLLLEKLENKRINKYLDEIVKEVEAKAPILKRQREEYERAQKAVASLSVKLEQAMKEIQRLQEDTDKANKQSSVLERDNRRMEIQVKDLSQQIRVLLMELEEARGNHVIRDEEVSSADISSSSEVISQHLVSYRNIEELQQQNQRLLVALRELGETREREEQETTSSKITELQLKLESALTELEQLRKSRQHQMQLVDSIVRQRDMYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYEMLQDNVEGYRREITSLHERNQKLTATTQKQEQIINTMTQDLRGANEKLAVAEVRAENLKKEKEMLKLSEVRLSQQRESLLAEQRGQNLLLTNLQTIQGILERSETETKQRLSSQIEKLEHEISHLKKKLENEVEQRHTLTRNLDVQLLDTKRQLDTETNLHLNTKELLKNAQKEIATLKQHLSNMEVQVASQSSQRTGKGQPSNKEDVDDLVSQLRQTEEQVNDLKERLKTSTSNVEQYQAMVTSLEESLNKEKQVTEEVRKNIEVRLKESAEFQTQLEKKLMEVEKEKQELQDDKRRAIESMEQQLSELKKTLSSVQNEVQEALQRASTALSNEQQARRDCQEQAKIAVEAQNKYERELMLHAADVEALQAAKEQVSKMASVRQHLEETTQKAESQLLECKASWEERERMLKDEVSKCVCRCEDLEKQNRLLHDQIEKLSDKVVASVKEGVQGPLNVSLSEEGKSQEQILEILRFIRREKEIAETRFEVAQVESLRYRQRVELLERELQELQDSLNAEREKVQVTAKTMAQHEELMKKTETMNVVMETNKMLREEKERLEQDLQQMQAKVRKLELDILPLQEANAELSEKSGMLQAEKKLLEEDVKRWKARNQHLVSQQKDPDTEEYRKLLSEKEVHTKRIQQLTEEIGRLKAEIARSNASLTNNQNLIQSLKEDLNKVRTEKETIQKDLDAKIIDIQEKVKTITQVKKIGRRYKTQYEELKAQQDKVMETSAQSSGDHQEQHVSVQEMQELKETLNQAETKSKSLESQVENLQKTLSEKETEARNLQEQTVQLQSELSRLRQDLQDRTTQEEQLRQQITEKEEKTRKAIVAAKSKIAHLAGVKDQLTKENEELKQRNGALDQQKDELDVRITALKSQYEGRISRLERELREHQERHLEQRDEPQEPSNKVPEQQRQITLKTTPASGERGIASTSDPPTANIKPTPVVSTPSKVTAAAMAGNKSTPRASIRPMVTPATVTNPTTTPTATVMPTTQVESQEAMQSEGPVEHVPVFGSTSGSVRSTSPNVQPSISQPILTVQQQTQATAFVQPTQQSHPQIEPANQELSSNIVEVVQSSPVERPSTSTAVFGTVSATPSSSLPKRTREEEEDSTIEASDQVSDDTVEMPLPKKLKSVTPVGTEEEVMAEESTDGEVETQVYNQDSQDSIGEGVTQGDYTPMEDSEETSQSLQIDLGPLQSDQQTTTSSQDGQGKGDDVIVIDSDDEEEDDDENDGEHEDYEEDEEDDDDDEDDTGMGDEGEDSNEGTGSADGNDGYEADDAEGGDGTDPGTETEESMGGGEGNHRAADSQNSGEGNTGAAESSFSQEVSREQQPSSASERQAPRAPQSPRRPPHPLPPRLTIHAPPQELGPPVQRIQMTRRQSVGRGLQLTPGIGGMQQHFFDDEDRTVPSTPTLVVPHRTDGFAEAIHSPQVAGVPRFRFGPPEDMPQTSSSHSDLGQLASQGGLGMYETPLFLAHEEESGGRSVPTTPLQVAAPVTVFTESTTSDASEHASQSVPMVTTSTGTLSTTNETATGDDGDEVFVEAESEGISSEAGLEIDSQQEEEPVQASDESDLPSTSQDPPSSSSVDTSSSQPKPFRRVRLQTTLRQGVRGRQFNRQRGVSHAMGGRGGINRGNIN

SEQ ID NO: 90546 - protein, 150 aa, Homo sapiens
  Payload ID: 18103
  Gene Name: translocated promoter region, nuclear basket protein
  ENSP ID: ENSP00000408103
MPSSGSVSRSRQRGRSMASRGFDGSRRGSLRRAGAREPPSEVIEAAAQASGSCWSSPFFSASTPSAAATGVPGPTDMAAVLQQVLERTELNKLPKSVQNKLEKFLADQQSEIDGLKGRHEKFKVESEQQYFEIEKRLSHSQERLVNETRE

SEQ ID NO: 90547 - protein, 726 aa, Homo sapiens
  Payload ID: 18103
  Gene Name: translocated promoter region, nuclear basket protein
  Uniprot ID: P12270
  ENSP ID: ENSP00000483425
MAAVLQQVLERTELNKLPKSVQNKLEKFLADQQSEIDGLKGRHEKFKVESEQQYFEIEKRLSHSQERLVNETRECQSLRLELEKLNNQLKALTEKNKELEIAQDRNIAIQSQFTRTKEELEAEKRDLIRTNERLSQELEYLTEDVKRLNEKLKESNTTKGELQLKLDELQASDVSVKYREKRLEQEKELLHSQNTWLNTELKTKTDELLALGREKGNEILELKCNLENKKEEVSRLEEQMNGLKTSNEHLQKHVEDLLTKLKEAKEQQASMEEKFHNELNAHIKLSNLYKSAADDSEAKSNELTRAVEELHKLLKEAGEANKAIQDHLLEVEQSKDQMEKEMLEKIGRLEKELENANDLLSATKRKGAILSEEELAAMSPTAAAVAKIVKPGMKLTELYNAYVETQDQLLLEKLENKRINKYLDEIVKEVEAKAPILKRQREEYERAQKAVASLSVKLEQAMKEIQRLQEDTDKANKQSSVLERDNRRMEIQVKDLSQQIRVLLMELEEARGNHVIRDEEVSSADISSSSEVISQHLVSYRNIEELQQQNQRLLVALRELGETREREEQETTSSKITELQLKLESALTELEQLRKSRQHQMQLVDSIVRQRDMYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYL

SEQ ID NO: 90548 - protein, 374 aa, Homo sapiens
  Payload ID: 18104
  Gene Name: translocation associated membrane protein 1
  Uniprot ID: Q15629
  ENSP ID: ENSP00000262213
MAIRKKSTKSPPVLSHEFVLQNHADIVSCVAMVFLLGLMFEITAKASIIFVTLQYNVTLPATEEQATESVSLYYYGIKDLATVFFYMLVAIIIHAVIQEYMLDKINRRMHFSKTKHSKFNESGQLSAFYLFACVWGTFILISENYISDPTILWRAYPHNLMTFQMKFFYISQLAYWLHAFPELYFQKTKKEDIPRQLVYIGLYLFHIAGAYLLNLNHLGLVLLVLHYFVEFLFHISRLFYFSNEKYQKGFSLWAVLFVLGRLLTLILSVLTVGFGLARAENQKLDFSTGNFNVLAVRIAVLASICVTQAFMMWKFINFQLRRWREHSAFQAPAVKKKPTVTKGRSSKKGTENGVNGTLTSNVADSPRNKKEKSS

SEQ ID NO: 90549 - protein, 112 aa, Homo sapiens
  Payload ID: 18104
  Gene Name: translocation associated membrane protein 1
  ENSP ID: ENSP00000428025
MVFLLGLMFEITAKASIIFVTLQYNVTLPATEEQATESVSLYYYGIKDLATVFFYMLVAIIIHAVIQEYMLDKINRRMHFSKTKHSKFNESGQLSAFYLFACVWGTFILISV

SEQ ID NO: 90550 - protein, 288 aa, Homo sapiens
  Payload ID: 18104
  Gene Name: translocation associated membrane protein 1
  ENSP ID: ENSP00000428052
MLVAIIIHAVIQEYMLDKINRRMHFSKTKHSKFNESGQLSAFYLFACVWGTFILISENYISDPTILWRAYPHNLMTFQMKFFYISQLAYWLHAFPELYFQKTKKEDIPRQLVYIGLYLFHIAGAYLLNLNHLGLVLLVLHYFVEFLFHISRLFYFSNEKYQKGFSLWAVLFVLGRLLTLILSVLTVGFGLARAENQKLDFSTGNFNVLAVRIAVLASICVTQAFMMWKFINFQLRRWREHSAFQAPAVKKKPTVTKGRSSKKGTENGVNGTLTSNVADSPRNKKEKSS

SEQ ID NO: 90551 - protein, 369 aa, Homo sapiens
  Payload ID: 18105
  Gene Name: translocation associated membrane protein 1-like 1
  Uniprot ID: Q8N609
  ENSP ID: ENSP00000309402
MGLRKKSTKNPPVLSQEFILQNHADIVSCVGMFFLLGLVFEGTAEASIVFLTLQHSVAVPAAEEQATGSKSLYYYGVKDLATVFFYMLVAIIIHATIQEYVLDKINKRMQFTKAKQNKFNESGQFSVFYFFSCIWGTFILISENCLSDPTLIWKARPHSMMTFQMKFFYISQLAYWFHAFPELYFQKTKKQDIPRQLVYIGLHLFHITGAYLLYLNHLGLLLLVLHYFVELLSHMCGLFYFSDEKYQKGISLWAIVFILGRLVTLIVSVLTVGFHLAGSQNRNPDALTGNVNVLAAKIAVLSSSCTIQAYVTWNLITLWLQRWVEDSNIQASCMKKKRSRSSKKRTENGVGVETSNRVDCPPKRKEKSS

SEQ ID NO: 90552 - protein, 370 aa, Homo sapiens
  Payload ID: 18106
  Gene Name: translocation associated membrane protein 2
  Uniprot ID: Q15035
  ENSP ID: ENSP00000182527
MAFRRRTKSYPLFSQEFVIHNHADIGFCLVLCVLIGLMFEVTAKTAFLFILPQYNISVPTADSETVHYHYGPKDLVTILFYIFITIILHAVVQEYILDKISKRLHLSKVKHSKFNESGQLVVFHFTSVIWCFYVVVTEGYLTNPRSLWEDYPHVHLPFQVKFFYLCQLAYWLHALPELYFQKVRKEEIPRQLQYICLYLVHIAGAYLLNLSRLGLILLLLQYSTEFLFHTARLFYFADENNEKLFSAWAAVFGVTRLFILTLAVLAIGFGLARMENQAFDPEKGNFNTLFCRLCVLLLVCAAQAWLMWRFIHSQLRHWREYWNEQSAKRRVPATPRLPARLIKRESGYHENGVVKAENGTSPRTKKLKSP

SEQ ID NO: 90553 - protein, 169 aa, Homo sapiens
  Payload ID: 18107
  Gene Name: translocator protein (18kDa)
  Uniprot ID: P30536
  ENSP ID: ENSP00000328973
MAPPWVPAMGFTLAPSLGCFVGSRFVHGEGLRWYAGLQKPSWHPPHWVLGPVWGTLYSAMGYGSYLVWKELGGFTEKAVVPLGLYTGQLALNWAWPPIFFGARQMGWALVDLLLVSGAAAATTVAWYQVSPLAARLLYPYLAWLAFTTTLNYCVWRDNHGWRGGRRLPE

SEQ ID NO: 90554 - protein, 169 aa, Homo sapiens; identical to SEQ ID NO: 90553
  Payload ID: 18107
  Gene Name: translocator protein (18kDa)
  Uniprot ID: P30536
  ENSP ID: ENSP00000338004

SEQ ID NO: 90555 - protein, 169 aa, Homo sapiens; identical to SEQ ID NO: 90553
  Payload ID: 18107
  Gene Name: translocator protein (18kDa)
  Uniprot ID: P30536
  ENSP ID: ENSP00000379563

SEQ ID NO: 90556 - protein, 107 aa, Homo sapiens
  Payload ID: 18107
  Gene Name: translocator protein (18kDa)
  ENSP ID: ENSP00000405685
MAPPWVPAMGFTLAPSLGCFVGSRFVHGEGLRWYAGLQKPSWHPPHWVLGPVWGTLYSAMGYGSYLVWKELGGFTEKAVVPLGLYTGQLALNWAWPPIFFGARQMGW

SEQ ID NO: 90557 - protein, 65 aa, Homo sapiens
  Payload ID: 18107
  Gene Name: translocator protein (18kDa)
  ENSP ID: ENSP00000463495
MGWALVDLLLVSGAAAATTVAWYQVSPLAARLLYPYLAWLAFTTTLNYCVWRDNHGWRGGRRLPE

SEQ ID NO: 90558 - protein, 70 aa, Homo sapiens
  Payload ID: 18108
  Gene Name: translocator protein 2
  Uniprot ID: Q5TGU0
  ENSP ID: ENSP00000362252
MRLQGAIFVLLPHLGPILVWLFTRDHMSGWCEGPRMLSWCPFYKVLLLVQTAIYSVVGPCCTCCCCMGWW

SEQ ID NO: 90559 - protein, 170 aa, Homo sapiens
  Payload ID: 18108
  Gene Name: translocator protein 2
  Uniprot ID: Q5TGU0
  ENSP ID: ENSP00000362255
MRLQGAIFVLLPHLGPILVWLFTRDHMSGWCEGPRMLSWCPFYKVLLLVQTAIYSVVGYASYLVWKDLGGGLGWPLALPLGLYAVQLTISWTVLVLFFTVHNPGLALLHLLLLYGLVVSTALIWHPINKLAALLLLPYLAWLTVTSALTYHLWRDSLCPVHQPQPTEKSD

SEQ ID NO: 90560 - protein, 170 aa, Homo sapiens; identical to SEQ ID NO: 90559
  Payload ID: 18108
  Gene Name: translocator protein 2
  Uniprot ID: Q5TGU0
  ENSP ID: ENSP00000419985

SEQ ID NO: 90561 - protein, 348 aa, Homo sapiens
  Payload ID: 18109
  Gene Name: transmembrane (C-terminal) protease, serine 12
  Uniprot ID: Q86WS5
  ENSP ID: ENSP00000381476
MRLGLLSVALLFVGSSHLYSDHYSPSGRHRLGPSPEPAASSQQAEAVRKRLRRRREGGAHAEDCGTAPLKDVLQGSRIIGGTEAQAGAWPWVVSLQIKYGRVLVHVCGGTLVRERWVLTAAHCTKDASDPLMWTAVIGTNNIHGRYPHTKKIKIKAIIIHPNFILESYVNDIALFHLKKAVRYNDYIQPICLPFDVFQILDGNTKCFISGWGRTKEEGNATNILQDAEVHYISREMCNSERSYGGIIPNTSFCAGDEDGAFDTCRGDSGGPLMCYLPEYKRFFVMGITSYGHGCGRRGFPGVYIGPSFYQKWLTEHFFHASTQGILTINILRGQILIALCFVILLATT

SEQ ID NO: 90562 - protein, 320 aa, Homo sapiens
  Payload ID: 18109
  Gene Name: transmembrane (C-terminal) protease, serine 12
  ENSP ID: ENSP00000447259
MRLGLLSVALLFVGSSHLYSDHYSPSGRHRLGPSPEPAASSQQAEAVRKRLRRRREGGAHAEDCGTAPLKDVLQGSRIIGGTEAQAGAWPWVVSLQIKYGRVLVHVCGGTLVRERWVLTAAHCTKDASDPLMWTAVIGTNNIHGRYPHTKKIKIKAIIIHPNFILESYVNDIALFHLKKAVRYNDYIQPICLPFDVFQILDGNTKCFISGWGRTKEEGNATNILQDAEVHYISREMCNSERSYGGIIPNTSFCAGDEDGAFDTCRVRPSNFPLKYFLKPEGNLSNKAFDNFLVVLIIRPKNNKSFFLLFNYFNNPNLLGS

SEQ ID NO: 90563 - protein, 202 aa, Homo sapiens
  Payload ID: 18110
  Gene Name: transmembrane 4 L six family member 1
  Uniprot ID: P30408
  ENSP ID: ENSP00000304277
MCYGKCARCIGHSLVGLALLCIAANILLYFPNGETKYASENHLSRFVWFFSGIVGGGLLMLLPAFVFIGLEQDDCCGCCGHENCGKRCAMLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQQYDC

SEQ ID NO: 90564 - protein, 117 aa, Homo sapiens
  Payload ID: 18110
  Gene Name: transmembrane 4 L six family member 1
  ENSP ID: ENSP00000417084
MLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQVRTCMKMS

SEQ ID NO: 90565 - protein, 103 aa, Homo sapiens
  Payload ID: 18110
  Gene Name: transmembrane 4 L six family member 1
  ENSP ID: ENSP00000418025
MCYGKCARCIGHSLVGLALLCIAANILLYFPNGETKYASENHLSRFVWFFSGIVGGGLLMLLPAFVFIGLEQDDCCGCCGHENCGKRCAVGPPALVVKMTPKM

SEQ ID NO: 90566 - protein, 101 aa, Homo sapiens
  Payload ID: 18110
  Gene Name: transmembrane 4 L six family member 1
  ENSP ID: ENSP00000419426
MCYGKCARCIGHSLVGLALLCIAANILLYFPNGETKYASENHLSRFVWFFSGIVGGGLLMLLPAFVFIGLEQDDCCGCCGHENCGKRCAVPSGYLHMVRVH

SEQ ID NO: 90567 - protein, 232 aa, Homo sapiens
  Payload ID: 18110
  Gene Name: transmembrane 4 L six family member 1
  ENSP ID: ENSP00000477606
MCYGKCARCIGHSLVGLALLCIAANILLYFPNGETKYASENHLSRFVWFFSGIVGGGLLMLLPAFVFIGLEQDDCCGCCGHENCGKRCAMLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQQMTAKRTNPGQSHNLPLFHCNLYISLVFICKTLY

SEQ ID NO: 90568 - protein, 201 aa, Homo sapiens
  Payload ID: 18111
  Gene Name: transmembrane 4 L six family member 18
  Uniprot ID: Q96CE8
  ENSP ID: ENSP00000296059
MGSRKCGGCLSCLLIPLALWSIIVNILLYFPNGQTSYASSNKLTNYVWYFEGICFSGIMMLIVTTVLLVLENNNNYKCCQSENCSKKYVTLLSIIFSSLGIAFSGYCLVISALGLVQGPYCRTLDGWEYAFEGTAGRFLTDSSIWIQCLEPAHVVEWNIILFSILITLSGLQVIICLIRVVMQLSKILCGSYSVIFQPGII

SEQ ID NO: 90569 - protein, 159 aa, Homo sapiens
  Payload ID: 18111
  Gene Name: transmembrane 4 L six family member 18
  ENSP ID: ENSP00000418372
MGSRKCGGCLSCLLIPLALWSIIVNILLYFPNGQTSYASSNKLTNYVWYFEGICFSGIMMLIVTTVLLVLENNNNYKCCQSENCSKKYVTLLSIIFSSLGIAFSGYCLVISALGLVQGPYCRTLDGWEYAFEGTAGRFLTDSSIWIQCLEPAHVVEWNI

SEQ ID NO: 90570 - protein, 201 aa, Homo sapiens; identical to SEQ ID NO: 90568
  Payload ID: 18111
  Gene Name: transmembrane 4 L six family member 18
  Uniprot ID: Q96CE8
  ENSP ID: ENSP00000419278

SEQ ID NO: 90571 - protein, 209 aa, Homo sapiens; identical to SEQ ID NO: 89022
  Payload ID: 18112
  Gene Name: transmembrane 4 L six family member 19
  Uniprot ID: Q96DZ7
  ENSP ID: ENSP00000273695

SEQ ID NO: 90572 - protein, 183 aa, Homo sapiens
  Payload ID: 18112
  Gene Name: transmembrane 4 L six family member 19
  Uniprot ID: Q96DZ7
  ENSP ID: ENSP00000387728
MVSSPCTQASSRTCSRILGLSLGTAALFAAGANVALLLPNWDVTYLLRGLLGRHAMLGTGLWGGGLMVLTALLSGGLALLGALICFVTSGVALKDGPFCMFDVSSFNQTQAWKYGYPFKDLHSRNYLYDRSLWNSVCLEPSAAVVWHVSLFSALLCISLLQLLLVVVHVINSLLGLFCSLCEK

SEQ ID NO: 90573 - protein, 299 aa, Homo sapiens
  Payload ID: 18112
  Gene Name: transmembrane 4 L six family member 19
  ENSP ID: ENSP00000395280
MVSSPCTQASSRTCSRILGLSLGTAALFAAGANVALLLPNWDVTYLLRGLLGRHAMLGTGLWGGGLMVLTAAILISLMGWRYGCFSKSGLCRSVLTALLSGGLALLGALICFVTSGVALKDGPFCMFDVSSFNQTQAWKYGYPFKDLHRIICMTVRSGTPSAWSPLQLLSGTCPSSPPFCASACSSFSWWSFMSSTASWAFSAASARSDRQNLHLQAWVFSSSAVLNPFYKEWSLMLECSGVISAHCKLRLPGSSNSPASASQVAGITGTCHHTQLIFVFLVETGFHNVSQDGLDLLTS

SEQ ID NO: 90574 - protein, 110 aa, Homo sapiens
  Payload ID: 18112
  Gene Name: transmembrane 4 L six family member 19
  ENSP ID: ENSP00000414864
  MOD_RES (1)..(1): Any amino acid
XQTQAWKYGYPFKDLHRIICMTVRSGTPSAWSPLQLLSGTCPSSPPFCASACSSFSWWSFMSSTASWAFSAASARSDRQNLHLQAWVFSSSAVLNPFYKEWVRIINKLPL

SEQ ID NO: 90575 - protein, 229 aa, Homo sapiens
  Payload ID: 18113
  Gene Name: transmembrane 4 L six family member 20
  Uniprot ID: Q53R12
  ENSP ID: ENSP00000303028
MTCCEGWTSCNGFSLLVLLLLGVVLNAIPLIVSLVEEDQFSQNPISCFEWWFPGIIGAGLMAIPATTMSLTARKRACCNNRTGMFLSSLFSVITVIGALYCMLISIQALLKGPLMCNSPSNSNANCEFSLKNISDIHPESFNLQWFFNDSCAPPTGFNKPTSNDTMASGWRASSFHFDSEENKHRLIHFSVFLGLLLVGILEVLFGLSQIVIGFLGCLCGVSKRRSQIV

SEQ ID NO: 90576 - protein, 14 aa, Homo sapiens
  Payload ID: 18113
  Gene Name: transmembrane 4 L six family member 20
  ENSP ID: ENSP00000416565
MTCCEGWTSCNGFS

SEQ ID NO: 90577 - protein, 202 aa, Homo sapiens
  Payload ID: 18114
  Gene Name: transmembrane 4 L six family member 4
  Uniprot ID: P48230
  ENSP ID: ENSP00000305852
MCTGGCARCLGGTLIPLAFFGFLANILLFFPGGKVIDDNDHLSQEIWFFGGILGSGVLMIFPALVFLGLKNNDCCGCCGNEGCGKRFAMFTSTIFAVVGFLGAGYSFIISAISINKGPKCLMANSTWGYPFHDGDYLNDEALWNKCREPLNVVPWNLTLFSILLVVGGIQMVLCAIQVVNGLLGTLCGDCQCCGCCGGDGPV

SEQ ID NO: 90578 - protein, 81 aa, Homo sapiens
  Payload ID: 18114
  Gene Name: transmembrane 4 L six family member 4
  ENSP ID: ENSP00000419367
MCTGGCARCLGGTLIPLAFFGFLANILLFFPGGKVIDDNDHLSQEIWFFGGILGSGVLMFTSTIFAVVGFLGAGYSFIISA

SEQ ID NO: 90579 - protein, 197 aa, Homo sapiens
  Payload ID: 18115
  Gene Name: transmembrane 4 L six family member 5
  Uniprot ID: O14894
  ENSP ID: ENSP00000270560
MCTGKCARCVGLSLITLCLVCIVANALLLVPNGETSWTNTNHLSLQVWLMGGFIGGGLMVLCPGIAAVRAGGKGCCGAGCCGNRCRMLRSVFSSAFGVLGAIYCLSVSGAGLRNGPRCLMNGEWGYHFEDTAGAYLLNRTLWDRCEAPPRVVPWNVTLFSLLVAASCLEIVLCGIQLVNATIGVFCGDCRKKQDTPH

SEQ ID NO: 90580 - protein, 145 aa, Homo sapiens
  Payload ID: 18116
  Gene Name: transmembrane 6 superfamily member 1
  ENSP ID: ENSP00000258909
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWECWHICSILFLTL

SEQ ID NO: 90581 - protein, 370 aa, Homo sapiens
  Payload ID: 18116
  Gene Name: transmembrane 6 superfamily member 1
  Uniprot ID: Q9BZW5
  ENSP ID: ENSP00000317000
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWEETYRTIGLYWVGSIIMSVVVFVPGNIVGKYGTRICPAFFLSIPYTCLPVWAGFRIYNQPSENYNYPSKVIQEAQAKDLLRRPFDLMLVVCLLLATGFCLFRGLIALDCPSELCRLYTQFQEPYLKDPAAYPKIQMLAYMFYSVPYFVTALYGLVVPGCSWMPDITLIHAGGLAQAQFSHIGASLHARTAYVYRVPEEAKILFLALNIAYGVLPQLLAYRCIYKPEFFIKTKAEEKVE

SEQ ID NO: 90582 - protein, 133 aa, Homo sapiens
  Payload ID: 18116
  Gene Name: transmembrane 6 superfamily member 1
  ENSP ID: ENSP00000368693
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWE

SEQ ID NO: 90583 - protein, 188 aa, Homo sapiens
  Payload ID: 18116
  Gene Name: transmembrane 6 superfamily member 1
  ENSP ID: ENSP00000368700
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWEETYRTIGLYWVGSIIMSVVVFVPGNIVDAGIYVLFCSLLCDCTVWLSGSWMFLDA

SEQ ID NO: 90584 - protein, 166 aa, Homo sapiens
  Payload ID: 18116
  Gene Name: transmembrane 6 superfamily member 1
  ENSP ID: ENSP00000454275
MTHYLREGEPYLNTAYGHMICYWDGSAHYLMYLVMVAAIAWEETYRTIGLYWVGSIIMSVVVFVPGNIVGKYGTRICPAFFLSIPYTCLPVWAGFRIYNQPSENYNYPSKVIQEAQAKDLLRRPFDLMLVVCLLLATGFCLFRGLIALDCPSELCRLYTQFQEPYL

SEQ ID NO: 90585 - protein, 30 aa, Homo sapiens
  Payload ID: 18116
  Gene Name: transmembrane 6 superfamily member 1
  ENSP ID: ENSP00000454416
  MOD_RES (1)..(1): Any amino acid
XYGLVVPGCSWMPDITLIHAGGLAQPAAML

SEQ ID NO: 90586 - protein, 339 aa, Homo sapiens
  Payload ID: 18116
  Gene Name: transmembrane 6 superfamily member 1
  Uniprot ID: Q9BZW5
  ENSP ID: ENSP00000457477
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWEETYRTIGLYWVGSIIMSVVVFVPGNIVGKYGTRICPAFFLSIPYTCLPVWAGFRIYNQPSENYNYPSKVIQEAQAKDLLRRPFDLMLVVCLLLATGFCLFRGLMLAYMFYSVPYFVTALYGLVVPGCSWMPDITLIHAGGLAQAQFSHIGASLHARTAYVYRVPEEAKILFLALNIAYGVLPQLLAYRCIYKPEFFIKTKAEEKVE

SEQ ID NO: 90587 - protein, 377 aa, Homo sapiens
  Payload ID: 18117
  Gene Name: transmembrane 6 superfamily member 2
  Uniprot ID: Q9BZW4
  ENSP ID: ENSP00000374014
MDIPPLAGKIAALSLSALPVSYALNHVSALSHPLWVALMSALILGLLFVAVYSLSHGEVSYDPLYAVFAVFAFTSVVDLIIALQEDSYVVGFMEFYTKEGEPYLRTAHGVFICYWDGTVHYLLYLAMAGAICRRKRYRNFGLYWLGSFAMSILVFLTGNILGKYSSEIRPAFFLTIPYLLVPCWAGMKVFSQPRALTRCTANMVQEEQRKGLLQRPADLALVIYLILAGFFTLFRGLVVLDCPTDACFVYIYQYEPYLRDPVAYPKVQMLMYMFYVLPFCGLAAYALTFPGCSWLPDWALVFAGGIGQAQFSHMGASMHLRTPFTYRVPEDTWGCFFVCNLLYALGPHLLAYRCLQWPAFFHQPPPSDPLALHKKQH

SEQ ID NO: 90588 - protein, 418 aa, Homo sapiens
  Payload ID: 18118
  Gene Name: transmembrane 7 superfamily member 2
  Uniprot ID: O76062
  ENSP ID: ENSP00000279263
MAPTQGPRAPLEFGGPLGAAALLLLLPATMFHLLLAARSGPARLLGPPASLPGLEVLWSPRALLLWLAWLGLQAALYLLPARKVAEGQELKDKSRLRYPINGFQALVLTALLVGLGMSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVAGLETISTATGRKLLVSGWWGMVRHPNYLGDLIMALAWSLPCGVSHLLPYFYLLYFTALLVHREARDERQCLQKYGLAWQEYCRRVPYRIMPYIY

SEQ ID NO: 90589 - protein, 391 aa, Homo sapiens
  Payload ID: 18118
  Gene Name: transmembrane 7 superfamily member 2
  Uniprot ID: O76062
  ENSP ID: ENSP00000329520
MAPTQGPRAPLEFGGPLGAAALLLLLPATMFHLLLAARSGPARLLGPPASLPGLEVLWSPRALLLWLAWLGLQAALYLLPARKVAEGQELKDKSRLRYPINGFQALVLTALLVGLGMSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINGLETISTATGRKLLVSGWWGMVRHPNYLGDLIMALAWSLPCGVSHLLPYFYLLYFTALLVHREARDERQCLQKYGLAWQEYCRRVPYRIMPYIY

SEQ ID NO: 90590 - protein, 271 aa, Homo sapiens
  Payload ID: 18118
  Gene Name: transmembrane 7 superfamily member 2
  ENSP ID: ENSP00000431300
MFHLLLAARSGPARLLGPPASLPGLEVLWSPRALLLWLAWLGLQAALYLLPARKVAEGQELKDKSRLRYPINGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVAGLETISTATGRKLLVSGWWGMVRHPNYLGDLIMALAWSLPC

SEQ ID NO: 90591 - protein, 181 aa, Homo sapiens
  Payload ID: 18118
  Gene Name: transmembrane 7 superfamily member 2
  ENSP ID: ENSP00000431685
PIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVAGVSHLLPYFYLLYFTALLVHREARD

SEQ ID NO: 90592 - protein, 219 aa, Homo sapiens
  Payload ID: 18118
  Gene Name: transmembrane 7 superfamily member 2
  ENSP ID: ENSP00000432171
MAPTQGPRAPLEFGGPLGAAALLLLLPATMFHLLLAARSGPARLLGPPASLPGLEVLWSPRALLLWLAWLGLQAALYLLPARKVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVAGLETISTATGRKL

SEQ ID NO: 90593 - protein, 256 aa, Homo sapiens
  Payload ID: 18118
  Gene Name: transmembrane 7 superfamily member 2
  ENSP ID: ENSP00000432187
MAPTQGPRAPLEFGGPLGAAALLLLLPATMFHLLLAARSGPARLLGPPASLPGLEVLWSPRALLLWLAWLGLQAALYLLPARKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVA

SEQ ID NO: 90594 - protein, 115 aa, Homo sapiens
  Payload ID: 18118
  Gene Name: transmembrane 7 superfamily member 2
  ENSP ID: ENSP00000432413
MAPTQGPRAPLEFGGPLGAAALLLLLPATMFHLLLAARSGPARLLGPPASLPGLEVLWSPRALLLWLAWLGLQAALYLLPARKVAEGQELKDKSRLRYPINGNPIYDFFLGRELN

SEQ ID NO: 90595 - protein, 207 aa, Homo sapiens
  Payload ID: 18118
  Gene Name: transmembrane 7 superfamily member 2
  ENSP ID: ENSP00000433275
MAPTQGPRAPLEFGGPLGAAALLLLLPATMFHLLLAARSGPARLLGPPASLPGLEVLWSPRALLLWLAWLGLQAALYLLPARKVAEGQELKDKSRLRYPINGFQALVLTALLVGLGMSAGLPLGALPEMLLPLAFVATLTAFIFSLFLYMKAQVAPVSALAPGGNSELNPRICFFDFKYFCELRPGLIGWVLINLALLMKEAELRGS

SEQ ID NO: 90596 - protein, 292 aa, Homo sapiens
  Payload ID: 18118
  Gene Name: transmembrane 7 superfamily member 2
  ENSP ID: ENSP00000433325
MFHLLLAARSGPARLLGPPASLPGLEVLWSPRALLLWLAWLGLQAALYLLPARKVAEGQELKDKSRLRYPINGFQALVLTALLVGLGMSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDP

SEQ ID NO: 90597 - protein, 148 aa, Homo sapiens
  Payload ID: 18118
  Gene Name: transmembrane 7 superfamily member 2
  ENSP ID: ENSP00000434447
MAPTQGPRAPLEFGGPLGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLIN

SEQ ID NO: 90598 - protein, 93 aa, Homo sapiens
  Payload ID: 18118
  Gene Name: transmembrane 7 superfamily member 2
  ENSP ID: ENSP00000434598
  MOD_RES (1)..(1): Any amino acid
XEFGGPLGAAALLLLLPATMFHLLLAARSGPARLLGPPASLPGLEVLWSPRALLLWLAWLGLQAALYLLPARKVAEGQELKDKSRLRYPINGA

SEQ ID NO: 90599 - protein, 89 aa, Homo sapiens
  Payload ID: 18118
  Gene Name: transmembrane 7 superfamily member 2
  ENSP ID: ENSP00000435458
MAPTQGPRAPLEFGGPLGAAALLLLLPATMFHLLLAARSGPARLLGPPASLPGLEVLWSPRALLLWLAWLGLQAALYLLPARKASRPWC

SEQ ID NO: 90600 - protein, 223 aa, Homo sapiens
  Payload ID: 18118
  Gene Name: transmembrane 7 superfamily member 2
  ENSP ID: ENSP00000435972
MFHLLLAARSGPARLLGPPASLPGLEVLWSPRALLLWLAWLGLQAALYLLPARKVAEGQELKDKSRLRYPINGFQALVLTALLVGLGMSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITH

SEQ ID NO: 90601 - protein, 208 aa, Homo sapiens
  Payload ID: 18118
  Gene Name: transmembrane 7 superfamily member 2
  ENSP ID: ENSP00000436233
  MOD_RES (1)..(1): Any amino acid
XFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVAGLETISTATGRKLLVSGWWGMVRHPNYLGDLIMALAWSLPCDPGAFAAEPRCPHEP

SEQ ID NO: 90602 - protein, 135 aa, Homo sapiens
  Payload ID: 18118
  Gene Name: transmembrane 7 superfamily member 2
  ENSP ID: ENSP00000436370
MAPTQGPRAPLEFGGPLGAAALLLLLPATMFHLLLAARSGPARLLGPPASLPGLEVLWSPRALLLWLAWLGLQAALYLLPARKVAEGQELKDKSRLRYPINGPHQPGPVDEGGRASRQSLTGHVAGQWLPVALRG

SEQ ID NO: 90603 - protein, 570 aa, Homo sapiens
  Payload ID: 18119
  Gene Name: transmembrane 7 superfamily member 3
  Uniprot ID: Q9NS93
  ENSP ID: ENSP00000342322
MGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 90604 - protein, 37 aa, Homo sapiens
  Payload ID: 18119
  Gene Name: transmembrane 7 superfamily member 3
  ENSP ID: ENSP00000438848
MAILLSYSERDPVPGGCNLEFDLDIDPNIYLEYNFFE

SEQ ID NO: 90605 - protein, 200 aa, Homo sapiens
  Payload ID: 18119
  Gene Name: transmembrane 7 superfamily member 3
  ENSP ID: ENSP00000439318
  MOD_RES (1)..(1): Any amino acid
XLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLETGSLSVTHAGLQ

SEQ ID NO: 90606 - protein, 116 aa, Homo sapiens
  Payload ID: 18119
  Gene Name: transmembrane 7 superfamily member 3
  ENSP ID: ENSP00000439987
MGFLQLLVVAVLASEHRVAGAAEVFGNSSEVYLVVGLIEFSVGKFRYFELNRPFPEEAILHDISSNVTFLIFQIHSQYQNTTVSFSPTLLSNSSETGTASGLVFILRPEQSTCTWY

SEQ ID NO: 90607 - protein, 144 aa, Homo sapiens
  Payload ID: 18119
  Gene Name: transmembrane 7 superfamily member 3
  ENSP ID: ENSP00000440146
  MOD_RES (1)..(1): Any amino acid
XVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDAEHTDLWSHWLLFGGFSH

SEQ ID NO: 90608 - protein, 115 aa, Homo sapiens
  Payload ID: 18119
  Gene Name: transmembrane 7 superfamily member 3
  ENSP ID: ENSP00000440262
MSHRARPISGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVP

SEQ ID NO: 90609 - protein, 49 aa, Homo sapiens
  Payload ID: 18119
  Gene Name: transmembrane 7 superfamily member 3
  ENSP ID: ENSP00000440323
MGFLQLLVVAVLASEHRVAGAAEVFGNSSEDSPFQFLGNRHCQWTGFHP

SEQ ID NO: 90610 - protein, 152 aa, Homo sapiens
  Payload ID: 18119
  Gene Name: transmembrane 7 superfamily member 3
  ENSP ID: ENSP00000440736
ETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLAVLYLLLCLSTSSPSFITGLF

SEQ ID NO: 90611 - protein, 86 aa, Homo sapiens
  Payload ID: 18119
  Gene Name: transmembrane 7 superfamily member 3
  ENSP ID: ENSP00000441027
MAILLSYSERDPVPGGCNLEFDLDIDPNIYLEYNFFETTIKFAPANLGYARGVDPPPCDAGTDQDSRWRLQYDVYQYFLPENDLTE

SEQ ID NO: 90612 - protein, 136 aa, Homo sapiens
  Payload ID: 18119
  Gene Name: transmembrane 7 superfamily member 3
  ENSP ID: ENSP00000441924
MLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYD

SEQ ID NO: 90613 - protein, 128 aa, Homo sapiens
  Payload ID: 18119
  Gene Name: transmembrane 7 superfamily member 3
  ENSP ID: ENSP00000442617
MGFLQLLVVAVLASEHRVAGAAEVFGNSSEDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALK

SEQ ID NO: 90614 - protein, 81 aa, Homo sapiens
  Payload ID: 18119
  Gene Name: transmembrane 7 superfamily member 3
  ENSP ID: ENSP00000444362
FYILITRLTPIKYDGNLKIFHDDGVFWVTFSCIAILIPVVFMGCLRILNILTCGVIGSYSVVLAIDSYWSTSLSYITLNVL

SEQ ID NO: 90615 - protein, 66 aa, Homo sapiens
  Payload ID: 18119
  Gene Name: transmembrane 7 superfamily member 3
  ENSP ID: ENSP00000444632
MAILLSYSERDPVPGGCNLEFDLDIDPNIYLEYNFFETTIKFAPANLGYARGVDPPPCDAGTDQDS

SEQ ID NO: 90616 - protein, 136 aa, Homo sapiens; identical to SEQ ID NO: 90612
  Payload ID: 18119
  Gene Name: transmembrane 7 superfamily member 3
  ENSP ID: ENSP00000445156

SEQ ID NO: 90617 - protein, 222 aa, Homo sapiens
  Payload ID: 18119
  Gene Name: transmembrane 7 superfamily member 3
  ENSP ID: ENSP00000445756
VWDPFLNTSAAYIPAHTYACSFEAGEGSCASLELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERG

SEQ ID NO: 90618 - protein, 606 aa, Homo sapiens
  Payload ID: 18120
  Gene Name: transmembrane 9 superfamily member 1
  Uniprot ID: O15321
  ENSP ID: ENSP00000261789
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 90619 - protein, 489 aa, Homo sapiens
  Payload ID: 18120
  Gene Name: transmembrane 9 superfamily member 1
  Uniprot ID: O15321
  ENSP ID: ENSP00000380063
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFRYPPFIPWLLLSGS

SEQ ID NO: 90620 - protein, 300 aa, Homo sapiens
  Payload ID: 18120
  Gene Name: transmembrane 9 superfamily member 1
  ENSP ID: ENSP00000431447
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRF

SEQ ID NO: 90621 - protein, 420 aa, Homo sapiens
  Payload ID: 18120
  Gene Name: transmembrane 9 superfamily member 1
  ENSP ID: ENSP00000431747
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSGSASHNHPAASDGLAAGGLSPHCHWRHLWEEQRQPL

SEQ ID NO: 90622 - protein, 242 aa, Homo sapiens
  Payload ID: 18120
  Gene Name: transmembrane 9 superfamily member 1
  ENSP ID: ENSP00000432435
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINS

SEQ ID NO: 90623 - protein, 589 aa, Homo sapiens
  Payload ID: 18120
  Gene Name: transmembrane 9 superfamily member 1
  ENSP ID: ENSP00000432997
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPCAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 90624 - protein, 210 aa, Homo sapiens
  Payload ID: 18120
  Gene Name: transmembrane 9 superfamily member 1
  ENSP ID: ENSP00000433792
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSE

SEQ ID NO: 90625 - protein, 519 aa, Homo sapiens
  Payload ID: 18120
  Gene Name: transmembrane 9 superfamily member 1
  ENSP ID: ENSP00000434387
MAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 90626 - protein, 257 aa, Homo sapiens
  Payload ID: 18120
  Gene Name: transmembrane 9 superfamily member 1
  ENSP ID: ENSP00000435857
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVIL

SEQ ID NO: 90627 - protein, 133 aa, Homo sapiens
  Payload ID: 18120
  Gene Name: transmembrane 9 superfamily member 1
  ENSP ID: ENSP00000436486
MTVVGNPRSWSCQWLPILILLLGTALVQVYCHPHDCWRLPAFQCHLCGAVLHLCHSMGSGAVHFVRHPLLCLRHPAECGGLHLHCTHLLPVVWGGLPLVVAICAECWLHRPLHLPLLSFLLCPALQHVWGSTD

SEQ ID NO: 90628 - protein, 207 aa, Homo sapiens
  Payload ID: 18120
  Gene Name: transmembrane 9 superfamily member 1
  ENSP ID: ENSP00000437127
MAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIH

SEQ ID NO: 90629 - protein, 663 aa, Homo sapiens
  Payload ID: 18121
  Gene Name: transmembrane 9 superfamily member 2
  Uniprot ID: Q99805
  ENSP ID: ENSP00000365567
MSARLPVLSPPRWPRLLLLSLLLLGAVPGPRRSGAFYLPGLAPVNFCDEEKKSDECKAEIELFVNRLDSVESVLPYEYTAFDFCQASEGKRPSENLGQVLFGERIEPSPYKFTFNKKETCKLVCTKTYHTEKAEDKQKLEFLKKSMLLNYQHHWIVDNMPVTWCYDVEDGQRFCNPGFPIGCYITDKGHAKDACVISSDFHERDTFYIFNHVDIKIYYHVVETGSMGARLVAAKLEPKSFKHTHIDKPDCSGPPMDISNKASGEIKIAYTYSVSFEEDDKIRWASRWDYILESMPHTHIQWFSIMNSLVIVLFLSGMVAMIMLRTLHKDIARYNQMDSTEDAQEEFGWKLVHGDIFRPPRKGMLLSVFLGSGTQILIMTFVTLFFACLGFLSPANRGALMTCAVVLWVLLGTPAGYVAARFYKSFGGEKWKTNVLLTSFLCPGIVFADFFIMNLILWGEGSSAAIPFGTLVAILALWFCISVPLTFIGAYFGFKKNAIEHPVRTNQIPRQIPEQSFYTKPLPGIIMGGILPFGCIFIQLFFILNSIWSHQMYYMFGFLFLVFIILVITCSEATILLCYFHLCAEDYHWQWRSFLTSGFTAVYFLIYAVHYFFSKLQITGTASTILYFGYTMIMVLIFFLFTGTIGFFACFWFVTKIYSVVKVD

SEQ ID NO: 90630 - protein, 589 aa, Homo sapiens
  Payload ID: 18122
  Gene Name: transmembrane 9 superfamily member 3
  Uniprot ID: Q9HD45
  ENSP ID: ENSP00000360184
MRPLPGALGVAAAAALWLLLLLLPRTRADEHEHTYQDKEEVVLWMNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQMSYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 90631 - protein, 253 aa, Homo sapiens
  Payload ID: 18122
  Gene Name: transmembrane 9 superfamily member 3
  ENSP ID: ENSP00000401152
MNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQMSYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGS

SEQ ID NO: 90632 - protein, 625 aa, Homo sapiens
  Payload ID: 18123
  Gene Name: transmembrane 9 superfamily protein member 4
  ENSP ID: ENSP00000217315
MCETSAFYVPGVAPINFHQNDPVEIKAVKLTSSRTQLPYEYYSLPFCQPSKITYKAENLGEVLRGDRIVNTPFQVLMNSEKKCEVLCSQSNKPVTLTVEQSRLVAERITEDYYVHLIADNLPVATRLELYSNRDSDDKKKEKDVQFEHGYRLGFTDVNKIYLHNHLSFILYYHREDMEEDQEHTYRVVRFEVIPQSIRLEDLKADEKSSCTLPEGTNSSPQEIDPTKENQLYFTYSVHWEESDIKWASRWDTYLTMSDVQIHWFSIINSVVVVFFLSGILSMIIIRTLRKDIANYNKEDDIEDTMEESGWKLVHGDVFRPPQYPMILSSLLGSGIQLFCMILIVIFVAMLGMLSPSSRGALMTTACFLFMFMGVFGGFSAGRLYRTLKGHRWKKGAFCTATLYPGVVFGICFVLNCFIWGKHSSGAVPFPTMVALLCMWFGISLPLVYLGYYFGFRKQPYDNPVRTNQIPRQIPEQRWYMNRFVGILMAGILPFGAMFIELFFIFSAIWENQFYYLFGFLFLVFIILVVSCSQISIVMVYFQLCAEDYRWWWRNFLVSGGSAFYVLVYAIFYFVNKLDIVEFIPSLLYFGYTALMVLSFWLLTGTIGFYAAYMFVRKIYAAVKID

SEQ ID NO: 90633 - protein, 642 aa, Homo sapiens
  Payload ID: 18123
  Gene Name: transmembrane 9 superfamily protein member 4
  Uniprot ID: Q92544
  ENSP ID: ENSP00000381104
MATAMDWLPWSLLLFSLMCETSAFYVPGVAPINFHQNDPVEIKAVKLTSSRTQLPYEYYSLPFCQPSKITYKAENLGEVLRGDRIVNTPFQVLMNSEKKCEVLCSQSNKPVTLTVEQSRLVAERITEDYYVHLIADNLPVATRLELYSNRDSDDKKKEKDVQFEHGYRLGFTDVNKIYLHNHLSFILYYHREDMEEDQEHTYRVVRFEVIPQSIRLEDLKADEKSSCTLPEGTNSSPQEIDPTKENQLYFTYSVHWEESDIKWASRWDTYLTMSDVQIHWFSIINSVVVVFFLSGILSMIIIRTLRKDIANYNKEDDIEDTMEESGWKLVHGDVFRPPQYPMILSSLLGSGIQLFCMILIVIFVAMLGMLSPSSRGALMTTACFLFMFMGVFGGFSAGRLYRTLKGHRWKKGAFCTATLYPGVVFGICFVLNCFIWGKHSSGAVPFPTMVALLCMWFGISLPLVYLGYYFGFRKQPYDNPVRTNQIPRQIPEQRWYMNRFVGILMAGILPFGAMFIELFFIFSAIWENQFYYLFGFLFLVFIILVVSCSQISIVMVYFQLCAEDYRWWWRNFLVSGGSAFYVLVYAIFYFVNKLDIVEFIPSLLYFGYTALMVLSFWLLTGTIGFYAAYMFVRKIYAAVKID

SEQ ID NO: 90634 - protein, 85 aa, Homo sapiens
  Payload ID: 18123
  Gene Name: transmembrane 9 superfamily protein member 4
  ENSP ID: ENSP00000390314
MATAMDWLPWSLLLFSLMCETSAFYVPGVAPINFHQNDPVEIKAVKLTSSRTQLPYEYYSLPFCQPSKITYKAENLGRRKERTGS

SEQ ID NO: 90635 - protein, 68 aa, Homo sapiens
  Payload ID: 18123
  Gene Name: transmembrane 9 superfamily protein member 4
  ENSP ID: ENSP00000404755
MCETSAFYVPGVAPINFHQNDPVEIKAVKLTSSRTQLPYEYYSLPFCQPSKITYKAENLGSHEQREEV

SEQ ID NO: 90636 - protein, 85 aa, Homo sapiens; identical to SEQ ID NO: 90634
  Payload ID: 18123
  Gene Name: transmembrane 9 superfamily protein member 4
  ENSP ID: ENSP00000413382

SEQ ID NO: 90637 - protein, 653 aa, Homo sapiens
  Payload ID: 18124
  Gene Name: transmembrane and coiled-coil domain family 1
  Uniprot ID: O94876
  ENSP ID: ENSP00000376930
MEPSGSEQLFEDPDPGGKSQDAEARKQTESEQKLSKMTHNALENINVIGQGLKHLFQHQRRRSSVSPHDVQQIQADPEPEMDLESQNACAEIDGVPTHPTALNRVLQQIRVPPKMKRGTSLHSRRGKPEAPKGSPQINRKSGQEMTAVMQSGRPRSSSTTDAPTSSAMMEIACAAAAAAAACLPGEEGTAERIERLEVSSLAQTSSAVASSTDGSIHTDSVDGTPDPQRTKAAIAHLQQKILKLTEQIKIAQTARDDNVAEYLKLANSADKQQAARIKQVFEKKNQKSAQTILQLQKKLEHYHRKLREVEQNGIPRQPKDVFRDMHQGLKDVGAKVTGFSEGVVDSVKGGFSSFSQATHSAAGAVVSKPREIASLIRNKFGSADNIPNLKDSLEEGQVDDAGKALGVISNFQSSPKYGSEEDCSSATSGSVGANSTTGGIAVGASSSKTNTLDMQSSGFDALLHEIQEIRETQARLEESFETLKEHYQRDYSLIMQTLQEERYRCERLEEQLNDLTELHQNEILNLKQELASMEEKIAYQSYERARDIQEALEACQTRISKMELQQQQQQVVQLEGLENATARNLLGKLINILLAVMAVLLVFVSTVANCVVPLMKTRNRTFSTLFLVVFIAFLWKHWDALFSYVERFFSSPR

SEQ ID NO: 90638 - protein, 539 aa, Homo sapiens
  Payload ID: 18124
  Gene Name: transmembrane and coiled-coil domain family 1
  ENSP ID: ENSP00000389892
MKRGTSLHSRRGKPEAPKGSPQINRKSGQEMTAVMQSGRPRSSSTTDAPTSSAMMEIACAAAAAAAACLPGEEGTAERIERLEVSSLAQTSSAVASSTDGSIHTDSVDGTPDPQRTKAAIAHLQQKILKLTEQIKIAQTARDDNVAEYLKLANSADKQQAARIKQVFEKKNQKSAQTILQLQKKLEHYHRKLREVEQNGIPRQPKDVFRDMHQGLKDVGAKVTGFSEGVVDSVKGGFSSFSQATHSAAGAVVSKPREIASLIRNKFGSADNIPNLKDSLEEGQVDDAGKALGVISNFQSSPKYGSEEDCSSATSGSVGANSTTGGIAVGASSSKTNTLDMQSSGFDALLHEIQEIRETQARLEESFETLKEHYQRDYSLIMQTLQEERYRCERLEEQLNDLTELHQNEILNLKQELASMEEKIAYQSYERARDIQEALEACQTRISKMELQQQQQQVVQLEGLENATARNLLGKLINILLAVMAVLLVFVSTVANCVVPLMKTRNRTFSTLFLVVFIAFLWKHWDALFSYVERFFSSPR

SEQ ID NO: 90639 - protein, 329 aa, Homo sapiens
  Payload ID: 18124
  Gene Name: transmembrane and coiled-coil domain family 1
  ENSP ID: ENSP00000404711
MHQGLKDVGAKVTGFSEGVVDSVKGGFSSFSQATHSAAGAVVSKPREIASLIRNKFGSADNIPNLKDSLEEGQVDDAGKALGVISNFQSSPKYGSEEDCSSATSGSVGANSTTGGIAVGASSSKTNTLDMQSSGFDALLHEIQEIRETQARLEESFETLKEHYQRDYSLIMQTLQEERYRCERLEEQLNDLTELHQNEILNLKQELASMEEKIAYQSYERARDIQEALEACQTRISKMELQQQQQQVVQLEGLENATARNLLGKLINILLAVMAVLLVFVSTVANCVVPLMKTRNRTFSTLFLVVFIAFLWKHWDALFSYVERFFSSPR

SEQ ID NO: 90640 - protein, 83 aa, Homo sapiens
  Payload ID: 18124
  Gene Name: transmembrane and coiled-coil domain family 1
  ENSP ID: ENSP00000422544
MKRGTSLHSRRGKPEAPKGSPQINRKSGQEMTAVMQSGRPRSSSTTDAPTSSAMMEIACAAAAAAAACLPGEEGTAERIERLE

SEQ ID NO: 90641 - protein, 17 aa, Homo sapiens
  Payload ID: 18124
  Gene Name: transmembrane and coiled-coil domain family 1
  ENSP ID: ENSP00000426180
MEEKIAYQSYERARDIQ

SEQ ID NO: 90642 - protein, 6 aa, Homo sapiens
  Payload ID: 18124
  Gene Name: transmembrane and coiled-coil domain family 1
  ENSP ID: ENSP00000427352
MKRGTS

SEQ ID NO: 90643 - protein, 469 aa, Homo sapiens
  Payload ID: 18125
  Gene Name: transmembrane and coiled-coil domain family 2
  ENSP ID: ENSP00000329436
MKSKEEETAVDKGDLVALSLPAGHGDTDGPISLDVPDGAPDPQRTKAAIDHLHQKILKITEQIKIEQEARDDNVAEYLKLANNADKQQVSRIKQVFEKKNQKSAQTIAQLHKKLEHYRRRLKEIEQNGPSRQPKDVLRDMQQGLKDVGANVRAGISGFGGGVVEGVKGSLSGLSQATHTAVVSKPREFASLIRNKFGSADNIAHLKDPLEDGPPEEAARALSGSATLVSSPKYGSDDECSSASASSAGAGSNSGAGPGGALGSPKSNALYGAPGNLDALLEELREIKEGQSHLEDSMEDLKTQLQRDYTYMTQCLQEERYRYERLEEQLNDLTELHQNEMTNLKQELASMEEKVAYQSYERARDIQEAVESCLTRVTKLELQQQQQQVVQLEGVENANARALLGKFINVILALMAVLLVFVSTIANFITPLMKTRLRITSTTLLVLVLFLLWKHWDSLTYLLEHVLLPS

SEQ ID NO: 90644 - protein, 484 aa, Homo sapiens
  Payload ID: 18125
  Gene Name: transmembrane and coiled-coil domain family 2
  ENSP ID: ENSP00000331842
MNQVVQPLMSRHSACRGSQAHLSWVDKGDLVALSLPAGHGDTDGPISLDVPDGAPDPQRTKAAIDHLHQKILKITEQIKIEQEARDDNVAEYLKLANNADKQQVSRIKQVFEKKNQKSAQTIAQLHKKLEHYRRRLKEIEQNGPSRQPKDVLRDMQQGLKDVGANVRAGISGFGGGVVEGVKGSLSGLSQATHTAVVSKPREFASLIRNKFGSADNIAHLKDPLEDGPPEEAARALSGSATLVSSPKYGSDDECSSASASSAGAGSNSGAGPGGALGSPKSNALYGAPGNLDALLEELREIKEGQSHLEDSMEDLKTQLQRDYTYMTQCLQEERYRYERLEEQLNDLTELHQNEMTNLKQELASMEEKVAYQSYERARDIQEAVESCLTRVTKLELQQQQQQVVQLEGVENANARALLGKFINVILALMAVLLVFVSTIANFITPLMKTRLRITSTTLLVLVLFLLWKHWDSLTYLLEHVLLPS

SEQ ID NO: 90645 - protein, 709 aa, Homo sapiens
  Payload ID: 18125
  Gene Name: transmembrane and coiled-coil domain family 2
  Uniprot ID: O75069
  ENSP ID: ENSP00000350718
MKRCRSDELQQQQGEEDGAGLEDAASHLPGADLRPGETTGANSAGGPTSDAGAAAAPNPGPRSKPPDLKKIQQLSEGSMFGHGLKHLFHSRRRSREREHQTSQDSQQHQQQQGMSDHDSPDEKERSPEMHRVSYAMSLHDLPARPTAFNRVLQQIRSRPSIKRGASLHSSSGGGSSGSSSRRTKSSSLEPQRGSPHLLRKAPQDSSLAAILHQHQCRPRSSSTTDTALLLADGSNVYLLAEEAEGIGDKVDKGDLVALSLPAGHGDTDGPISLDVPDGAPDPQRTKAAIDHLHQKILKITEQIKIEQEARDDNVAEYLKLANNADKQQVSRIKQVFEKKNQKSAQTIAQLHKKLEHYRRRLKEIEQNGPSRQPKDVLRDMQQGLKDVGANVRAGISGFGGGVVEGVKGSLSGLSQATHTAVVSKPREFASLIRNKFGSADNIAHLKDPLEDGPPEEAARALSGSATLVSSPKYGSDDECSSASASSAGAGSNSGAGPGGALGSPKSNALYGAPGNLDALLEELREIKEGQSHLEDSMEDLKTQLQRDYTYMTQCLQEERYRYERLEEQLNDLTELHQNEMTNLKQELASMEEKVAYQSYERARDIQEAVESCLTRVTKLELQQQQQQVVQLEGVENANARALLGKFINVILALMAVLLVFVSTIANFITPLMKTRLRITSTTLLVLVLFLLWKHWDSLTYLLEHVLLPS

SEQ ID NO: 90646 - protein, 256 aa, Homo sapiens
  Payload ID: 18125
  Gene Name: transmembrane and coiled-coil domain family 2
  ENSP ID: ENSP00000356127
MNQVVQPLMSRHSACRGSQAHLSWLWTSVPLCWPLTEFPAGTVKMKSKEEETAVDKGDLVALSLPAGHGDTDGPISLDVPDGAPDPQRTKAAIDHLHQKILKITEQIKIEQEARDDNVAEYLKLANNADKQQVSRIKQVFEKKNQKSAQTIAQLHKKLEHYRRRLKEIEQNGPSRQPKDVLRDMQQGLKDVGANVRAGISGFGGGVVEGVKGSLSGLSQATHTAVVSKPREFASLIRNKFGSADNIAHLKDPLEDG

SEQ ID NO: 90647 - protein, 631 aa, Homo sapiens
  Payload ID: 18125
  Gene Name: transmembrane and coiled-coil domain family 2
  Uniprot ID: O75069
  ENSP ID: ENSP00000437943
MFGHGLKHLFHSRRRSREREHQTSQDSQQHQQQQGMSDHDSPDEKERSPEMHRVSYAMSLHDLPARPTAFNRVLQQIRSRPSIKRGASLHSSSGGGSSGSSSRRTKSSSLEPQRGSPHLLRKAPQDSSLAAILHQHQCRPRSSSTTDTALLLADGSNVYLLAEEAEGIGDKVDKGDLVALSLPAGHGDTDGPISLDVPDGAPDPQRTKAAIDHLHQKILKITEQIKIEQEARDDNVAEYLKLANNADKQQVSRIKQVFEKKNQKSAQTIAQLHKKLEHYRRRLKEIEQNGPSRQPKDVLRDMQQGLKDVGANVRAGISGFGGGVVEGVKGSLSGLSQATHTAVVSKPREFASLIRNKFGSADNIAHLKDPLEDGPPEEAARALSGSATLVSSPKYGSDDECSSASASSAGAGSNSGAGPGGALGSPKSNALYGAPGNLDALLEELREIKEGQSHLEDSMEDLKTQLQRDYTYMTQCLQEERYRYERLEEQLNDLTELHQNEMTNLKQELASMEEKVAYQSYERARDIQEAVESCLTRVTKLELQQQQQQVVQLEGVENANARALLGKFINVILALMAVLLVFVSTIANFITPLMKTRLRITSTTLLVLVLFLLWKHWDSLTYLLEHVLLPS

SEQ ID NO: 90648 - protein, 477 aa, Homo sapiens
  Payload ID: 18126
  Gene Name: transmembrane and coiled-coil domain family 3
  Uniprot ID: Q9ULS5
  ENSP ID: ENSP00000261226
MPGSDTALTVDRTYSYPGRHHRCKSRVERHDMNTLSLPLNIRRGGSDTNLNFDVPDGILDFHKVKLTADSLKQKILKVTEQIKIEQTSRDGNVAEYLKLVNNADKQQAGRIKQVFEKKNQKSAHSIAQLQKKLEQYHRKLREIEQNGASRSSKDISKDHLKDIHRSLKDAHVKSRTAPHCMESSKSGMPGVSLTPPVFVFNKSREFANLIRNKFGSADNIAHLKNSLEEFRPEASARAYGGSATIVNKPKYGSDDECSSGTSGSADSNGNQSFGAGGASTLDSQGKLAVILEELREIKDTQAQLAEDIEALKVQFKREYGFISQTLQEERYRYERLEDQLHDLTDLHQHETANLKQELASIEEKVAYQAYERSRDIQEALESCQTRISKLELHQQEQQALQTDTVNAKVLLGRCINVILAFMTVILVCVSTIAKFVSPMMKSRCHILGTFFAVTLLAIFCKNWDHILCAIERMIIPR

SEQ ID NO: 90649 - protein, 446 aa, Homo sapiens
  Payload ID: 18126
  Gene Name: transmembrane and coiled-coil domain family 3
  ENSP ID: ENSP00000449888
MNTLSLPLNIRRGGSDTNLNFDVPDGILDFHKVKLTADSLKQKILKVTEQIKIEQTSRDGNVAEYLKLVNNADKQQAGRIKQVFEKKNQKSAHSIAQLQKKLEQYHRKLREIEQNGASRSSKDISKDHLKDIHRSLKDAHVKSRTAPHCMESSKSGMPGVSLTPPVFVFNKSREFANLIRNKFGSADNIAHLKNSLEEFRPEASARAYGGSATIVNKPKYGSDDECSSGTSGSADSNGNQSFGAGGASTLDSQGKLAVILEELREIKDTQAQLAEDIEALKVQFKREYGFISQTLQEERYRYERLEDQLHDLTDLHQHETANLKQELASIEEKVAYQAYERSRDIQEALESCQTRISKLELHQQEQQALQTDTVNAKVLLGRCINVILAFMTVILVCVSTIAKFVSPMMKSRCHILGTFFAVTLLAIFCKNWDHILCAIERMIIPR

SEQ ID NO: 90650 - protein, 132 aa, Homo sapiens
  Payload ID: 18126
  Gene Name: transmembrane and coiled-coil domain family 3
  ENSP ID: ENSP00000450078
MNTLSLPLNIRRGGSDTNLNFDVPDGILDFHKVKLTADSLKQKILKVTEQIKIEQTSRDGNVAEYLKLVNNADKQQAGRIKQVFEKKNQKSAHSIAQLQKKLEQYHRKLREIEQNGASRSSKDISKDHLKDI

SEQ ID NO: 90651 - protein, 239 aa, Homo sapiens
  Payload ID: 18127
  Gene Name: transmembrane and coiled-coil domains 1
  ENSP ID: ENSP00000356856
MPRKRKCDLRAVRVGLLLGGGGVYGSRFRFTFPGCRALSPWRVRVQRRRCEMSTMFADTLLIVFISVCTALLAEGITWVLVYRTDKYKRLKAEVEKQSKKLEKKKETITESAGRQQKKKIERQEEKLKNNNRDLSMVRMKSMFAIGFCFTALMGMFNSIFDGRVVAKLPFTPLSYIQGLSHRNLLGDDTTDCSFIFLYILCTMSIRQNIQKILGLAPSRAATKQAGGFLGPPPPSGKFS

SEQ ID NO: 90652 - protein, 188 aa, Homo sapiens
  Payload ID: 18127
  Gene Name: transmembrane and coiled-coil domains 1
  Uniprot ID: Q9UM00
  ENSP ID: ENSP00000375975
MSTMFADTLLIVFISVCTALLAEGITWVLVYRTDKYKRLKAEVEKQSKKLEKKKETITESAGRQQKKKIERQEEKLKNNNRDLSMVRMKSMFAIGFCFTALMGMFNSIFDGRVVAKLPFTPLSYIQGLSHRNLLGDDTTDCSFIFLYILCTMSIRQNIQKILGLAPSRAATKQAGGFLGPPPPSGKFS

SEQ ID NO: 90653 - protein, 143 aa, Homo sapiens
  Payload ID: 18127
  Gene Name: transmembrane and coiled-coil domains 1
  ENSP ID: ENSP00000462300
MESIAEFSLVSGITWVLVYRTDKYKRLKAEVEKQSKKLEKKKETITESAGRQQKKKIERQEEKLKNNNRDLSMVRMKSMFAIGFCFTALMGMFNSIFDGRVVAKLPFTPLSYIQGLSHRNLLGDDTTDCSFIFLYILCTMSIR

SEQ ID NO: 90654 - protein, 104 aa, Homo sapiens
  Payload ID: 18127
  Gene Name: transmembrane and coiled-coil domains 1
  ENSP ID: ENSP00000462588
MVRMKSMFAIGFCFTALMGMFNSIFDGRVVAKLPFTPLSYIQGLSHRNLLGDDTTDCSFIFLYILCTMSIRQNIQKILGLAPSRAATKQAGGFLGPPPPSGKFS

SEQ ID NO: 90655 - protein, 152 aa, Homo sapiens
  Payload ID: 18127
  Gene Name: transmembrane and coiled-coil domains 1
  ENSP ID: ENSP00000463105
MPRKRKCDLRAVRVGLLLGGGGVYGSRFRFTFPGCRALSPWRVRVQRRRCEMSTMFADTLLIVFISVCTALLAEGITWVLVYRTDKYKRLKAEVEKQSKKLEKKKETITESAGRQQKKKIDRVSPYRPGWSTVTRSWPTAASNSWAQVILPL

SEQ ID NO: 90656 - protein, 104 aa, Homo sapiens; identical to SEQ ID NO: 90654
  Payload ID: 18127
  Gene Name: transmembrane and coiled-coil domains 1
  ENSP ID: ENSP00000463951

SEQ ID NO: 90657 - protein, 95 aa, Homo sapiens
  Payload ID: 18127
  Gene Name: transmembrane and coiled-coil domains 1
  ENSP ID: ENSP00000464127
  MOD_RES (1)..(1): Any amino acid
XCDLRAVRVGLLLGGGGVYGSRFRFTFPGCRALSPWRVRVQRRRCEMSTMFADTLLIVFISVCTALLAEGITWVLVYRTDKYKRLKAEVEKQSKK

SEQ ID NO: 90658 - protein, 239 aa, Homo sapiens; identical to SEQ ID NO: 90651
  Payload ID: 18127
  Gene Name: transmembrane and coiled-coil domains 1
  ENSP ID: ENSP00000480514

SEQ ID NO: 90659 - protein, 152 aa, Homo sapiens; identical to SEQ ID NO: 90655
  Payload ID: 18127
  Gene Name: transmembrane and coiled-coil domains 1
  ENSP ID: ENSP00000485789

SEQ ID NO: 90660 - protein, 182 aa, Homo sapiens
  Payload ID: 18128
  Gene Name: transmembrane and coiled-coil domains 2
  Uniprot ID: Q7Z6W1
  ENSP ID: ENSP00000361852
MSTSSSSSWDNLLESLSLSTVWNWIQASFLGETSAPQQTSLGLLDNLAPAVQIILRISFLILLGIGIYALWKRSIQSIQKTLLFVITLYKLYKKGSHIFEALLANPEGSGLRIQDNNNLFLSLGLQEKILKKLKTVENKMKNLEGIIVAQKPATKRDCSSEPYCSCSDCQSPLSTSGFTSPI

SEQ ID NO: 90661 - protein, 414 aa, Homo sapiens
  Payload ID: 18129
  Gene Name: transmembrane and coiled-coil domains 3
  Uniprot ID: Q6UWJ1
  ENSP ID: ENSP00000364540
MKVLGRSFFWVLFPVLPWAVQAVEHEEVAQRVIKLHRGRGVAAMQSRQWVRDSCRKLSGLLRQKNAVLNKLKTAIGAVEKDVGLSDEEKLFQVHTFEIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVKGVNFEAVLRVEEEEANSKQNITKREVEDDLGLSMLIDSQNNQYILTKPRDSTIPRADHHFIKDIVTIGMLSLPCGWLCTAIGLPTMFGYIICGVLLGPSGLNSIKSIVQVETLGEFGVFFTLFLVGLEFSPEKLRKVWKISLQGPCYMTLLMIAFGLLWGHLLRIKPTQSVFISTCLSLSSTPLVSRFLMGSARGDKEGNRTAL

SEQ ID NO: 90662 - protein, 677 aa, Homo sapiens
  Payload ID: 18129
  Gene Name: transmembrane and coiled-coil domains 3
  Uniprot ID: Q6UWJ1
  ENSP ID: ENSP00000389399
MKVLGRSFFWVLFPVLPWAVQAVEHEEVAQRVIKLHRGRGVAAMQSRQWVRDSCRKLSGLLRQKNAVLNKLKTAIGAVEKDVGLSDEEKLFQVHTFEIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVKGVNFEAVLRVEEEEANSKQNITKREVEDDLGLSMLIDSQNNQYILTKPRDSTIPRADHHFIKDIVTIGMLSLPCGWLCTAIGLPTMFGYIICGVLLGPSGLNSIKSIVQVETLGEFGVFFTLFLVGLEFSPEKLRKVWKISLQGPCYMTLLMIAFGLLWGHLLRIKPTQSVFISTCLSLSSTPLVSRFLMGSARGDKEGDIDYSTVLLGMLVTQDVQLGLFMAVMPTLIQAGASASSSIVVEVLRILVLIGQILFSLAAVFLLCLVIKKYLIGPYYRKLHMESKGNKEILILGISAFIFLMLTVTELLDVSMELGCFLAGALVSSQGPVVTEEIATSIEPIRDFLAIVFFASIGLHVFPTFVAYELTVLVFLTLSVVVMKFLLAALVLSLILPRSSQYIKWIVSAGLAQVSEFSFVLGSRARRAGVISREVYLLILSVTTLSLLLAPVLWRAAITRCVPRPERRSSL

SEQ ID NO: 90663 - protein, 145 aa, Homo sapiens
  Payload ID: 18129
  Gene Name: transmembrane and coiled-coil domains 3
  ENSP ID: ENSP00000478818
  MOD_RES (1)..(1): Any amino acid
XIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVSVPEQLLLHLLSHSLIRRHVVEIVHVYVFNVD

SEQ ID NO: 90664 - protein, 94 aa, Homo sapiens
  Payload ID: 18129
  Gene Name: transmembrane and coiled-coil domains 3
  ENSP ID: ENSP00000479613
FLLAALVLSLILPRSSQYIKWIVSAGLAQVSEFSFVLGSRARRAGVISREVYLLILSVTTLSLLLAPVLWRAAITRPHLPTLAVHIEGTEAFEP

SEQ ID NO: 90665 - protein, 163 aa, Homo sapiens
  Payload ID: 18129
  Gene Name: transmembrane and coiled-coil domains 3
  ENSP ID: ENSP00000481060
NITKREVEDDLGLSMLIDSQNNQYILTKPRDSTIPRADHHFIKDIVTIGMLSLPCGWLCTAIGLPTMFGYIICGVLLGPSGLNSIKVWKISLQGPCYMTLLMIAFGLLWGHLLRIKPTQSVFISTCLSLSSTPLVSRFLMGSARGDKEGDIDYSTVLLGMLVT

SEQ ID NO: 90666 - protein, 126 aa, Homo sapiens
  Payload ID: 18129
  Gene Name: transmembrane and coiled-coil domains 3
  ENSP ID: ENSP00000482311
ITKREVEDDLGLSMLIDSQNNQYILTKPRDSTIPRADHHFIKDIVTIGMLSLPCGWLCTAIGLPTMFGYIICGVLLGPSGLNSIKSIVQVETLGEFGVFFTLFLVGLEFSPEKLRKVRTSSTCYCS

SEQ ID NO: 90667 - protein, 524 aa, Homo sapiens
  Payload ID: 18129
  Gene Name: transmembrane and coiled-coil domains 3
  Uniprot ID: Q6UWJ1
  ENSP ID: ENSP00000484053
MKVLGRSFFWVLFPVLPWAVQAVEHEEVAQRVIKLHRGRGVAAMQSRQWVRDSCRKLSGLLRQKNAVLNKLKTAIGAVEKDVGLSDEEKLFQVHTFEIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVKGVNFEAVLRVEEEEANSKQNITKREVEDDLGLSMLIDSQNNQYILTKPRDSTIPRADHHFIKDIVTIGMLSLPCGWLCTAIGLPTMFGYIICGVLLGPSGLNSIKSIVQVETLGEFGVFFTLFLVGLEFSPEKLRKVWKISLQGPCYMTLLMIAFGLLWGHLLRIKPTQSVFISTCLSLSSTPLVSRFLMGSARGDKEGDIDYSTVLLGMLVTQDVQLGLFMAVMPTLIQAGASASSSIVVEVLRILVLIGQILFSLAAVFLLCLVIKKYLIGPYYRKLHMESKGNKEILILGISAFIFLMLTVILKLCVIYVI

SEQ ID NO: 90668 - protein, 84 aa, Homo sapiens
  Payload ID: 18129
  Gene Name: transmembrane and coiled-coil domains 3
  ENSP ID: ENSP00000484911
ILPRSSQYIKWIVSAGLAQVSEFSFVLGSRARRAGVISREVYLLILSVTTLSLLLAPVLWRAAITRPHLPTLAVHIEGTEAFEP

SEQ ID NO: 90669 - protein, 634 aa, Homo sapiens
  Payload ID: 18130
  Gene Name: transmembrane and coiled-coil domains 4
  Uniprot ID: Q5TGY1
  ENSP ID: ENSP00000294543
MAMWNRPCQRLPQQPLVAEPTAEGEPHLPTGRELTEANRFAYAALCGISLSQLFPEPEHSSFCTEFMAGLVQWLELSEAVLPTMTAFASGLGGEGADVFVQILLKDPILKDDPTVITQDLLSFSLKDGHYDARARVLVCHMTSLLQVPLEELDVLEEMFLESLKEIKEEESEMAEASRKKKENRRKWKRYLLIGLATVGGGTVIGVTGGLAAPLVAAGAATIIGSAGAAALGSAAGIAIMTSLFGAAGAGLTGYKMKKRVGAIEEFTFLPLTEGRQLHITIAVTGWLASGKYRTFSAPWAALAHSREQYCLAWEAKYLMELGNALETILSGLANMVAQEALKYTVLSGIVAALTWPASLLSVANVIDNPWGVCLHRSAEVGKHLAHILLSRQQGRRPVTLIGFSLGARVIYFCLQEMAQEKDCQGIIEDVILLGAPVEGEAKHWEPFRKVVSGRIINGYCRGDWLLSFVYRTSSVQLRVAGLQPVLLQDRRVENVDLTSVVSGHLDYAKQMDAILKAVGIRTKPGWDEKGLLLAPGCLPSEEPRQAAAAASSGETPHQVGQTQGPISGDTSKLAMSTDPSQAQVPVGLDQSEGASLPAAASPERPPICSHGMDPNPLGCPDCACKTQGPSTGLD

SEQ ID NO: 90670 - protein, 580 aa, Homo sapiens
  Payload ID: 18130
  Gene Name: transmembrane and coiled-coil domains 4
  ENSP ID: ENSP00000364269
MAMWNRPCQRLPQQPLVAEPTAEGEPHLPTGRELTEANRFAYAALCGISLSQLFPEPEHSSFCTEFMAGLVQWLELSEAVLPTMTAFASGLGGEGADVFVQILLKDPILKDDPTVITQDLLSFSLKDGHYDARARVLVCHMTSLLQVPLEELDVLEEMFLESLKEIKEEESEMAEASRKKKENRRKWKRYLLIGLATVGGGTVIGVTGGLAAPLVAAGAATIIGSAGAAALGSAAGIAIMTSLFGAAGAGLTGYKMKKRVGAIEEFTFLPLTEGRQLHITIAVTGWLASGKYRTFSAPWAALAHSREQYCLAWEAKYLMELGNALETILSGLANMVAQEALKYTVLSGIVAALTWPASLLSVANVIDNPWGVCLHRSAEVGKHLAHILLSRQQGRRPVTLIGFSLGARVIYFCLQEMAQEKDCQGIIEDVILLGAPVEGEAKHWEPFRKVVSGRIINGYCRGDWLLSFVYRTSSVQLRVAGLQPVLLQDRRVENVDLTSVVSGHLDYAKQMDAILKAVGIRTKPGWDEKGLLLAPGCLPSEEPRQAAAAASSALESGCPSGGPEGSLGPEAPTPALPWPQ

SEQ ID NO: 90671 - protein, 288 aa, Homo sapiens
  Payload ID: 18131
  Gene Name: transmembrane and coiled-coil domains 5A
  Uniprot ID: Q8N6Q1
  ENSP ID: ENSP00000327234
MEISRLAQSKRNIISLNMDLERDTQRIDEANQKLLLKIQEREDKIQRLESEIIQTRGLVEDEEWEKENRTTMERERALQELEEETARLERKNKTLVHSITELQQKLTRKSQKITNCEQSSPDGALEETKVKLQQLEASYACQEKELLKVMKEYAFVTQLCEDQALYIKKYQETLKKIEEELEALFLEREVSKLVSMNPVEKEHTSQNNEGTPTQKTARLFSKKIFCCLFFITLFFIRLLSYMFFHVRFINPDLLVNVLPKVLGRSTLWKLRCFFFPSLTLETEDMLPH

SEQ ID NO: 90672 - protein, 190 aa, Homo sapiens
  Payload ID: 18131
  Gene Name: transmembrane and coiled-coil domains 5A
  ENSP ID: ENSP00000453047
MEISRLAQSKRNIISLNMDLERDTQRIDEANQKLLLKIQEREDKIQRLESEIIQTRGLVEDEEWEKENRTTMERERALQELEEETARLERKNKTLVHSITELQQKLTRKSQKITNCEQSSPDGALEETKVKLQQLEASYACQEKELLKVMKEYAFVTQLCEDQALYIKKYQETLKKIEEELEALFLEREV

SEQ ID NO: 90673 - protein, 70 aa, Homo sapiens
  Payload ID: 18131
  Gene Name: transmembrane and coiled-coil domains 5A
  ENSP ID: ENSP00000453162
MEISRLAQSKRNIISLNMDLERDTQRIDEANQKLLLKIQEREDKIQRLESEIIQTRGLVEDEEWEKENRT

SEQ ID NO: 90674 - protein, 144 aa, Homo sapiens
  Payload ID: 18131
  Gene Name: transmembrane and coiled-coil domains 5A
  ENSP ID: ENSP00000453271
MEISRLAQSKRNIISLNMDLERDTQRIDEANQKLLLKIQEREDKIQRLESEIIQTRGLVEDEEWEKENRTTMERERALQELEEETARLERKNKTLVHSITELQQKLTRKSQKITNCEQSSPDGALEETKVKLQQLEASYACQEK

SEQ ID NO: 90675 - protein, 81 aa, Homo sapiens
  Payload ID: 18131
  Gene Name: transmembrane and coiled-coil domains 5A
  ENSP ID: ENSP00000453369
MEISRLAQSKRNIISLNMDLERDTQRIDEANQKLLLKIQEREDKIQRLESEIIQTRGLVEDEEWEKENRTTMERERALQEL

SEQ ID NO: 90676 - protein, 190 aa, Homo sapiens
  Payload ID: 18131
  Gene Name: transmembrane and coiled-coil domains 5A
  ENSP ID: ENSP00000453561
MEISRLAQSKRNIISLNMDLERDTQRIDEANQKLLLKIQEREDKIQRLESEIIQTRGLVEDEEWEKENRTTMERERALQELEEETARLERKNKTLVHSITELQQKLTRKSQKITNCEQSSPDGALEETKVKLQQLEASYACQEKELLKVMKEYAFVTQLCEDQALYIKVELLEVPGNVEENRRRTRGSVP

SEQ ID NO: 90677 - protein, 228 aa, Homo sapiens
  Payload ID: 18131
  Gene Name: transmembrane and coiled-coil domains 5A
  Uniprot ID: Q8N6Q1
  ENSP ID: ENSP00000454112
MEISRLAQSKRNIISLNMDLERDTQRIDEANQKLLLKIQEREDKIQRLESEIIQTRGLVEDEEWEKENRTTMERERALQELEEETARLERKNKTLVHSITELQQKLTRKSQKITNCEQSSPDGALEETKVKLQQLEASYACQEKELLKVMKEYAFVTQLCEDQALYIKKYQETLKKIEEELEALFLEREVSKLVSMNPVEKEHTSQNNEGTPTQKTARLFSKKWASSF

SEQ ID NO: 90678 - protein, 499 aa, Homo sapiens
  Payload ID: 18132
  Gene Name: transmembrane and coiled-coil domains 6
  Uniprot ID: Q96DC7
  ENSP ID: ENSP00000252100
MWSRRQGRLRPTVCGVEELRRRRREREAALRKARREQQLVSKRLLRNDAPEEAGEGCVAAILGETEVQQFLRQAQRGTEEKEREGALVSLRRGLQHPETQQTFIRLEGSMRTLVGLLTSNQALLQLEAARCLHELSHSEQSTVAEACLPATSYLLTYLSSHSSDFIELCLYTLGNLIVESEAVRRQLLPQGIVPALAACIQSPHVAVLEALGYALSQLLQAEEAPEKIIPPASASSSILASTLPQHMLQMLQPGPKLNPGVAVEFAWCLHYIICSQVSNPLLIGHGALSTLGLLLLDLAGAVQKTEDAGLELLACPVLRCLSNLLTEAAVETVGGQMQLRDERVVAALFILLQFFFQKQPSLLPEGLWLLNNLTANSPSFCTSLLSLDLIEPLLQLLPVSNVVSVMVLTVLCNVAEKGPAYCQRLWPGPLLPALLHTLAFSDTEVVGQSLELLHLLFLYQPEAVQVFLQQSGLQALERHQEEAQLQDRVYALQQTALQG

SEQ ID NO: 90679 - protein, 493 aa, Homo sapiens
  Payload ID: 18132
  Gene Name: transmembrane and coiled-coil domains 6
  Uniprot ID: Q96DC7
  ENSP ID: ENSP00000378166
MWSRRQGRLRPTVCGVEELRRRRREREAALRKARREQQLVSKRLLRNDAPEEAGEGCVAAILGETEVQQFLRQAQRGTEEKEREGALVSLRRGLQHPETQQTFIRLEGSMRTLVGLLTSNQALLQLEAARCLHELSHSEQSTVAEACLPATSYLLTYLSSHSSDFIELCLYTLGNLIVESEAVRRQLLPQGIVPALAACIQSPHVAVLEALGYALSQLLQAEEAPEKIIPSILASTLPQHMLQMLQPGPKLNPGVAVEFAWCLHYIICSQVSNPLLIGHGALSTLGLLLLDLAGAVQKTEDAGLELLACPVLRCLSNLLTEAAVETVGGQMQLRDERVVAALFILLQFFFQKQPSLLPEGLWLLNNLTANSPSFCTSLLSLDLIEPLLQLLPVSNVVSVMVLTVLCNVAEKGPAYCQRLWPGPLLPALLHTLAFSDTEVVGQSLELLHLLFLYQPEAVQVFLQQSGLQALERHQEEAQLQDRVYALQQTALQG

SEQ ID NO: 90680 - protein, 57 aa, Homo sapiens
  Payload ID: 18132
  Gene Name: transmembrane and coiled-coil domains 6
  ENSP ID: ENSP00000421613
MRTLVGLLTSNQALLQLEAARCLHELSHSEQSTVAEACLPATSYLLTYLSSHSSDFI

SEQ ID NO: 90681 - protein, 101 aa, Homo sapiens
  Payload ID: 18132
  Gene Name: transmembrane and coiled-coil domains 6
  ENSP ID: ENSP00000423297
MWSRRQGRLRPTVCGVEELRRRRREREAALRKARREQQLVSKRLLRNDAPEEAGEGCVAAILGETEVRGQGAAVPAASPAGDRGKGERGGSGQPSSRLAAP

SEQ ID NO: 90682 - protein, 43 aa, Homo sapiens
  Payload ID: 18132
  Gene Name: transmembrane and coiled-coil domains 6
  ENSP ID: ENSP00000424937
MWSRRQGRLRPTVCGVEELRRRRREREHCGRRGGSSSWSARGC

SEQ ID NO: 90683 - protein, 43 aa, Homo sapiens; identical to SEQ ID NO: 90682
  Payload ID: 18132
  Gene Name: transmembrane and coiled-coil domains 6
  ENSP ID: ENSP00000426221

SEQ ID NO: 90684 - protein, 43 aa, Homo sapiens; identical to SEQ ID NO: 90682
  Payload ID: 18132
  Gene Name: transmembrane and coiled-coil domains 6
  ENSP ID: ENSP00000443223

SEQ ID NO: 90685 - protein, 43 aa, Homo sapiens; identical to SEQ ID NO: 90682
  Payload ID: 18132
  Gene Name: transmembrane and coiled-coil domains 6
  ENSP ID: ENSP00000445469

SEQ ID NO: 90686 - protein, 262 aa, Homo sapiens
  Payload ID: 18133
  Gene Name: transmembrane and immunoglobulin domain containing 1
  Uniprot ID: Q6UXZ0
  ENSP ID: ENSP00000332404
MAWKSSVIMQMGRFLLLVILFLPREMTSSVLTVNGKTENYILDTTPGSQASLICAVQNHTREEELLWYREEGRVDLKSGNKINSSSVCVSSISENDNGISFTCRLGRDQSVSVSVVLNVTFPPLLSGNDFQTVEEGSNVKLVCNVKANPQAQMMWYKNSSLLDLEKSRHQIQQTSESFQLSITKVEKPDNGTYSCIAKSSLKTESLDFHLIVKDKTVGVPIEPIIAACVVIFLTLCFGLIARRKKIMKLCMKDKDPHSETAL

SEQ ID NO: 90687 - protein, 218 aa, Homo sapiens
  Payload ID: 18133
  Gene Name: transmembrane and immunoglobulin domain containing 1
  Uniprot ID: Q6UXZ0
  ENSP ID: ENSP00000446118
MAWKSSVIMQMGRFLLLVILFLPREMTSSVLTVNGKTENYILDTTPGSQASLICAVQNHTREEELLWYREEGRVDLKSGNKINSSSVCVSSISENDNGISFTCRLGRDQSVSVSVVLNVTFPPLLSGNDFQTVEEGSNVKLVCNVKANPQAQMMWYKNSSLLDLEKSRHQIQQTSESFQLSITKVEKPDNGTYSCIAKSSLKTESLDFHLIVKALHEG

SEQ ID NO: 90688 - protein, 282 aa, Homo sapiens
  Payload ID: 18134
  Gene Name: transmembrane and immunoglobulin domain containing 2
  Uniprot ID: Q96BF3
  ENSP ID: ENSP00000301272
MGSPGMVLGLLVQIWALQEASSLSVQQGPNLLQVRQGSQATLVCQVDQATAWERLRVKWTKDGAILCQPYITNGSLSLGVCGPQGRLSWQAPSHLTLQLDPVSLNHSGAYVCWAAVEIPELEEAEGNITRLFVDPDDPTQNRNRIASFPGFLFVLLGVGSMGVAAIVWGAWFWGRRSCQQRDSGNSPGNAFYSNVLYRPRGAPKKSEDCSGEGKDQRGQSIYSTSFPQPAPRQPHLASRPCPSPRPCPSPRPGHPVSMVRVSPRPSPTQQPRPKGFPKVGEE

SEQ ID NO: 90689 - protein, 162 aa, Homo sapiens
  Payload ID: 18134
  Gene Name: transmembrane and immunoglobulin domain containing 2
  ENSP ID: ENSP00000470494
MGSPGMVLGLLVQIWDDPTQNRNRIASFPGFLFVLLGVGSMGVAAIVWGAWFWGRRSCQQRDSGNSPGNAFYSNVLYRPRGAPKKSEDCSGEGKDQRGQSIYSTSFPQPAPRQPHLASRPCPSPRPCPSPRPGHPVSMVRVSPRPSPTQQPRPKGFPKVGEE

SEQ ID NO: 90690 - protein, 278 aa, Homo sapiens
  Payload ID: 18134
  Gene Name: transmembrane and immunoglobulin domain containing 2
  Uniprot ID: Q96BF3
  ENSP ID: ENSP00000470561
MGSPGMVLGLLVQIWALQEASSLSVQQGPNLLQVRQGSQATLVCQVDQATAWERLRVKWTKDGAILCQPYITNGSLSLGVCGPQGRLSWQAPSHLTLQLDPVSLNHSGAYVCWAAVEIPELEEAEGNITRLFVDPDDPTQNRNRIASFPGFLFVLLGVGSMGVAAIVWGAWFWGRRSCQQRDSGNAFYSNVLYRPRGAPKKSEDCSGEGKDQRGQSIYSTSFPQPAPRQPHLASRPCPSPRPCPSPRPGHPVSMVRVSPRPSPTQQPRPKGFPKVGEE

SEQ ID NO: 90691 - protein, 110 aa, Homo sapiens
  Payload ID: 18134
  Gene Name: transmembrane and immunoglobulin domain containing 2
  ENSP ID: ENSP00000471821
MGSPGMVLGLLVQIWGNAFYSNVLYRPRGAPKKSEDCSGEGKDQRGQSIYSTSFPQPAPRQPHLASRPCPSPRPCPSPRPGHPVSMVRVSPRPSPTQQPRPKGFPKVGEE

SEQ ID NO: 90692 - protein, 347 aa, Homo sapiens
  Payload ID: 18135
  Gene Name: transmembrane and immunoglobulin domain containing 3
  ENSP ID: ENSP00000358730
MPNNSTALSLANVTYITMEIFIGLCAIVGNVLVICVVKLNPSLQTTTFYFIVSLALADIAVGVLVMPLAIVVSLGITIHFYSCLFMTCLLLIFTHASIMSLLAIAVDRYLRVKLTVRFRIPGLPGCILSFQLKVCFLPVMWLFILLSLALISDAMVMDEKVKRSFVLDTASAICNYNAHYKNHPKYWCRGYFRDYCNIIAFSPNSTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRVGNTLKPFSRVLTPKEMAPTEQM

SEQ ID NO: 90693 - protein, 266 aa, Homo sapiens
  Payload ID: 18135
  Gene Name: transmembrane and immunoglobulin domain containing 3
  Uniprot ID: P0DMS9
  ENSP ID: ENSP00000358731
MEGSPAGPIEQKEARWESSWEEQPDWTLGCLSPESQFRIPGLPGCILSFQLKVCFLPVMWLFILLSLALISDAMVMDEKVKRSFVLDTASAICNYNAHYKNHPKYWCRGYFRDYCNIIAFSPNSTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRVGNTLKPFSRVLTPKEMAPTEQM

SEQ ID NO: 90694 - protein, 172 aa, Homo sapiens
  Payload ID: 18135
  Gene Name: transmembrane and immunoglobulin domain containing 3
  ENSP ID: ENSP00000398770
GPIEQKEARWESSWEEQPDWTLGCLSPESHTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRVGNTLKPFSRVLTPKEMAPTEQM

SEQ ID NO: 90695 - protein, 158 aa, Homo sapiens
  Payload ID: 18135
  Gene Name: transmembrane and immunoglobulin domain containing 3
  ENSP ID: ENSP00000415646
KPQALQGPPSSNDAMVMDEKVKRSFVLDTASAICNYNAHYKNHPKYWCRGYFRDYCNIIAFSPNSTNHVALRDTGNQLIVTMSCLTKEDTGWYWCGIQRDFARDDMDFTELIVTDDKGTLANDFWSGKDLSGNKTRSCKAPKVVRKTAPGRPFSSFAY

SEQ ID NO: 90696 - protein, 107 aa, Homo sapiens
  Payload ID: 18135
  Gene Name: transmembrane and immunoglobulin domain containing 3
  ENSP ID: ENSP00000488683
VTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRGK

SEQ ID NO: 90697 - protein, 774 aa, Homo sapiens
  Payload ID: 18136
  Gene Name: transmembrane and tetratricopeptide repeat containing 1
  Uniprot ID: Q8IUR5
  ENSP ID: ENSP00000256062
MNPFYFHAVNIILHCLVTLVLMYTCDKTVFKNRGLAFVTALLFAVHPIHTEAVAGIVGRADVLACLLFLLAFLSYNRSLDQGCVGGSFPSTVSPFFLLLSLFLGTCAMLVKETGITVFGVCLVYDLFSLSNKQDKSSNGALCPRSPQQPGSPQPSSLPGHPHRENGKQQRFPHKGAWGGCHSPLPPEPKSSGFPVSPRAVWSMMRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALKLYPRHASALNNLGTLTRDTAEAKMYYQRALQLHPQHNRALFNLGNLLKSQEKKEEAITLLKDSIKYGPEFADAYSSLASLLAEQERFKEAEEIYQTGIKNCPDSSDLHNNYGVFLVDTGLPEKAVAHYQQAIKLSPSHHVAMVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 90698 - protein, 882 aa, Homo sapiens
  Payload ID: 18136
  Gene Name: transmembrane and tetratricopeptide repeat containing 1
  Uniprot ID: Q8IUR5
  ENSP ID: ENSP00000442046
MVVTTSARGGGGDRTPSRRRGCGLAPAGAAALLAGASCLCYGRSLQGEFVHDDVWAIVNNPDVRPGAPLRWGIFTNDFWGKGMAENTSHKSYRPLCVLTFKLNIFLTGMNPFYFHAVNIILHCLVTLVLMYTCDKTVFKNRGLAFVTALLFAVHPIHTEAVAGIVGRADVLACLLFLLAFLSYNRSLDQGCVGGSFPSTVSPFFLLLSLFLGTCAMLVKETGITVFGVCLVYDLFSLSNKQDKSSNGALCPRSPQQPGSPQPSSLPGHPHRENGKQQRFPHKGAWGGCHSPLPPEPKSSGFPVSPRAVWSMMRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALKLYPRHASALNNLGTLTRDTAEAKMYYQRALQLHPQHNRALFNLGNLLKSQEKKEEAITLLKDSIKYGPEFADAYSSLASLLAEQERFKEAEEIYQTGIKNCPDSSDLHNNYGVFLVDTGLPEKAVAHYQQAIKLSPSHHVAMVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 90699 - protein, 944 aa, Homo sapiens
  Payload ID: 18136
  Gene Name: transmembrane and tetratricopeptide repeat containing 1
  ENSP ID: ENSP00000448112
MVVTTSARGGGGDRTPSRRRGCGLAPAGAAALLAGASCLCYGRSLQGEFVHDDVWAIVNNPDVRPGAPLRWGIFTNDFWGKGMAENTSHKSYRPLCVLTFKLNIFLTGMNPFYFHAVNIILHCLVTLVLMYTCDKTVFKNRGLAFVTALLFAVHPIHTEAVAGIVGRADVLACLLFLLAFLSYNRSLDQGCVGGSFPSTVSPFFLLLSLFLGTCAMLVKETGITVFGVCLVYDLFSLSNKQDKSSNGALCPRSPQQPGSPQPSSLPGHPHRENGKQQRFPHKGAWGGCHSPLPPEPKSSGFPVSPRAVWSMMRYLRASSNRNFLLTMRPFLKRAILVLSYVLVILYFRLWIMGGSMPLFSEQDNPASFSPYILTRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALKLYPRHASALNNLGTLTRDTAEAKMYYQRALQLHPQHNRALFNLGNLLKSQEKKEEAITLLKDSIKYGPEFADAYSSLASLLAEQERFKEAEEIYQTGIKNCPDSSDLHNNYGVFLVDTGLPEKAVAHYQQAIKLSPSHHVAMVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 90700 - protein, 906 aa, Homo sapiens
  Payload ID: 18136
  Gene Name: transmembrane and tetratricopeptide repeat containing 1
  ENSP ID: ENSP00000449043
MVVTTSARGGGGDRTPSRRRGCGLAPAGAAALLAGASCLCYGRSLQGEFVHDDVWAIVNNPDVRPGAPLRWGIFTNDFWGKGMAENTSHKSYRPLCVLTFKLNIFLTGMNPFYFHAVNIILHCLVTLVLMYTCDKTVFKNRGLAFVTALLFAVHPIHTEAVAGIVGRADVLACLLFLLAFLSYNRSLDQGCVGGSFPSTVSPFFLLLSLFLGTCAMLVKETGITVFGVCLVYDLFSLSNKQDKSSNGALCPRSPQQPGSPQPSSLPGHPHRENGKQQRFPHKGAWGGCHSPLPPEPKSSGFPVSPRAVWSMMRYLRASSNRNFLLTMRPFLKRAILVLSYVLVILYFRLWIMGGSMPLFSEQDNPASFSPYILTRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRLYPRHASALNNLGTLTRDTAEAKMYYQRALQLHPQHNRALFNLGNLLKSQEKKEEAITLLKDSIKYGPEFADAYSSLASLLAEQERFKEAEEIYQTGIKNCPDSSDLHNNYGVFLVDTGLPEKAVAHYQQAIKLSPSHHVAMVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 90701 - protein, 130 aa, Homo sapiens
  Payload ID: 18136
  Gene Name: transmembrane and tetratricopeptide repeat containing 1
  ENSP ID: ENSP00000449054
FRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALNNNKAWDYLCWRFRKTLTDLP

SEQ ID NO: 90702 - protein, 836 aa, Homo sapiens
  Payload ID: 18137
  Gene Name: transmembrane and tetratricopeptide repeat containing 2
  Uniprot ID: Q8N394
  ENSP ID: ENSP00000322300
MIAELVSSALGLALYLNTLSADFCYDDSRAIKTNQDLLPETPWTHIFYNDFWGTLLTHSGSHKSYRPLCTLSFRLNHAIGGLNPWSYHLVNVLLHAAVTGLFTSFSKILLGDGYWTFMAGLMFASHPIHTEAVAGIVGRADVGASLFFLLSLLCYIKHCSTRGYSARTWGWFLGSGLCAGCSMLWKEQGVTVLAVSAVYDVFVFHRLKIKQILPTIYKRKNLSLFLSISLLIFWGSSLLGARLYWMGNKPPSFSNSDNPAADSDSLLTRTLTFFYLPTKNLWLLLCPDTLSFDWSMDAVPLLKTVCDWRNLHTVAFYTGLLLLAYYGLKSPSVDRECNGKTVTNGKQNANGHSCLSDVEYQNSETKSSFASKVENGIKNDVSQRTQLPSTENIVVLSLSLLIIPFVPATNLFFYVGFVIAERVLYIPSMGFCLLITVGARALYVKVQKRFLKSLIFYATATLIVFYGLKTAIRNGDWQNEEMLYRSGIKVNPAKAWGNLGNVLKSQSKISEAESAYRNALYYRSNMADMLYNLGLLLQENSRFAEALHYYKLAIGSRPTLASAYLNTGIILMNQGRTEEARRTFLKCSEIPDENLKDPHAHKSSVTSCLYNLGKLYHEQGHYEEALSVYKEAIQKMPRQFAPQSLYNMMGEAYMRLSKLPEAEHWYMESLRSKTDHIPAHLTYGKLLALTGRKSEAEKLFLKAIELDPTKGNCYMHYGQFLLEEARLIEAAEMAKKAAELDSTEFDVVFNAAHMLRQASLNEAAEKYYDLAARLRPNYPAALMNLGAILHLNGRLQKAEANYLRALQLKPDDVITQSNLRKLWNIMEKQGLKTSKT

SEQ ID NO: 90703 - protein, 830 aa, Homo sapiens
  Payload ID: 18137
  Gene Name: transmembrane and tetratricopeptide repeat containing 2
  ENSP ID: ENSP00000447609
MEPSSCRKTSSGLRTPTDYTLCRAIKTNQDLLPETPWTHIFYNDFWGTLLTHSGSHKSYRPLCTLSFRLNHAIGGLNPWSYHLVNVLLHAAVTGLFTSFSKILLGDGYWTFMAGLMFASHPIHTEAVAGIVGRADVGASLFFLLSLLCYIKHCSTRGYSARTWGWFLGSGLCAGCSMLWKEQGVTVLAVSAVYDVFVFHRLKIKQILPTIYKRKNLSLFLSISLLIFWGSSLLGARLYWMGNKPPSFSNSDNPAADSDSLLTRTLTFFYLPTKNLWLLLCPDTLSFDWSMDAVPLLKTVCDWRNLHTVAFYTGLLLLAYYGLKSPSVDRECNGKTVTNGKQNANGHSCLSDVEYQNSETKSSFASKVENGIKNDVSQRTQLPSTENIVVLSLSLLIIPFVPATNLFFYVGFVIAERVLYIPSMGFCLLITVGARALYVKVQKRFLKSLIFYATATLIVFYGLKTAIRNGDWQNEEMLYRSGIKVNPAKAWGNLGNVLKSQSKISEAESAYRNALYYRSNMADMLYNLGLLLQENSRFAEALHYYKLAIGSRPTLASAYLNTGIILMNQGRTEEARRTFLKCSEIPDENLKDPHAHKSSVTSCLYNLGKLYHEQGHYEEALSVYKEAIQKMPRQFAPQSLYNMMGEAYMRLSKLPEAEHWYMESLRSKTDHIPAHLTYGKLLALTGRKSEAEKLFLKAIELDPTKGNCYMHYGQFLLEEARLIEAAEMAKKAAELDSTEFDVVFNAAHMLRQASLNEAAEKYYDLAARLRPNYPAALMNLGAILHLNGRLQKAEANYLRALQLKPDDVITQSNLRKLWNIMEKQGLKTSKT

SEQ ID NO: 90704 - protein, 637 aa, Homo sapiens
  Payload ID: 18137
  Gene Name: transmembrane and tetratricopeptide repeat containing 2
  ENSP ID: ENSP00000448292
MIAELVSSALGLALYLNTLSADFCYDDSRAIKTNQDLLPETPWTHIFYNDFWGTLLTHSGSHKSYRPLCTLSFRLNHAIGGLNPWSYHLVNVLLHAAVTGLFTSFSKILLGDGYWTFMAGLMFASHPIHTEAVAGIVGRADVGASLFFLLSLLCYIKHCSTRGYSARTWGWFLGSGLCAGCSMLWKEQGVTVLAVSAVYDVFVFHRLKIKQILPTIYKRKNLSLFLSISLLIFWGSSLLGARLYWMGNKPPSFSNSDNPAADSDSLLTRTLTFFYLPTKNLWLLLCPDTLSFDWSMDAVPLLKTVCDWRNLHTVAFYTGLLLLAYYGLKSPSVDRECNGKTVTNGKQNANGHSCLSDVEYQNSETKSSFASKVENGIKNDVSQRTQLPSTENIVVLSLSLLIIPFVPATNLFFYVGFVIAERVLYIPSMGFCLLITVGARALYVKVQKRFLKSLIFYATATLIVFYGLKTAIRNGDWQNEEMLYRSGIKVNPAKAWGNLGNVLKSQSKISEAESAYRNALYYRSNMADMLYNLGLLLQENSRFAEALHYYKLAIGSRPTLASAYLNTGIILMNQGRTEEARRTFLKCSEIPDENLKDPHAHKSSVTSCLYNLGKLYHEQGHYEVWPMPLCPFPSPLF

SEQ ID NO: 90705 - protein, 35 aa, Homo sapiens
  Payload ID: 18137
  Gene Name: transmembrane and tetratricopeptide repeat containing 2
  ENSP ID: ENSP00000448630
MIAELVSSALGLALYLNTLSADFCYDDRGRTCRFS

SEQ ID NO: 90706 - protein, 914 aa, Homo sapiens
  Payload ID: 18138
  Gene Name: transmembrane and tetratricopeptide repeat containing 3
  Uniprot ID: Q6ZXV5
  ENSP ID: ENSP00000266712
MANINLKEITLIVGVVTACYWNSLFCGFVFDDVSAILDNKDLHPSTPLKTLFQNDFWGTPMSEERSHKSYRPLTVLTFRLNYLLSELKPMSYHLLNMIFHAVVSVIFLKVCKLFLDNKSSVIASLLFAVHPIHTEAVTGVVGRAELLSSIFFLAAFLSYTRSKGPDNSIIWTPIALTVFLVAVATLCKEQGITVVGICCVYEVFIAQGYTLPLLCTTAGQFLRGKGSIPFSMLQTLVKLIVLMFSTLLLVVIRVQVIQSQLPVFTRFDNPAAVSPTPTRQLTFNYLLPVNAWLLLNPSELCCDWTMGTIPLIESLLDIRNLATFTFFCFLGMLGVFSIRYSGDSSKTVLMALCLMALPFIPASNLFFPVGFVVAERVLYVPSMGFCILVAHGWQKISTKSVFKKLSWICLSMVILTHSLKTFHRNWDWESEYTLFMSALKVNKNNAKLWNNVGHALENEKNFERALKYFLQATHVQPDDIGAHMNVGRTYKNLNRTKEAEESYMMAKSLMPQIIPGKKYAARIAPNHLNVYINLANLIRANESRLEEADQLYRQAISMRPDFKQAYISRGELLLKMNKPLKAKEAYLKALELDRNNADLWYNLAIVHIELKEPNEALKNFNRALELNPKHKLALFNSAIVMQESGEVKLRPEARKRLLSYINEEPLDANGYFNLGMLAMDDKKDNEAEIWMKKAIKLQADFRSALFNLALLYSQTAKELKALPILEELLRYYPDHIKGLILKGDILMNQKKDILGAKKCFERILEMDPSNVQGKHNLCVVYFEEKDLLKAERCLLETLALAPHEEYIQRHLNIVRDKISSSSFIEPIFPTSKISSVEGKKIPTESVKEIRGESRQTQIVKTSDNKSQSKSNKQLGKNGDEETPHKTTKDIKEIEKKRVAALKRLEEIERILNGE

SEQ ID NO: 90707 - protein, 148 aa, Homo sapiens
  Payload ID: 18138
  Gene Name: transmembrane and tetratricopeptide repeat containing 3
  ENSP ID: ENSP00000447640
MANINLKEITLIVGVVTACYWNSLFCGFVFDDVSAILDNKDLHPSTPLKTLFQNDFWGTPMSEERSHKSYRPLTVLTFRLNYLLSELKPMSYHLLNMIFHAVVSVIFLKVCKLFLDNKSSVIASLLFAVHPIHTEAVTGVVGRAELLS

SEQ ID NO: 90708 - protein, 145 aa, Homo sapiens
  Payload ID: 18138
  Gene Name: transmembrane and tetratricopeptide repeat containing 3
  ENSP ID: ENSP00000448566
MANINLKEITLIVGVVTACYWNSLFCGFVFDDVSAILDNKDLHPSTPLKTLFQNDFWGTPMSEVTGVVGRAELLSSIFFLAAFLSYTRSKGPDNSIIWTPIALTVFLVAVATLCKEQGITVVGICCVYEVFIAQGYTLPLLCTTA

SEQ ID NO: 90709 - protein, 406 aa, Homo sapiens
  Payload ID: 18138
  Gene Name: transmembrane and tetratricopeptide repeat containing 3
  ENSP ID: ENSP00000448733
MANINLKEITLIVGVVTACYWNSLFCGFVFDDVSAILDNKDLHPSTPLKTLFQNDFWGTPMSEERSHKSYRPLTVLTFRLNYLLSELKPMSYHLLNMIFHAVVSVIFLKVCKLFLDNKSSVIASLLFAVHPIHTEAVTGVVGRAELLSSIFFLAAFLSYTRSKGPDNSIIWTPIALTVFLVAVATLCKEQGITVVGICCVYEVFIAQGYTLPLLCTTAGQFLRGKGSIPFSMLQTLVKLIVLMFSTLLLVVIRVQVIQSQLPVFTRFDNPAAVSPTPTRQLTFNYLLPVNAWLLLNPSELCCDWTMGTIPLIESLLDIRNLATFTFFCFLGMLGVFSIRYSGDSSKTVLMALCLMALPFIPASNLFFPVGFVVAERVLYVPSMGFCILVAHGWQKISTKSLRQNKL

SEQ ID NO: 90710 - protein, 760 aa, Homo sapiens
  Payload ID: 18139
  Gene Name: transmembrane and tetratricopeptide repeat containing 4
  Uniprot ID: Q5T4D3
  ENSP ID: ENSP00000343871
MIPNQHNAGAGSHQPAVFRMAVLDTDLDHILPSSVLPPFWAKLVVGSVAIVCFARSYDGDFVFDDSEAIVNNKDLQAETPLGDLWHHDFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 90711 - protein, 741 aa, Homo sapiens
  Payload ID: 18139
  Gene Name: transmembrane and tetratricopeptide repeat containing 4
  Uniprot ID: Q5T4D3
  ENSP ID: ENSP00000365408
MAVLDTDLDHILPSSVLPPFWAKLVVGSVAIVCFARSYDGDFVFDDSEAIVNNKDLQAETPLGDLWHHDFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 90712 - protein, 630 aa, Homo sapiens
  Payload ID: 18139
  Gene Name: transmembrane and tetratricopeptide repeat containing 4
  Uniprot ID: Q5T4D3
  ENSP ID: ENSP00000365409
MAVLDTDLDHILPSSVLPPFWAKLVVGSVAIVCFARSYDGDFVFDDSEAIVNNKVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 90713 - protein, 114 aa, Homo sapiens
  Payload ID: 18139
  Gene Name: transmembrane and tetratricopeptide repeat containing 4
  ENSP ID: ENSP00000393600
MAVLDTDLDHILPSSVLPPFWAKLVVGSVAIVCFARSYDGDFVFDDSEAIVNNKHTLLWRLHLIKYLEPRWCSFPVQREEKILCRSPSQLTGYFCKSVEEGPPSRNAPGGPVAS

SEQ ID NO: 90714 - protein, 54 aa, Homo sapiens
  Payload ID: 18139
  Gene Name: transmembrane and tetratricopeptide repeat containing 4
  ENSP ID: ENSP00000398400
MAVLDTDLDHILPSSVLPPFWAKLVVGSVAIVCFARSYDGDFVFDDSEAIVNNK

SEQ ID NO: 90715 - protein, 73 aa, Homo sapiens
  Payload ID: 18139
  Gene Name: transmembrane and tetratricopeptide repeat containing 4
  ENSP ID: ENSP00000419613
MIPNQHNAGAGSHQPAVFRMAVLDTDLDHILPSSVLPPFWAKLVVGSVAIVCFARSYDGDFVFDDSEAIVNNK

SEQ ID NO: 90716 - protein, 246 aa, Homo sapiens
  Payload ID: 18140
  Gene Name: transmembrane and ubiquitin-like domain containing 1
  Uniprot ID: Q9BVT8
  ENSP ID: ENSP00000297533
MTLIEGVGDEVTVLFSVLACLLVLALAWVSTHTAEGGDPLPQPSGTPTPSQPSAAMAATDSMRGEAPGAETPSLRHRGQAAQPEPSTGFTATPPAPDSPQEPLVLRLKFLNDSEQVARAWPHDTIGSLKRTQFPGREQQVRLIYQGQLLGDDTQTLGSLHLPPNCVLHCHVSTRVGPPNPPCPPGSEPGPSGLEIGSLLLPLLLLLLLLLWYCQIQYRPFFPLTATLGLAGFTLLLSLLAFAMYRP

SEQ ID NO: 90717 - protein, 246 aa, Homo sapiens; identical to SEQ ID NO: 90716
  Payload ID: 18140
  Gene Name: transmembrane and ubiquitin-like domain containing 1
  Uniprot ID: Q9BVT8
  ENSP ID: ENSP00000376565

SEQ ID NO: 90718 - protein, 246 aa, Homo sapiens; identical to SEQ ID NO: 90716
  Payload ID: 18140
  Gene Name: transmembrane and ubiquitin-like domain containing 1
  Uniprot ID: Q9BVT8
  ENSP ID: ENSP00000417519

SEQ ID NO: 90719 - protein, 246 aa, Homo sapiens; identical to SEQ ID NO: 90716
  Payload ID: 18140
  Gene Name: transmembrane and ubiquitin-like domain containing 1
  Uniprot ID: Q9BVT8
  ENSP ID: ENSP00000418709

SEQ ID NO: 90720 - protein, 246 aa, Homo sapiens; identical to SEQ ID NO: 90716
  Payload ID: 18140
  Gene Name: transmembrane and ubiquitin-like domain containing 1
  Uniprot ID: Q9BVT8
  ENSP ID: ENSP00000419214

SEQ ID NO: 90721 - protein, 152 aa, Homo sapiens
  Payload ID: 18140
  Gene Name: transmembrane and ubiquitin-like domain containing 1
  ENSP ID: ENSP00000420516
MTLIEGVGDEVTVLFSVLACLLVLALAWVSTHTAEGGDPLPQPSGTPTPSQPSAAMAATDSMRGEAPGAETPSLRHRGQAAQPEPSTGFTATPPAPDSPQEPLVLRLKFLNDSEQVARAWPHDTIGSLKRTQFPGREQQVRLIYQGQLLGDD

SEQ ID NO: 90722 - protein, 170 aa, Homo sapiens
  Payload ID: 18140
  Gene Name: transmembrane and ubiquitin-like domain containing 1
  ENSP ID: ENSP00000420692
MTLIEGVGDEVTVLFSVLACLLVLALAWVSTHTAEGGDPLPQPSGTPTPSQPSAAMAATDSMRGEAPGAETPSLRHRGQAAQPEPSTGFTATPPAPDSPQEPLVLRLKFLNDSEQVARAWPHDTIGSLKRTQFPGREQQVRLIYQGQLLGDDTQTLGSLHLPPNCVLHCH

SEQ ID NO: 90723 - protein, 301 aa, Homo sapiens
  Payload ID: 18141
  Gene Name: transmembrane and ubiquitin-like domain containing 2
  Uniprot ID: Q71RG4
  ENSP ID: ENSP00000313214
MELSDVTLIEGVGNEVMVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 90724 - protein, 301 aa, Homo sapiens; identical to SEQ ID NO: 90723
  Payload ID: 18141
  Gene Name: transmembrane and ubiquitin-like domain containing 2
  Uniprot ID: Q71RG4
  ENSP ID: ENSP00000350672

SEQ ID NO: 90725 - protein, 264 aa, Homo sapiens
  Payload ID: 18141
  Gene Name: transmembrane and ubiquitin-like domain containing 2
  ENSP ID: ENSP00000413127
MELSDVTLIEGVGNEVMVVAGVVVLILALVLAWLSTYVADSGSNQLLGAIVSAGDTSVLHLGHVDHLVAGQGNPEPTELPHPSEGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 90726 - protein, 321 aa, Homo sapiens
  Payload ID: 18141
  Gene Name: transmembrane and ubiquitin-like domain containing 2
  Uniprot ID: Q71RG4
  ENSP ID: ENSP00000444565
MISRHLQNNLMSVDPASSQAMELSDVTLIEGVGNEVMVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 90727 - protein, 94 aa, Homo sapiens
  Payload ID: 18141
  Gene Name: transmembrane and ubiquitin-like domain containing 2
  Uniprot ID: Q71RG4
  ENSP ID: ENSP00000465015
MELSDVTLIEGVGNEVMVVAGVVVLILALVLAWLSTYVADSGSNQLLGAIVSAGDTSVLHLGHVDHLVAGQGNPEPTELPHPSEANTSLDKKAR

SEQ ID NO: 90728 - protein, 61 aa, Homo sapiens
  Payload ID: 18141
  Gene Name: transmembrane and ubiquitin-like domain containing 2
  ENSP ID: ENSP00000465152
MELSDVTLIEGVGNEATHPSSTWGMWTTWWQAKATPSQLNSPIHQRTSRCRQQQSRGPPEI

SEQ ID NO: 90729 - protein, 94 aa, Homo sapiens; identical to SEQ ID NO: 90727
  Payload ID: 18141
  Gene Name: transmembrane and ubiquitin-like domain containing 2
  Uniprot ID: Q71RG4
  ENSP ID: ENSP00000465153

SEQ ID NO: 90730 - protein, 61 aa, Homo sapiens; identical to SEQ ID NO: 90728
  Payload ID: 18141
  Gene Name: transmembrane and ubiquitin-like domain containing 2
  ENSP ID: ENSP00000465217

SEQ ID NO: 90731 - protein, 194 aa, Homo sapiens
  Payload ID: 18141
  Gene Name: transmembrane and ubiquitin-like domain containing 2
  ENSP ID: ENSP00000465810
  MOD_RES (1)..(1): Any amino acid
XGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 90732 - protein, 94 aa, Homo sapiens; identical to SEQ ID NO: 90727
  Payload ID: 18141
  Gene Name: transmembrane and ubiquitin-like domain containing 2
  Uniprot ID: Q71RG4
  ENSP ID: ENSP00000466189

SEQ ID NO: 90733 - protein, 321 aa, Homo sapiens; identical to SEQ ID NO: 90726
  Payload ID: 18141
  Gene Name: transmembrane and ubiquitin-like domain containing 2
  Uniprot ID: Q71RG4
  ENSP ID: ENSP00000466971

SEQ ID NO: 90734 - protein, 301 aa, Homo sapiens; identical to SEQ ID NO: 90723
  Payload ID: 18141
  Gene Name: transmembrane and ubiquitin-like domain containing 2
  Uniprot ID: Q71RG4
  ENSP ID: ENSP00000467364

SEQ ID NO: 90735 - protein, 97 aa, Homo sapiens
  Payload ID: 18141
  Gene Name: transmembrane and ubiquitin-like domain containing 2
  ENSP ID: ENSP00000467506
MELSDVTLIEGVGNEVMVVAGVVVLILALVLAWLSTYVADSGSNQLLGAIVSAGDTSVLHLGHVDHLVAGQGNPEPTELPHPSEDKQVQAAAVQRPP

SEQ ID NO: 90736 - protein, 181 aa, Homo sapiens
  Payload ID: 18141
  Gene Name: transmembrane and ubiquitin-like domain containing 2
  Uniprot ID: Q71RG4
  ENSP ID: ENSP00000467960
MELSDVTLIEGVGNEVMVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKR

SEQ ID NO: 90737 - protein, 75 aa, Homo sapiens
  Payload ID: 18141
  Gene Name: transmembrane and ubiquitin-like domain containing 2
  ENSP ID: ENSP00000468765
MELSDVTLIEGVGNEQILPWTRKPDETDLPGPPATRPSPHTAFSEHYRQLCDSLPPLTPRVSCSRPLSLLGPLGH

SEQ ID NO: 90738 - protein, 567 aa, Homo sapiens
  Payload ID: 18142
  Gene Name: transmembrane anterior posterior transformation 1
  Uniprot ID: Q6NXT6
  ENSP ID: ENSP00000385347
MAGVGDAAAPGEGGGGGVDGPQRDGRGEAEQPGGSGGQGPPPAPQLTETLGFYESDRRRERRRGRTELSLLRFLSAELTRGYFLEHNEAKYTERRERVYTCLRIPRELEKLMVFGIFLCLDAFLYVFTLLPLRVFLALFRLLTLPCYGLRDRRLLQPAQVCDILKGVILVICYFMMHYVDYSMMYHLIRGQSVIKLYIIYNMLEVADRLFSSFGQDILDALYWTATEPKERKRAHIGVIPHFFMAVLYVFLHAILIMVQATTLNVAFNSHNKSLLTIMMSNNFVEIKGSVFKKFEKNNLFQMSNSDIKERFTNYVLLLIVCLRNMEQFSWNPDHLWVLFPDVCMVIASEIAVDIVKHAFITKFNDITADVYSEYRASLAFDLVSSRQKNAYTDYSDSVARRMGFIPLPLAVLLIRVVTSSIKVQGILSYACVILFYFGLISLKVLNSIVLLGKSCQYVKEAKMEEKLSNPPATCTPGKPSSKSQNKCKPSQGLSTEENLSASITKQPIHQKENIIPLLVTSNSDQFLTTPDGDEKDITQDNSELKHRSSKKDLLEIDRFTICGNRID

SEQ ID NO: 90739 - protein, 117 aa, Homo sapiens
  Payload ID: 18142
  Gene Name: transmembrane anterior posterior transformation 1
  ENSP ID: ENSP00000422652
MAGVGDAAAPGEGGGGGVDGPQRDGRGEAEQPGGSGGQGPPPAPQLTETLGFYESDRRRERRRGRTADGFWNLSVPGCVFVCVHPASFKSFPGTIQAPHFALLWLKGQTFASACPGV

SEQ ID NO: 90740 - protein, 51 aa, Homo sapiens
  Payload ID: 18142
  Gene Name: transmembrane anterior posterior transformation 1
  ENSP ID: ENSP00000422752
  MOD_RES (1)..(1): Any amino acid
XLMVFGIFLCLDAFLYVFTLLPLRVFLALFRLLTLPCYGLRPKGGALSLPL

SEQ ID NO: 90741 - protein, 212 aa, Homo sapiens
  Payload ID: 18142
  Gene Name: transmembrane anterior posterior transformation 1
  ENSP ID: ENSP00000423359
  MOD_RES (1)..(1): Any amino acid
XLKGVILVICYFMMHYVDYSMMYHLIRGQSVIKLYIIYNMLEVADRLFSSFGQDILDALYWTATEPKERKRAHIGFVEIKGSVFKKFEKNNLFQMSNSDIKERFTNYVLLLIVCLRNMEQFSWNPDHLWVLFPDVCMVIASEIAVDIVKHAFITKFNDITADVYSEYRASLAFDLVSSRQKNAYTDYSDSVARRMGFIPLPLAVLVDIPEST

SEQ ID NO: 90742 - protein, 311 aa, Homo sapiens
  Payload ID: 18143
  Gene Name: transmembrane BAX inhibitor motif containing 1
  Uniprot ID: Q969X1
  ENSP ID: ENSP00000258412
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKVYSIISVQLLITVAIIAIFTFVEPVSAFVRRNVAVYYVSYAVFVVTYLILACCQGPRRRFPWNIILLTLFTFAMGFMTGTISSMYQTKAVIIAMIITAVVSISVTIFCFQTKVDFTSCTGLFCVLGIVLLVTGIVTSIVLYFQYVYWLHMLYAALGAICFTLFLAYDTQLVLGNRKHTISPEDYITGALQIYTDIIYIFTFVLQLMGDRN

SEQ ID NO: 90743 - protein, 311 aa, Homo sapiens; identical to SEQ ID NO: 90742
  Payload ID: 18143
  Gene Name: transmembrane BAX inhibitor motif containing 1
  Uniprot ID: Q969X1
  ENSP ID: ENSP00000380025

SEQ ID NO: 90744 - protein, 73 aa, Homo sapiens
  Payload ID: 18143
  Gene Name: transmembrane BAX inhibitor motif containing 1
  ENSP ID: ENSP00000394946
MSNPSAPPPYEDRNPLYPGPPPPGGYGQPSVLPGGYPAYPGYPQPGYGHPAGYPQPMPPTHPMPMNYGPGHGY

SEQ ID NO: 90745 - protein, 84 aa, Homo sapiens
  Payload ID: 18143
  Gene Name: transmembrane BAX inhibitor motif containing 1
  ENSP ID: ENSP00000395614
MSNPSAPPPYEDRNPLYPGPPPPGGYGQPSVLPGGYPAYPGYPQPGYGHPAGYPQPMPPTHPMPMNYGPGHGYDGEERAVSDSF

SEQ ID NO: 90746 - protein, 167 aa, Homo sapiens
  Payload ID: 18143
  Gene Name: transmembrane BAX inhibitor motif containing 1
  ENSP ID: ENSP00000399345
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKVYSIISVQLLITVAIIAIFTFVEPVSAFVRRNVAVYYVSYAVFVVTYLILACCQGPRRRFPWNIIL

SEQ ID NO: 90747 - protein, 171 aa, Homo sapiens
  Payload ID: 18143
  Gene Name: transmembrane BAX inhibitor motif containing 1
  ENSP ID: ENSP00000399987
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKVYSIISVQLLITVAIIAIFTFVEPVSAFVRRNVAVYYVSYAVFVVTYLILACCQGPRRRFPWNIILLTLF

SEQ ID NO: 90748 - protein, 137 aa, Homo sapiens
  Payload ID: 18143
  Gene Name: transmembrane BAX inhibitor motif containing 1
  ENSP ID: ENSP00000401491
MGFMTGTISSMYQTKAVIIAMIITAVVSISVTIFCFQTKVDFTSCTGLFCVLGIVLLVTGIVTSIVLYFQYVYWLHMLYAALGAICFTLFLAYDTQLVLGNRKHTISPEDYITGALQIYTDIIYIFTFVLQLMGDRN

SEQ ID NO: 90749 - protein, 90 aa, Homo sapiens
  Payload ID: 18143
  Gene Name: transmembrane BAX inhibitor motif containing 1
  ENSP ID: ENSP00000403462
MSNPSAPPPYEDRNPLYPGPPPPGGYGQPSVLPGGYPAYPGYPQPGYGHPAGYPQPMPPTHPMPMNYGPGHGYDGEERAVSDSFGPGEWD

SEQ ID NO: 90750 - protein, 215 aa, Homo sapiens
  Payload ID: 18143
  Gene Name: transmembrane BAX inhibitor motif containing 1
  ENSP ID: ENSP00000404709
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKGTCQRLCEEKCGCLLRVLCCLRCHLPDPCLLPGTQTPFPMEHHSADPFYFCHGLHDGHHFQYVPNQSRHHCNDHHCGGIHFSHHLLLSDQGGLHLVHRPLLCPGNCAPGDWDCH

SEQ ID NO: 90751 - protein, 67 aa, Homo sapiens
  Payload ID: 18143
  Gene Name: transmembrane BAX inhibitor motif containing 1
  ENSP ID: ENSP00000405516
MSNPSAPPPYEDRNPLYPGPPPPGGYGQPSVLPGGYPAYPGYPQPGYGHPAGYPQPMPPTHPMPMNY

SEQ ID NO: 90752 - protein, 150 aa, Homo sapiens
  Payload ID: 18143
  Gene Name: transmembrane BAX inhibitor motif containing 1
  ENSP ID: ENSP00000406744
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKVYSIISVQLLITVAIIAIFTFVEPVSAFVRRNVAVYYVSYAVFVVTYLI

SEQ ID NO: 90753 - protein, 46 aa, Homo sapiens
  Payload ID: 18143
  Gene Name: transmembrane BAX inhibitor motif containing 1
  ENSP ID: ENSP00000408729
MSNPSAPPPYEDRNPLYPGPPPPGGYGQPSVLPGGYPAYPGYPQPG

SEQ ID NO: 90754 - protein, 311 aa, Homo sapiens; identical to SEQ ID NO: 90742
  Payload ID: 18143
  Gene Name: transmembrane BAX inhibitor motif containing 1
  Uniprot ID: Q969X1
  ENSP ID: ENSP00000409738

SEQ ID NO: 90755 - protein, 106 aa, Homo sapiens
  Payload ID: 18143
  Gene Name: transmembrane BAX inhibitor motif containing 1
  ENSP ID: ENSP00000410136
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKVYSII

SEQ ID NO: 90756 - protein, 91 aa, Homo sapiens
  Payload ID: 18143
  Gene Name: transmembrane BAX inhibitor motif containing 1
  ENSP ID: ENSP00000410771
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDD

SEQ ID NO: 90757 - protein, 107 aa, Homo sapiens
  Payload ID: 18143
  Gene Name: transmembrane BAX inhibitor motif containing 1
  ENSP ID: ENSP00000412518
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKVYSIIS

SEQ ID NO: 90758 - protein, 8 aa, Homo sapiens
  Payload ID: 18143
  Gene Name: transmembrane BAX inhibitor motif containing 1
  ENSP ID: ENSP00000413624
MSNPSAPP

SEQ ID NO: 90759 - protein, 140 aa, Homo sapiens
  Payload ID: 18143
  Gene Name: transmembrane BAX inhibitor motif containing 1
  ENSP ID: ENSP00000414572
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKVYSIISVQLLITVAIIAIFTFVEPVSAFVRRNVAVYYVS

SEQ ID NO: 90760 - protein, 285 aa, Homo sapiens
  Payload ID: 18144
  Gene Name: transmembrane BAX inhibitor motif containing 4
  ENSP ID: ENSP00000286424
MADPDPRYPRSSIEDDFNYGSSVASATVHIRMVLQRDCTFSKQYMRIPSAPSATLNIIRFFHLRQSGRSGMVNIFYKGPTFLRKVYSILSLQVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGLFALLWILCLSGFLKFFFYSEIMELVLAAAGALLFCGFIIYDTHSLMHKLSPEEYVLAAISLYLDIINLFLHLLRFLEAVNKK

SEQ ID NO: 90761 - protein, 238 aa, Homo sapiens
  Payload ID: 18144
  Gene Name: transmembrane BAX inhibitor motif containing 4
  Uniprot ID: Q9HC24
  ENSP ID: ENSP00000350965
MADPDPRYPRSSIEDDFNYGSSVASATVHIRMAFLRKVYSILSLQVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGLFALLWILCLSGFLKFFFYSEIMELVLAAAGALLFCGFIIYDTHSLMHKLSPEEYVLAAISLYLDIINLFLHLLRFLEAVNKK

SEQ ID NO: 90762 - protein, 161 aa, Homo sapiens
  Payload ID: 18144
  Gene Name: transmembrane BAX inhibitor motif containing 4
  ENSP ID: ENSP00000381114
MADPDPRYPRSSIEDDFNYGSSVASATVHIRMAFLRKVYSILSLQVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGFFFIVR

SEQ ID NO: 90763 - protein, 47 aa, Homo sapiens
  Payload ID: 18144
  Gene Name: transmembrane BAX inhibitor motif containing 4
  ENSP ID: ENSP00000438957
MADPDPRYPRSSIEDDFNYGSSVASATVHIRMDAVGSSDCGSCCYFL

SEQ ID NO: 90764 - protein, 43 aa, Homo sapiens
  Payload ID: 18144
  Gene Name: transmembrane BAX inhibitor motif containing 4
  ENSP ID: ENSP00000439310
MADPDPRYPRSSIEDDFNYGSSVASATVHIRMGPRMQQVFEDY

SEQ ID NO: 90765 - protein, 43 aa, Homo sapiens; identical to SEQ ID NO: 90764
  Payload ID: 18144
  Gene Name: transmembrane BAX inhibitor motif containing 4
  ENSP ID: ENSP00000440964

SEQ ID NO: 90766 - protein, 162 aa, Homo sapiens
  Payload ID: 18144
  Gene Name: transmembrane BAX inhibitor motif containing 4
  ENSP ID: ENSP00000441291
MADPDPRYPRSSIEDDFNYGSSVASATVHIRMAFLRKVYSILSLQVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGILEVFFL

SEQ ID NO: 90767 - protein, 61 aa, Homo sapiens
  Payload ID: 18144
  Gene Name: transmembrane BAX inhibitor motif containing 4
  ENSP ID: ENSP00000444639
MELVLAAAGALLFCGFIIYDTHSLMHKLSPEEYVLAAISLYLDIINLFLHLLRFLEAVNKK

SEQ ID NO: 90768 - protein, 162 aa, Homo sapiens
  Payload ID: 18144
  Gene Name: transmembrane BAX inhibitor motif containing 4
  ENSP ID: ENSP00000451688
MADPDPRYPRSSIEDDFNYGSSVASATVHIRMAFLRKVYSILSLQVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGIMDIFFL

SEQ ID NO: 90769 - protein, 210 aa, Homo sapiens
  Payload ID: 18144
  Gene Name: transmembrane BAX inhibitor motif containing 4
  ENSP ID: ENSP00000481025
MADPDPRYPRSSIEDDFNYGSSVASATVHIRMAFLRKVYSILSLQVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGLFALLWILPVRILEVFFYSEIMELVLAAAGALLFCGFIIYDTHSLMHKLSPKSTY

SEQ ID NO: 90770 - protein, 43 aa, Homo sapiens; identical to SEQ ID NO: 90764
  Payload ID: 18144
  Gene Name: transmembrane BAX inhibitor motif containing 4
  ENSP ID: ENSP00000488791

SEQ ID NO: 90771 - protein, 46 aa, Homo sapiens
  Payload ID: 18144
  Gene Name: transmembrane BAX inhibitor motif containing 4
  ENSP ID: ENSP00000488909
MADPDPRYPRSSIEDDFNYGSSVASATVHIRMGSLNYSDFNSFFIL

SEQ ID NO: 90772 - protein, 207 aa, Homo sapiens
  Payload ID: 18145
  Gene Name: transmembrane BAX inhibitor motif containing 4 [Source:EntrezGene
  Acc:51643]
  ENSP ID: ENSP00000488848
MAAAWPPPPCTSEWVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGLFALLWILCLSGFLKFFFYSEIMELVLAAAGALLFCGFIIYDTHSLMHKLSPEEYVLAAISLYLDIINLFLHLLRFLEAVNKK

SEQ ID NO: 90773 - protein, 237 aa, Homo sapiens
  Payload ID: 18146
  Gene Name: transmembrane BAX inhibitor motif containing 6
  Uniprot ID: P55061
  ENSP ID: ENSP00000267115
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWLFQANLYVGLVVMCGFVLFDTQLIIEKAEHGDQDYIWHCIDLFLDFITVFRKLMMILAMNEKDKKKEKK

SEQ ID NO: 90774 - protein, 237 aa, Homo sapiens; identical to SEQ ID NO: 90773
  Payload ID: 18146
  Gene Name: transmembrane BAX inhibitor motif containing 6
  Uniprot ID: P55061
  ENSP ID: ENSP00000378454

SEQ ID NO: 90775 - protein, 295 aa, Homo sapiens
  Payload ID: 18146
  Gene Name: transmembrane BAX inhibitor motif containing 6
  Uniprot ID: P55061
  ENSP ID: ENSP00000389277
MSHSSVTREAPQLLSQRQRREVRGVWGWGCLPGPRGGPALFGLVTFGQSGDCCTDSGTMNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWLFQANLYVGLVVMCGFVLFDTQLIIEKAEHGDQDYIWHCIDLFLDFITVFRKLMMILAMNEKDKKKEKK

SEQ ID NO: 90776 - protein, 108 aa, Homo sapiens
  Payload ID: 18146
  Gene Name: transmembrane BAX inhibitor motif containing 6
  ENSP ID: ENSP00000446668
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIA

SEQ ID NO: 90777 - protein, 295 aa, Homo sapiens; identical to SEQ ID NO: 90775
  Payload ID: 18146
  Gene Name: transmembrane BAX inhibitor motif containing 6
  Uniprot ID: P55061
  ENSP ID: ENSP00000446734

SEQ ID NO: 90778 - protein, 200 aa, Homo sapiens
  Payload ID: 18146
  Gene Name: transmembrane BAX inhibitor motif containing 6
  ENSP ID: ENSP00000447030
MFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWLFQANLYVGLVVMCGFVLFDTQLIIEKAEHGDQDYIWHCIDLFLDFITVFRKLMMILAMNEKDKKKEKK

SEQ ID NO: 90779 - protein, 16 aa, Homo sapiens
  Payload ID: 18146
  Gene Name: transmembrane BAX inhibitor motif containing 6
  ENSP ID: ENSP00000447074
MNIFDRKINFDALLKF

SEQ ID NO: 90780 - protein, 95 aa, Homo sapiens
  Payload ID: 18146
  Gene Name: transmembrane BAX inhibitor motif containing 6
  ENSP ID: ENSP00000447400
MNIFDRKINFDALLKFSHITPSTQQHLKKVYASFALCMFVAAAGAYVHMVTHFIQAGLLSALGSLILMIWLMATPHSHETEQKRLGLLAGFAFLT

SEQ ID NO: 90781 - protein, 10 aa, Homo sapiens
  Payload ID: 18146
  Gene Name: transmembrane BAX inhibitor motif containing 6
  ENSP ID: ENSP00000447888
MNIFDRKINF

SEQ ID NO: 90782 - protein, 237 aa, Homo sapiens; identical to SEQ ID NO: 90773
  Payload ID: 18146
  Gene Name: transmembrane BAX inhibitor motif containing 6
  Uniprot ID: P55061
  ENSP ID: ENSP00000448036

SEQ ID NO: 90783 - protein, 138 aa, Homo sapiens
  Payload ID: 18146
  Gene Name: transmembrane BAX inhibitor motif containing 6
  ENSP ID: ENSP00000448269
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRR

SEQ ID NO: 90784 - protein, 95 aa, Homo sapiens; identical to SEQ ID NO: 90780
  Payload ID: 18146
  Gene Name: transmembrane BAX inhibitor motif containing 6
  ENSP ID: ENSP00000448612

SEQ ID NO: 90785 - protein, 11 aa, Homo sapiens
  Payload ID: 18146
  Gene Name: transmembrane BAX inhibitor motif containing 6
  ENSP ID: ENSP00000449000
MNIFDRKINFD

SEQ ID NO: 90786 - protein, 44 aa, Homo sapiens
  Payload ID: 18146
  Gene Name: transmembrane BAX inhibitor motif containing 6
  ENSP ID: ENSP00000449421
MNIFDRKINFDALLKFSHITPSTQQHLKKVYASFALCMFVAAAG

SEQ ID NO: 90787 - protein, 95 aa, Homo sapiens; identical to SEQ ID NO: 90780
  Payload ID: 18146
  Gene Name: transmembrane BAX inhibitor motif containing 6
  ENSP ID: ENSP00000449904

SEQ ID NO: 90788 - protein, 145 aa, Homo sapiens
  Payload ID: 18146
  Gene Name: transmembrane BAX inhibitor motif containing 6
  ENSP ID: ENSP00000449907
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGG

SEQ ID NO: 90789 - protein, 113 aa, Homo sapiens
  Payload ID: 18146
  Gene Name: transmembrane BAX inhibitor motif containing 6
  ENSP ID: ENSP00000450050
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSP

SEQ ID NO: 90790 - protein, 237 aa, Homo sapiens; identical to SEQ ID NO: 90773
  Payload ID: 18146
  Gene Name: transmembrane BAX inhibitor motif containing 6
  Uniprot ID: P55061
  ENSP ID: ENSP00000450158

SEQ ID NO: 90791 - protein, 145 aa, Homo sapiens; identical to SEQ ID NO: 90788
  Payload ID: 18146
  Gene Name: transmembrane BAX inhibitor motif containing 6
  ENSP ID: ENSP00000450159

SEQ ID NO: 90792 - protein, 130 aa, Homo sapiens
  Payload ID: 18146
  Gene Name: transmembrane BAX inhibitor motif containing 6
  ENSP ID: ENSP00000450265
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTL

SEQ ID NO: 90793 - protein, 89 aa, Homo sapiens
  Payload ID: 18146
  Gene Name: transmembrane BAX inhibitor motif containing 6
  ENSP ID: ENSP00000450305
MNIFDRKINFDALLKFSHITPSTQQHLKKVYASFALCMFVAAAGAYVHMVTHFIQAGLLSALGSLILMIWLMATPHSHETEQKRLGLLA

SEQ ID NO: 90794 - protein, 41 aa, Homo sapiens
  Payload ID: 18146
  Gene Name: transmembrane BAX inhibitor motif containing 6
  ENSP ID: ENSP00000450417
MNIFDRKINFDALLKFSHITPSTQQHLKKVYASFALCMFVA

SEQ ID NO: 90795 - protein, 760 aa, Homo sapiens
  Payload ID: 18147
  Gene Name: transmembrane channel-like 1
  Uniprot ID: Q8TDI8
  ENSP ID: ENSP00000297784
MSPKKVQIKVEEKEDETEESSSEEEEEVEDKLPRRESLRPKRKRTRDVINEDDPEPEPEDEETRKAREKERRRRLKRGAEEEEIDEEELERLKAELDEKRQIIATVKCKPWKMEKKIEVLKEAKKFVSENEGALGKGKGKRWFAFKMMMAKKWAKFLRDFENFKAACVPWENKIKAIESQFGSSVASYFLFLRWMYGVNMVLFILTFSLIMLPEYLWGLPYGSLPRKTVPRAEEASAANFGVLYDFNGLAQYSVLFYGYYDNKRTIGWMNFRLPLSYFLVGIMCIGYSFLVVLKAMTKNIGDDGGGDDNTFNFSWKVFTSWDYLIGNPETADNKFNSITMNFKEAITEEKAAQVEENVHLIRFLRFLANFFVFLTLGGSGYLIFWAVKRSQEFAQQDPDTLGWWEKNEMNMVMSLLGMFCPTLFDLFAELEDYHPLIALKWLLGRIFALLLGNLYVFILALMDEINNKIEEEKLVKANITLWEANMIKAYNASFSENSTGPPFFVHPADVPRGPCWETMVGQEFVRLTVSDVLTTYVTILIGDFLRACFVRFCNYCWCWDLEYGYPSYTEFDISGNVLALIFNQGMIWMGSFFAPSLPGINILRLHTSMYFQCWAVMCCNVPEARVFKASRSNNFYLGMLLLILFLSTMPVLYMIVSLPPSFDCGPFSGKNRMFEVIGETLEHDFPSWMAKILRQLSNPGLVIAVILVMVLAIYYLNATAKGQKAANLDLKKKMKMQALENKMRNKKMAAARAAAAAGRQ

SEQ ID NO: 90796 - protein, 760 aa, Homo sapiens; identical to SEQ ID NO: 90795
  Payload ID: 18147
  Gene Name: transmembrane channel-like 1
  Uniprot ID: Q8TDI8
  ENSP ID: ENSP00000341433

SEQ ID NO: 90797 - protein, 906 aa, Homo sapiens
  Payload ID: 18148
  Gene Name: transmembrane channel-like 2
  Uniprot ID: Q8TDI7
  ENSP ID: ENSP00000351732
MSHQVKGLKEEARGGVKGRVKSGSPHTGDRLGRRSSSKRALKAEGTPGRRGAQRSQKERAGGSPSPGSPRRKQTGRRRHREELGEQERGEAERTCEGRRKRDERASFQERTAAPKREKEIPRREEKSKRQKKPRSSSLASSASGGESLSEEELAQILEQVEEKKKLIATMRSKPWPMAKKLTELREAQEFVEKYEGALGKGKGKQLYAYKMLMAKKWVKFKRDFDNFKTQCIPWEMKIKDIESHFGSSVASYFIFLRWMYGVNLVLFGLIFGLVIIPEVLMGMPYGSIPRKTVPRAEEEKAMDFSVLWDFEGYIKYSALFYGYYNNQRTIGWLRYRLPMAYFMVGVSVFGYSLIIVIRSMASNTQGSTGEGESDNFTFSFKMFTSWDYLIGNSETADNKYASITTSFKESIVDEQESNKEENIHLTRFLRVLANFLIICCLCGSGYLIYFVVKRSQQFSKMQNVSWYERNEVEIVMSLLGMFCPPLFETIAALENYHPRTGLKWQLGRIFALFLGNLYTFLLALMDDVHLKLANEETIKNITHWTLFNYYNSSGWNESVPRPPLHPADVPRGSCWETAVGIEFMRLTVSDMLVTYITILLGDFLRACFVRFMNYCWCWDLEAGFPSYAEFDISGNVLGLIFNQGMIWMGSFYAPGLVGINVLRLLTSMYFQCWAVMSSNVPHERVFKASRSNNFYMGLLLLVLFLSLLPVAYTIMSLPPSFDCGPFSGKNRMYDVLQETIENDFPTFLGKIFAFLANPGLIIPAILLMFLAIYYLNSVSKSLSRANAQLRKKIQVLREVEKSHKSVKGKATARDSEDTPKSSSKNATQLQLTKEETTPPSASQSQAMDKKAQGPGTSNSASRTTLPASGHLPISRPPGIGPDSGHAPSQTHPWRSASGKSAQRPPH

SEQ ID NO: 90798 - protein, 1100 aa, Homo sapiens
  Payload ID: 18149
  Gene Name: transmembrane channel-like 3
  Uniprot ID: Q7Z5M5
  ENSP ID: ENSP00000352413
MKTSKASQRYRGIRRNASQCYLYQESLLLSNLDDSFSADETGDSNDPEQIFQNIQFQKDLMANIRCRPWTMGQKLRALRQAKNIVLKFEGRLTRTRGYQAAGAELWRKFARLACNFVVIFIPWEMRIKKIESHFGSGVASYFIFLRWLFGINIVLTIMTGAFIVIPELIAGQPFGSTARKTIPKEQVSSAQDLDTVWSLGGYLQYSVLFYGYYGRERKIGRAGYRLPLAYFLVGMAVFAYSFIILLKKMAKNSRTSLASASNENYTFCWRVFCAWDYLIGNPEAAESKTAAIVNSIREAILEEQEKKKSKNLAVTICLRIIANILVLLSLAGSIYLIYFVVDRSQKLEQSKKELTLWEKNEVSVVVSLVTMIAPSAFDLIAALEMYHPRTTLRFQLARVLVLYLGNLYSLIIALLDKVNSMSIEEMATKNNTSHWIDSTTFFATRTAPEEEKWSTSRPGMGLRRNNTWALEETSISAYTMPLIKANKTSLHTQSPQDQCWETYVGQEMLKLSIIDMLFTVASILLIDFFRGLFVRYLSDYWCWDLESKFPEYGEFKIAENVLHLVYNQGMIWMGAFFSPCLPAFNVLKLIGLMYLRSWAVLTCNVPHQQVFRASRSNNFYLAMLLFMLFLCMLPTIFAIVRYKPSLNCGPFSGQEKIYDIVSETIEKDFPVWFGSVVGHISSPVVILPAVLLLFMLIYYLQSIARSLKLSNHQLKMQIQNARSEDKKKVAQMVEARIQTQEESTKKLPNDSDLTSQLSSAHSGTPQNNGNVAHFDSGSSKSGRIETVAQSMPQSPRPGDRAPSSPLPGVPKSRLEHETNRYLHGLCASTSDLHRNRSRTPMTFTTHIEDVHSEPLFRKDFQQINPPHRGPQASTLLAQGPRPHAPRYYVINECDSYKKKHLNVWPERHFKIDASGDIVELYPRNVRQYASRVPRQPPSPQLSEEEEETPSRDWIKRSLPPRSLIDLRRAPHFYIGERSESQTRDPEHQGRVHYKSWNEDFEGHLERPAYVPRKPRSRNFQYPQPPLKPRGKPRFEPSLTESDSVSAASSSDQQNSSADQYLQVTHSQGRFPRSVGQPSRRKAKSGQELTVDLDDLICSDV

SEQ ID NO: 90799 - protein, 1101 aa, Homo sapiens
  Payload ID: 18149
  Gene Name: transmembrane channel-like 3
  ENSP ID: ENSP00000452681
MKTSKASQRYRGIRRNASQCYLYQESLLLSNLDDSFSADETGDSNDPEQIFQNIQFQKDLMANIRCRPWTMGQKLRALRQAKNIVLKFEGRLTRTRGYQAAGAELWRKFARLACNFVVIFIPWEMRIKKIESHFGSGVASYFIFLRWLFGINIVLTIMTGAFIVIPELIAGQPFGSTARKTIPKEQVSSAQDLDTVWSLGGYLQYSVLFYGYYGRERKIGRAGYRLPLAYFLVGMAVFAYSFIILLKKMAKNSRTSLASASNENYTFCWRVFCAWDYLIGNPEAAESKTAAIVNSIREAILEEQEKKKSKNLAVTICLRIIANILVLLSLAGSIYLIYFVVDRSQKLEQSKKELTLWEKNEQVSVVVSLVTMIAPSAFDLIAALEMYHPRTTLRFQLARVLVLYLGNLYSLIIALLDKVNSMSIEEMATKNNTSHWIDSTTFFATRTAPEEEKWSTSRPGMGLRRNNTWALEETSISAYTMPLIKANKTSLHTQSPQDQCWETYVGQEMLKLSIIDMLFTVASILLIDFFRGLFVRYLSDYWCWDLESKFPEYGEFKIAENVLHLVYNQGMIWMGAFFSPCLPAFNVLKLIGLMYLRSWAVLTCNVPHQQVFRASRSNNFYLAMLLFMLFLCMLPTIFAIVRYKPSLNCGPFSGQEKIYDIVSETIEKDFPVWFGSVVGHISSPVVILPAVLLLFMLIYYLQSIARSLKLSNHQLKMQIQNARSEDKKKVAQMVEARIQTQEESTKKLPNDSDLTSQLSSAHSGTPQNNGNVAHFDSGSSKSGRIETVAQSMPQSPRPGDRAPSSPLPGVPKSRLEHETNRYLHGLCASTSDLHRNRSRTPMTFTTHIEDVHSEPLFRKDFQQINPPHRGPQASTLLAQGPRPHAPRYYVINECDSYKKKHLNVWPERHFKIDASGDIVELYPRNVRQYASRVPRQPPSPQLSEEEEETPSRDWIKRSLPPRSLIDLRRAPHFYIGERSESQTRDPEHQGRVHYKSWNEDFEGHLERPAYVPRKPRSRNFQYPQPPLKPRGKPRFEPSLTESDSVSAASSSDQQNSSADQYLQVTHSQGRFPRSVGQPSRRKAKSGQELTVDLDDLICSDV

SEQ ID NO: 90800 - protein, 175 aa, Homo sapiens
  Payload ID: 18150
  Gene Name: transmembrane channel-like 4
  ENSP ID: ENSP00000416444
MQARRAHRQRNASRDQVVYGSGTKTDRWARLLRRSKEKTKEGLRSLQPWAWTLKRIGGQFGAGTESYFSLLRFLLLLNVLASVLMACMTLLPTWLGGAPPGPPGPDISSPCGSYNPHSQGLVTFATQLFNLLSGEGYLEWSPLFYGFYPPRPRLAVTYLCWAFAVGLICLLLILH

SEQ ID NO: 90801 - protein, 712 aa, Homo sapiens
  Payload ID: 18150
  Gene Name: transmembrane channel-like 4
  ENSP ID: ENSP00000477627
MEENPTLESEAWGSSREWLAPREARGAPCSSPGPSLSSVLNELPSAATLRYRDPGVLPWGALEEEEEDGGRSRKAFTEVTQTELQDPHPSRELPWPMQARRAHRQRNASRDQVVYGSGTKTDRWARLLRRSKEKTKEGLRSLQPWAWTLKRIGGQFGAGTESYFSLLRFLLLLNVLASVLMACMTLLPTWLGGAPPGPPGPDISSPCGSYNPHSQGLVTFATQLFNLLSGEGYLEWSPLFYGFYPPRPRLAVTYLCWAFAVGLICLLLILHRSVSGLKQTLLAESEALTSYSHRVFSAWDFGLCGDVHVRLRQRIILYELKVELEETVVRRQAAVRTLGQQARVWLVRVLLNLLVVALLGAAFYGVYWATGCTVELQEMPLVQELPLLKLGVNYLPSIFIAGVNFVLPPVFKLIAPLEGYTRSRQIVFILLRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRETEAQNKVFLARRAVALTSTKPAL

SEQ ID NO: 90802 - protein, 712 aa, Homo sapiens
  Payload ID: 18150
  Gene Name: transmembrane channel-like 4
  ENSP ID: ENSP00000477927
MEENPTLESEAWGSSRGWLAPREARGAPCSSPGPSLSSVLNELPSAATLRYRDPGVLPWGALEEEEEDGGRSRKAFTEVTQTELQDPHPSRELPWPMQARRAHRQRNASRDQVVYGSGTKTDRWARLLRRSKEKTKEGLRSLQPWAWTLKRIGGQFGAGTESYFSLLRFLLLLNVLASVLMACMTLLPTWLGGAPPGPPGPDISSPCGSYNPHSQGLVTFATQLFNLLSGEGYLEWSPLFYGFYPPRPRLAVTYLCWAFAVGLICLLLILHRSVSGLKQTLLAESEALTSYSHRVFSAWDFGLCGDVHVRLRQRIILYELKVELEETVVRRQAAVRTLGQQARVWLVRVLLNLLVVALLGAAFYGVYWATGCTVELQEMPLVQELPLLKLGVNYLPSIFIAGVNFVLPPVFKLIAPLEGYTRSRQIVFILLRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRQTEAQNKVFLARRAVALTSTKPAL

SEQ ID NO: 90803 - protein, 712 aa, Homo sapiens; identical to SEQ ID NO: 90802
  Payload ID: 18150
  Gene Name: transmembrane channel-like 4
  ENSP ID: ENSP00000477941

SEQ ID NO: 90804 - protein, 712 aa, Homo sapiens; identical to SEQ ID NO: 90802
  Payload ID: 18150
  Gene Name: transmembrane channel-like 4
  Uniprot ID: Q7Z404
  ENSP ID: ENSP00000478046

SEQ ID NO: 90805 - protein, 706 aa, Homo sapiens
  Payload ID: 18150
  Gene Name: transmembrane channel-like 4
  ENSP ID: ENSP00000479458
MEENPTLESEAWGSSREWLAPREARGGPSLSSVLNELPSAATLRYRDPGVLPWGALEEEEEDGGRSRKAFTEVTQTELQDPHPSRELPWPMQARRAHRQRNASRDQVVYGSGTKTDRWARLLRRSKEKTKEGLRSLQPWAWTLKRIGGQFGAGTESYFSLLRFLLLLNVLASVLMACMTLLPTWLGGAPPGPPGPDISSPCGSYNPHSQGLVTFATQLFNLLSGEGYLEWSPLFYGFYPPRPRLAVTYLCWAFAVGLICLLLILHRSVSGLKQTLLAESEALTSYSHRVFSAWDFGLCGDVHVRLRQRIILYELKVELEETVVRRQAAVRTLGQQARVWLVRVLLNLLVVALLGAAFYGVYWATGCTVELQEMPLVQELPLLKLGVNYLPSIFIAGVNFVLPPVFKLIAPLEGYTRSRQIVFILLRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRETEAQNKVFLARRAVALTSTKPAL

SEQ ID NO: 90806 - protein, 706 aa, Homo sapiens
  Payload ID: 18150
  Gene Name: transmembrane channel-like 4
  ENSP ID: ENSP00000479590
MEENPTLESEAWGSSREWLAPREARGGPSLSSVLNELPSAATLRYRDPGVLPWGALEEEEEDGGRSRKAFTEVTQTELQDPHPSRELPWPMQARRAYRQRNASRDQVVYGSGTKTDRWARLLRRSKEKTKEGLRSLQPWAWTLKRIGGQFGAGTESYFSLLRFLLLLNVLASVLMACMTLLPTWLGGAPPGPPGPDISSPCGSYNPHSQGLVTFATQLFNLLSGEGYLEWSPLFYGFYPPRPRLAVTYLCWAFAVGLICLLLILHRSVSGLKQTLLAESEALTSYSHRVFSAWDFGLCGDVHVRLRQRIILYELKVELEETVVRRQAAVRTLGQQARVWLVRVLLNLLVVALLGAAFYGVYWATGCTVELQEMPLVQELPLLKLGVNYLPSIFIAGVNFVLPPVFKLIAPLEGYTRSRQIVFILLRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRETEAQNKVFLARRAVALTSTKPAL

SEQ ID NO: 90807 - protein, 706 aa, Homo sapiens
  Payload ID: 18150
  Gene Name: transmembrane channel-like 4
  ENSP ID: ENSP00000479689
MEENPTLESEAWGSSREWLAPREARGGPSLSSVLNELPSAATLRYRDPGVLPWGALEEEEEDGGRSRKAFTEVTQTELQDPHPSRELPWPMQARRAYRQRNASRDQVVYGSGTKTDRWARLLRRSKEKTKEGLRSLQPWAWTLKRIGGQFGAGTESYFSLLRFLLLLNVLASVLMACMTLLPTWLGGAPPGPPGPDISSPCGSYNPHSQGLVTFATQLFNLLSGEGYLEWSPLFYGFYPPRPRLAVTYLCWAFAVGLICLLLILHRSVSGLKQTLLAESEALTSYSHRVFSAWDFGLCGDVHVRLRQRIILYELKVELEETVVRRQAAVRTLGQQARVWLVRVLLNLLVVALLGAAFYGVYWATGCTVELQEMPLVQELPLLKLGVNYLPSIFIAGVNFVLPPVFKLIAPLEGYTRSRQIVFILLRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRQTEAQNKVFLARRAVALTSTKPAL

SEQ ID NO: 90808 - protein, 239 aa, Homo sapiens
  Payload ID: 18150
  Gene Name: transmembrane channel-like 4
  ENSP ID: ENSP00000481093
  MOD_RES (1)..(1): Any amino acid
XPSLSSVLNELPSAATLRYRDPGVLPWGALEEEEEDGGRSRKAFTEVTQTELQDPHPSRELPWPMQARRAHRQRNASRDQVVYGSGTKTDRWARLLRRSKEKTKEGLRSLQPWAWTLKRIGGQFGAGTESYFSLLRFLLLLNVLASVLMACMTLLPTWLGGAPPGPPGPDISSPCGSYNPHSQGLVTFATQLFNLLSGEGYLEWSPLFYGFYPPRPRLAVTYLCWAFAVGLICLLLILH

SEQ ID NO: 90809 - protein, 712 aa, Homo sapiens; identical to SEQ ID NO: 90802
  Payload ID: 18150
  Gene Name: transmembrane channel-like 4
  ENSP ID: ENSP00000481281

SEQ ID NO: 90810 - protein, 55 aa, Homo sapiens
  Payload ID: 18150
  Gene Name: transmembrane channel-like 4
  ENSP ID: ENSP00000481392
PESISSLPETTQNFLFFLGTQAFAVPLLLISRSQTFGYNGRACQEWLPFLSPSAS

SEQ ID NO: 90811 - protein, 706 aa, Homo sapiens
  Payload ID: 18150
  Gene Name: transmembrane channel-like 4
  Uniprot ID: Q7Z404
  ENSP ID: ENSP00000481629
MEENPTLESEAWGSSRGWLAPREARGGPSLSSVLNELPSAATLRYRDPGVLPWGALEEEEEDGGRSRKAFTEVTQTELQDPHPSRELPWPMQARRAHRQRNASRDQVVYGSGTKTDRWARLLRRSKEKTKEGLRSLQPWAWTLKRIGGQFGAGTESYFSLLRFLLLLNVLASVLMACMTLLPTWLGGAPPGPPGPDISSPCGSYNPHSQGLVTFATQLFNLLSGEGYLEWSPLFYGFYPPRPRLAVTYLCWAFAVGLICLLLILHRSVSGLKQTLLAESEALTSYSHRVFSAWDFGLCGDVHVRLRQRIILYELKVELEETVVRRQAAVRTLGQQARVWLVRVLLNLLVVALLGAAFYGVYWATGCTVELQEMPLVQELPLLKLGVNYLPSIFIAGVNFVLPPVFKLIAPLEGYTRSRQIVFILLRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRQTEAQNKVFLARRAVALTSTKPAL

SEQ ID NO: 90812 - protein, 712 aa, Homo sapiens; identical to SEQ ID NO: 90802
  Payload ID: 18150
  Gene Name: transmembrane channel-like 4
  Uniprot ID: Q7Z404
  ENSP ID: ENSP00000482261

SEQ ID NO: 90813 - protein, 712 aa, Homo sapiens; identical to SEQ ID NO: 90802
  Payload ID: 18150
  Gene Name: transmembrane channel-like 4
  Uniprot ID: Q7Z404
  ENSP ID: ENSP00000482528

SEQ ID NO: 90814 - protein, 712 aa, Homo sapiens
  Payload ID: 18150
  Gene Name: transmembrane channel-like 4
  ENSP ID: ENSP00000483221
MEENPTLESEAWGSSREWLAPREARGAPCSSPGPSLSSVLNELPSAATLRYRDPGVLPWGALEEEEEDGGRSRKAFTEVTQTELQDPHPSRELPWPMQARRAYRQRNASRDQVVYGSGTKTDRWARLLRRSKEKTKEGLRSLQPWAWTLKRIGGQFGAGTESYFSLLRFLLLLNVLASVLMACMTLLPTWLGGAPPGPPGPDISSPCGSYNPHSQGLVTFATQLFNLLSGEGYLEWSPLFYGFYPPRPRLAVTYLCWAFAVGLICLLLILHRSVSGLKQTLLAESEALTSYSHRVFSAWDFGLCGDVHVRLRQRIILYELKVELEETVVRRQAAVRTLGQQARVWLVRVLLNLLVVALLGAAFYGVYWATGCTVELQEMPLVQELPLLKLGVNYLPSIFIAGVNFVLPPVFKLIAPLEGYTRSRQIVFILLRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRQTEAQNKVFLARRAVALTSTKPAL

SEQ ID NO: 90815 - protein, 55 aa, Homo sapiens; identical to SEQ ID NO: 90810
  Payload ID: 18150
  Gene Name: transmembrane channel-like 4
  ENSP ID: ENSP00000483594

SEQ ID NO: 90816 - protein, 712 aa, Homo sapiens
  Payload ID: 18150
  Gene Name: transmembrane channel-like 4
  ENSP ID: ENSP00000483893
MEENPTLESEAWGSSREWLAPREARGAPCSSPGPSLSSVLNELPSAATLRYRDPGVLPWGALEEEEEDGGRSRKAFTEVTQTELQDPHPSRELPWPMQARRAYRQRNASRDQVVYGSGTKTDRWARLLRRSKEKTKEGLRSLQPWAWTLKRIGGQFGAGTESYFSLLRFLLLLNVLASVLMACMTLLPTWLGGAPPGPPGPDISSPCGSYNPHSQGLVTFATQLFNLLSGEGYLEWSPLFYGFYPPRPRLAVTYLCWAFAVGLICLLLILHRSVSGLKQTLLAESEALTSYSHRVFSAWDFGLCGDVHVRLRQRIILYELKVELEETVVRRQAAVRTLGQQARVWLVRVLLNLLVVALLGAAFYGVYWATGCTVELQEMPLVQELPLLKLGVNYLPSIFIAGVNFVLPPVFKLIAPLEGYTRSRQIVFILLRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRETEAQNKVFLARRAVALTSTKPAL

SEQ ID NO: 90817 - protein, 712 aa, Homo sapiens; identical to SEQ ID NO: 90802
  Payload ID: 18150
  Gene Name: transmembrane channel-like 4
  Uniprot ID: Q7Z404
  ENSP ID: ENSP00000484205

SEQ ID NO: 90818 - protein, 760 aa, Homo sapiens
  Payload ID: 18151
  Gene Name: transmembrane channel-like 5
  Uniprot ID: Q6UXY8
  ENSP ID: ENSP00000219821
MLSDDHVNEIIIQVENVSSGVQSHPSSNQIFQEKVLLDSSINMVLSISDIDVIDSQTVSKRNDQKGNQVLRFSTSLNESMSQTLHSLECMGIDTPGSSHETVQGQKLIASLIPMTSRDRIKAIRNQPRTMEEKRNLRKIVDKEKSKQTHRILQLNCCIQCLNSISRAYRRSKNSLSEILNSISLWQKTLKIIGGKFGTSVLSYFNFLRWLLKFNIFSFILNFSFIIIPQFTVAKKNTLQFTGLEFFTGVGYFRDTVMYYGFYTNSTIQHGNSGASYNMQLAYIFTIGACLTTCFFSLLFSMAKYFRNNFINPHIYSGGITKLIFCWDFTVTHEKAVKLKQKNLSTEIRENLSELRQENSKLTFNQLLTRFSAYMVAWVVSTGVAIACCAAVYYLAEYNLEFLKTHSNPGAVLLLPFVVSCINLAVPCIYSMFRLVERYEMPRHEVYVLLIRNIFLKISIIGILCYYWLNTVALSGEECWETLIGQDIYRLLLMDFVFSLVNSFLGEFLRRIIGMQLITSLGLQEFDIARNVLELIYAQTLVWIGIFFCPLLPFIQMIMLFIMFYSKNISLMMNFQPPSKAWRASQMMTFFIFLLFFPSFTGVLCTLAITIWRLKPSADCGPFRGLPLFIHSIYSWIDTLSTRPGYLWVVWIYRNLIGSVHFFFILTLIVLIITYLYWQITEGRKIMIRLLHEQIINEGKDKMFLIEKLIKLQDMEKKANPSSLVLERREVEQQGFLHLGEHDGSLDLRSRRSVQEGNPRA

SEQ ID NO: 90819 - protein, 948 aa, Homo sapiens
  Payload ID: 18151
  Gene Name: transmembrane channel-like 5
  Uniprot ID: Q6UXY8
  ENSP ID: ENSP00000370822
MSAYYRNNWSEEDPDYPDYSGSQNRTQGYLKTQGYPDVPGPLNNPDYPGTRSNPYSVASRTRPDYPGSLAEPNYPRSLSNPDYSGTRSNAYSAASRTSPDHPTSLPEPDYSEFQSHPYHRASSRQPDYPGSQRNPDFAGSSSSGNYAGSRTHPDHFGSLEPDYPGAQSNSDHPGPRANLNHPGSRKNLEHTSFRINPYADSLGKPDYPGADIQPNSPPFFGEPDYPSAEDNQNLPSTWREPDYSDAENGHDYGSSETPKMTRGVLSRTSSIQPSFRHRSDDPVGSLWGENDYPEGIEMASMEMANSYGHSLPGAPGSGYVNPAYVGESGPVHAYGNPPLSECDWHKSPQGQKLIASLIPMTSRDRIKAIRNQPRTMEEKRNLRKIVDKEKSKQTHRILQLNCCIQCLNSISRAYRRSKNSLSEILNSISLWQKTLKIIGGKFGTSVLSYFNFLRWLLKFNIFSFILNFSFIIIPQFTVAKKNTLQFTGLEFFTGVGYFRDTVMYYGFYTNSTIQHGNSGASYNMQLAYIFTIGACLTTCFFSLLFSMAKYFRNNFINPHIYSGGITKLIFCWDFTVTHEKAVKLKQKNLSTEIRENLSELRQENSKLTFNQLLTRFSAYMVAWVVSTGVAIACCAAVYYLAEYNLEFLKTHSNPGAVLLLPFVVSCINLAVPCIYSMFRLVERYEMPRHEVYVLLIRNIFLKISIIGILCYYWLNTVALSGEECWETLIGQDIYRLLLMDFVFSLVNSFLGEFLRRIIGMQLITSLGLQEFDIARNVLELIYAQTLVWIGIFFCPLLPFIQMIMLFIMFYSKNISLMMNFQPPSKAWRASQMMTFFIFLLFFPSFTGVLCTLAITIWRIITYLYWQITEGRKIMIRLLHEQIINEGKDKMFLIEKLIKLQDMEKKANPSSLVLERREVEQQGFLHLGEHDGSLDLRSRRSVQEGNPRA

SEQ ID NO: 90820 - protein, 1006 aa, Homo sapiens
  Payload ID: 18151
  Gene Name: transmembrane channel-like 5
  Uniprot ID: Q6UXY8
  ENSP ID: ENSP00000379531
MSAYYRNNWSEEDPDYPDYSGSQNRTQGYLKTQGYPDVPGPLNNPDYPGTRSNPYSVASRTRPDYPGSLAEPNYPRSLSNPDYSGTRSNAYSAASRTSPDHPTSLPEPDYSEFQSHPYHRASSRQPDYPGSQRNPDFAGSSSSGNYAGSRTHPDHFGSLEPDYPGAQSNSDHPGPRANLNHPGSRKNLEHTSFRINPYADSLGKPDYPGADIQPNSPPFFGEPDYPSAEDNQNLPSTWREPDYSDAENGHDYGSSETPKMTRGVLSRTSSIQPSFRHRSDDPVGSLWGENDYPEGIEMASMEMANSYGHSLPGAPGSGYVNPAYVGESGPVHAYGNPPLSECDWHKSPQGQKLIASLIPMTSRDRIKAIRNQPRTMEEKRNLRKIVDKEKSKQTHRILQLNCCIQCLNSISRAYRRSKNSLSEILNSISLWQKTLKIIGGKFGTSVLSYFNFLRWLLKFNIFSFILNFSFIIIPQFTVAKKNTLQFTGLEFFTGVGYFRDTVMYYGFYTNSTIQHGNSGASYNMQLAYIFTIGACLTTCFFSLLFSMAKYFRNNFINPHIYSGGITKLIFCWDFTVTHEKAVKLKQKNLSTEIRENLSELRQENSKLTFNQLLTRFSAYMVAWVVSTGVAIACCAAVYYLAEYNLEFLKTHSNPGAVLLLPFVVSCINLAVPCIYSMFRLVERYEMPRHEVYVLLIRNIFLKISIIGILCYYWLNTVALSGEECWETLIGQDIYRLLLMDFVFSLVNSFLGEFLRRIIGMQLITSLGLQEFDIARNVLELIYAQTLVWIGIFFCPLLPFIQMIMLFIMFYSKNISLMMNFQPPSKAWRASQMMTFFIFLLFFPSFTGVLCTLAITIWRLKPSADCGPFRGLPLFIHSIYSWIDTLSTRPGYLWVVWIYRNLIGSVHFFFILTLIVLIITYLYWQITEGRKIMIRLLHEQIINEGKDKMFLIEKLIKLQDMEKKANPSSLVLERREVEQQGFLHLGEHDGSLDLRSRRSVQEGNPRA

SEQ ID NO: 90821 - protein, 954 aa, Homo sapiens
  Payload ID: 18151
  Gene Name: transmembrane channel-like 5
  ENSP ID: ENSP00000441227
MSAYYRNNWSEEDPDYPDYSGSQNRTQGYLKTQGYPDVPGPLNNPDYPGTRSNPYSVASRTRPDYPGSLAEPNYPRSLSNPDYSGTRSNAYSAASRTSPDHPTSLPEPDYSEFQSHPYHRASSRQPDYPGSQRNPDFAGSSSSGNYAGSRTHPDHFGSLEPDYPGAQSNSDHPGPRANLNHPGSRKNLEHTSFRINPYADSLGKPDYPGADIQPNSPPFFGEPDYPSAEDNQNLPSTWREPDYSDAENGHDYGSSETPKMTRGVLSRTSSIQPSFRHRSDDPVGSLWGENDYPEGIEMASMEMANSYGHSLPGAPGSGYVNPAYVGESGPVHAYGNPPLSECDWHKSPQGQKLIASLIPMTSRDRIKAIRNQPRTMEEKRNLRKIVDKEKSKQTHRILQLNCCIQCLNSISRAYRRSKNSLSEILNSISLWQKTLKIIGGKFGTSVLSYFNFLRWLLKFNIFSFILNFSFIIIPQFTVAKKNTLQFTGLEFFTGVGYFRDTVMYYGFYTNSTIQHGNSGASYNMQLAYIFTIGACLTTCFFSLLFSMAKYFRNNFINPHIYSGGITKLIFCWDFTVTHEKAVKLKQKNLSTEIRFLKTHSNPGAVLLLPFVVSCINLAVPCIYSMFRLVERYEMPRHEVYVLLIRNIFLKISIIGILCYYWLNTVALSGEECWETLIGQDIYRLLLMDFVFSLVNSFLGEFLRRIIGMQLITSLGLQEFDIARNVLELIYAQTLVWIGIFFCPLLPFIQMIMLFIMFYSKNISLMMNFQPPSKAWRASQMMTFFIFLLFFPSFTGVLCTLAITIWRLKPSADCGPFRGLPLFIHSIYSWIDTLSTRPGYLWVVWIYRNLIGSVHFFFILTLIVLIITYLYWQITEGRKIMIRLLHEQIINEGKDKMFLIEKLIKLQDMEKKANPSSLVLERREVEQQGFLHLGEHDGSLDLRSRRSVQEGNPRA

SEQ ID NO: 90822 - protein, 1006 aa, Homo sapiens; identical to SEQ ID NO: 90820
  Payload ID: 18151
  Gene Name: transmembrane channel-like 5
  Uniprot ID: Q6UXY8
  ENSP ID: ENSP00000446274

SEQ ID NO: 90823 - protein, 689 aa, Homo sapiens
  Payload ID: 18151
  Gene Name: transmembrane channel-like 5
  ENSP ID: ENSP00000454710
MLSDDHVNEIIIQKLIASLIPMTSRDRIKAIRNQPRTMEEKRNLSRGGLTITTEDEGRAKAHLTWWKIVDKEKSKQTHRILQLNCCIQCLNSISRAYRRSKNSLSEILNSISLWQKTLKIIGGKFGTSVLSYFNFLRWLLKFNIFSFILNFSFIIIPQFTVAKKNTLQFTGLEFFTGVGYFRDTVMYYGFYTNSTIQHGNSGASYNMQLAYIFTIGACLTTCFFSLLFSMAKYFRNNFINPHIYSGGITKLIFCWDFTVTHEKAVKLKQKNLSTEIRENLSELRQENSKLTFNQLLTRFSAYMVAWVVSTGVAIACCAAVYYLAEYNLEFLKTHSNPGAVLLLPFVVSCINLAVPCIYSMFRLVERYEMPRHEVYVLLIRNIFLKISIIGILCYYWLNTVALSGEECWETLIGQDIYRLLLMDFVFSLVNSFLGEFLRRIIGMQLITSLGLQEFDIARNVLELIYAQTLVWIGIFFCPLLPFIQMIMLFIMFYSKNISLMMNFQPPSKAWRASQMMTFFIFLLFFPSFTGVLCTLAITIWRLKPSADCGPFRGLPLFIHSIYSWIDTLSTRPGYLWVVWIYRNLIGSVHFFFILTLIVLIITYLYWQITEGRKIMIRLLHEQIINEGKDKMFLIEKLIKLQDMEKKANPSSLVLERREVEQQGFLHLGEHDGSLDLRSRRSVQEGNPRA

SEQ ID NO: 90824 - protein, 647 aa, Homo sapiens
  Payload ID: 18151
  Gene Name: transmembrane channel-like 5
  Uniprot ID: Q6UXY8
  ENSP ID: ENSP00000456148
MTSRDRIKAIRNQPRTMEEKRNLRKIVDKEKSKQTHRILQLNCCIQCLNSISRAYRRSKNSLSEILNSISLWQKTLKIIGGKFGTSVLSYFNFLRWLLKFNIFSFILNFSFIIIPQFTVAKKNTLQFTGLEFFTGVGYFRDTVMYYGFYTNSTIQHGNSGASYNMQLAYIFTIGACLTTCFFSLLFSMAKYFRNNFINPHIYSGGITKLIFCWDFTVTHEKAVKLKQKNLSTEIRENLSELRQENSKLTFNQLLTRFSAYMVAWVVSTGVAIACCAAVYYLAEYNLEFLKTHSNPGAVLLLPFVVSCINLAVPCIYSMFRLVERYEMPRHEVYVLLIRNIFLKISIIGILCYYWLNTVALSGEECWETLIGQDIYRLLLMDFVFSLVNSFLGEFLRRIIGMQLITSLGLQEFDIARNVLELIYAQTLVWIGIFFCPLLPFIQMIMLFIMFYSKNISLMMNFQPPSKAWRASQMMTFFIFLLFFPSFTGVLCTLAITIWRLKPSADCGPFRGLPLFIHSIYSWIDTLSTRPGYLWVVWIYRNLIGSVHFFFILTLIVLIITYLYWQITEGRKIMIRLLHEQIINEGKDKMFLIEKLIKLQDMEKKANPSSLVLERREVEQQGFLHLGEHDGSLDLRSRRSVQEGNPRA

SEQ ID NO: 90825 - protein, 32 aa, Homo sapiens
  Payload ID: 18151
  Gene Name: transmembrane channel-like 5
  ENSP ID: ENSP00000458240
  MOD_RES (1)..(1): Any amino acid
XRIGIFFCPLLPFIQMIMLFIMFYSKNIEAFS

SEQ ID NO: 90826 - protein, 42 aa, Homo sapiens
  Payload ID: 18151
  Gene Name: transmembrane channel-like 5
  ENSP ID: ENSP00000461008
  MOD_RES (1)..(1): Any amino acid
XPFVVSCINLAVPCIYSMFRLVERYEMPRHEVYVLLIRRGLM

SEQ ID NO: 90827 - protein, 454 aa, Homo sapiens
  Payload ID: 18152
  Gene Name: transmembrane channel-like 6
  Uniprot ID: Q7Z403
  ENSP ID: ENSP00000306405
MAQPLAFILDVPETPGDQGQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKELQSLAVAQRDHMLRGMPLSLAEKRSLREKSRTPRGKWRGQPGSGGVCSCCGRLRYACVLALHSLGLALLSALQALMPWRYALKRIGGQFGSSVLSYFLFLKTLLAFNALLLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKGEDKIFLINKLHSIYERKEREERSRVGTTEEAAAPPALLTDEQDA

SEQ ID NO: 90828 - protein, 805 aa, Homo sapiens
  Payload ID: 18152
  Gene Name: transmembrane channel-like 6
  Uniprot ID: Q7Z403
  ENSP ID: ENSP00000313408
MAQPLAFILDVPETPGDQGQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKELQSLAVAQRDHMLRGMPLSLAEKRSLREKSRTPRGKWRGQPGSGGVCSCCGRLRYACVLALHSLGLALLSALQALMPWRYALKRIGGQFGSSVLSYFLFLKTLLAFNALLLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRNLILKLAILGTLCYHWLGRRVGVLQGQCWEDFVGQELYRFLVMDFVLMLLDTLFGELVWRIISEKKLKRRRKPEFDIARNVLELIYGQTLTWLGVLFSPLLPAVQIIKLLLVFYVKKTSLLANCQAPRRPWLASHMSTVFLTLLCFPAFLGAAVFLCYAVWQVKPSSTCGPFRTLDTMYEAGRVWVRHLEAAGPRVSWLPWVHRYLMENTFFVFLVSALLLAVIYLNIQVVRGQRKVICLLKEQISNEGEDKIFLINKLHSIYERKEREERSRVGTTEEAAAPPALLTDEQDA

SEQ ID NO: 90829 - protein, 805 aa, Homo sapiens; identical to SEQ ID NO: 90828
  Payload ID: 18152
  Gene Name: transmembrane channel-like 6
  Uniprot ID: Q7Z403
  ENSP ID: ENSP00000376260

SEQ ID NO: 90830 - protein, 384 aa, Homo sapiens
  Payload ID: 18152
  Gene Name: transmembrane channel-like 6
  Uniprot ID: Q7Z403
  ENSP ID: ENSP00000464853
MAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRIISEKKLKRRRKPEFDIARNVLELIYGQTLTWLGVLFSPLLPAVQIIKLLLVFYVKKTSLLANCQAPRRPWLASHMSTVFLTLLCFPAFLGAAVFLCYAVWQVKPSSTCGPFRTLDTMYEAGRVWVRHLEAAGPRVSWLPWVHRYLMENTFFVFLVSALLLAVIYLNIQVVRGQRKVICLLKEQISNEGEDKIFLINKLHSIYERKEREERSRVGTTEEAAAPPALLTDEQDA

SEQ ID NO: 90831 - protein, 805 aa, Homo sapiens; identical to SEQ ID NO: 90828
  Payload ID: 18152
  Gene Name: transmembrane channel-like 6
  Uniprot ID: Q7Z403
  ENSP ID: ENSP00000465261

SEQ ID NO: 90832 - protein, 298 aa, Homo sapiens
  Payload ID: 18152
  Gene Name: transmembrane channel-like 6
  Uniprot ID: Q7Z403
  ENSP ID: ENSP00000465359
MPWRYALKRIGGQFGSSVLSYFLFLKTLLAFNALLLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRCVAAHENIIWCWS

SEQ ID NO: 90833 - protein, 41 aa, Homo sapiens
  Payload ID: 18152
  Gene Name: transmembrane channel-like 6
  ENSP ID: ENSP00000466159
MAQPLAFILDVPETPGDQGSSRSRASARPRRGWSCSRESGR

SEQ ID NO: 90834 - protein, 153 aa, Homo sapiens
  Payload ID: 18152
  Gene Name: transmembrane channel-like 6
  ENSP ID: ENSP00000466885
MAQPLAFILDVPETPGDQGQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKEL

SEQ ID NO: 90835 - protein, 143 aa, Homo sapiens
  Payload ID: 18152
  Gene Name: transmembrane channel-like 6
  ENSP ID: ENSP00000467016
MAQPLAFILDVPETPGDQGQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEE

SEQ ID NO: 90836 - protein, 285 aa, Homo sapiens
  Payload ID: 18152
  Gene Name: transmembrane channel-like 6
  ENSP ID: ENSP00000468255
MAQPLAFILDVPETPGDQGQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKELQSLAVAQRDHMLRGMPLSLAEKRSLREKSRTPRGKWRGQPGSGGVCSCCGRLRYACVLALHSLGLALLSALQALMPWRYALKRIGGQFGSSVLSYFLFLKTLLAFNALLLLLLVAFIMGPQVAFPPALPGPA

SEQ ID NO: 90837 - protein, 723 aa, Homo sapiens
  Payload ID: 18153
  Gene Name: transmembrane channel-like 7
  Uniprot ID: Q7Z402
  ENSP ID: ENSP00000304710
MSESSGSALQPGRPSRQPAVHPENLSLDSSCFSSPPVNFLQELPSYRSIARRRTTVHSRDKQSGTLLKPTDSYSSQLEDRIAENLSSHSLRNYALNISEKRRLRDIQETQMKYLSEWDQWKRYSSKSWKRFLEKAREMTTHLELWREDIRSIEGKFGTGIQSYFSFLRFLVLLNLVIFLIIFMLVLLPVLLTKYKITNSSFVLIPFKDMDKQCTVYPVSSSGLIYFYSYIIDLLSGTGFLEETSLFYGHYTIDGVKFQNFTYDLPLAYLLSTIASLALSLLWIVKRSVEGFKINLIRSEEHFQSYCNKIFAGWDFCITNRSMADLKHSSLRYELRADLEEERMRQKIAERTSEETIRIYSLRLFLNCIVLAVLGACFYAIYVATVFSQEHMKKEIDKMVFGENLFILYLPSIVITLANFITPMIFAKIIRYEDYSPGFEIRLTILRCVFMRLATICVLVFTLGSKITSCDDDTCDLCGYNQKLYPCWETQVGQEMYKLMIFDFIIILAVTLFVDFPRKLLVTYCSSCKLIQCWGQQEFAIPDNVLGIVYGQTICWIGAFFSPLLPAIATLKFIIIFYVKEWSLLYTCRPSPRPFRASNSNFFFLLVLLIGLCLAIIPLTISISRIPSSKACGPFTNFNTTWEVIPKTVSTFPSSLQSFIHGVTSEAFAVPFFMIICLIMFYFIALAGAHKRVVIQLREQLSLESRDKCYLIQKLTEAQRDMRN

SEQ ID NO: 90838 - protein, 613 aa, Homo sapiens
  Payload ID: 18153
  Gene Name: transmembrane channel-like 7
  Uniprot ID: Q7Z402
  ENSP ID: ENSP00000397081
MKYLSEWDQWKRYSSKSWKRFLEKAREMTTHLELWREDIRSIEGKFGTGIQSYFSFLRFLVLLNLVIFLIIFMLVLLPVLLTKYKITNSSFVLIPFKDMDKQCTVYPVSSSGLIYFYSYIIDLLSGTGFLEETSLFYGHYTIDGVKFQNFTYDLPLAYLLSTIASLALSLLWIVKRSVEGFKINLIRSEEHFQSYCNKIFAGWDFCITNRSMADLKHSSLRYELRADLEEERMRQKIAERTSEETIRIYSLRLFLNCIVLAVLGACFYAIYVATVFSQEHMKKEIDKMVFGENLFILYLPSIVITLANFITPMIFAKIIRYEDYSPGFEIRLTILRCVFMRLATICVLVFTLGSKITSCDDDTCDLCGYNQKLYPCWETQVGQEMYKLMIFDFIIILAVTLFVDFPRKLLVTYCSSCKLIQCWGQQEFAIPDNVLGIVYGQTICWIGAFFSPLLPAIATLKFIIIFYVKEWSLLYTCRPSPRPFRASNSNFFFLLVLLIGLCLAIIPLTISISRIPSSKACGPFTNFNTTWEVIPKTVSTFPSSLQSFIHGVTSEAFAVPFFMIICLIMFYFIALAGAHKRVVIQLREQLSLESRDKCYLIQKLTEAQRDMRN

SEQ ID NO: 90839 - protein, 758 aa, Homo sapiens
  Payload ID: 18153
  Gene Name: transmembrane channel-like 7
  ENSP ID: ENSP00000455041
MSESSGSALQPGRPSRQPAVHPENLSLDSSCFSSPPVNFLQELPSYRSIARRRTTVHSRDKQSGTLLKPTDSYSSQLEDRIAENLSSHSLRNYALNISEKRRLRDIQETQMKYLSEWDQWKRYSSKSWKRFLEKAREMTTHLELWREDIRSIEGKFGTGIQSYFSFLRFLVLLNLVIFLIIFMLVLLPVLLTKYKITNSSFVLIPFKDMDKQCTVYPVSSSGLIYFYSYIIDLLSGTGFLEETSLFYGHYTIDGVKFQNFTYDLPLAYLLSTIASLALSLLWIVKRSVEGFKINLIRSEEHFQSYCNKIFAGWDFCITNRSMADLKHSSLRYELRADLEEERMRQKIAERTSEETIRIYSLRLFLNCIVLAVLGACFYAIYVATVFSQEHMKKEIDKMVFGENLFILYLPSIVITLANFITPMIFAKIIRYEDYSPGFEIRLTILRCVFMRLATICVLVFTLGSKITSCDDDTCDLCGYNQKLYPCWETQVGQEMYKLMIFDFIIILAVTLFVDFPRKLLVTYCSSCKLIQCWGQQEFAIPDNVLGIVYGQTICWIGAFFSPLLPAIATLKFIIIFYVKEWSLLYTCRPSPRPFRASNSNFFFLLVLLIGLCLAIIPLTISISRIPSSKACGPFTNFNTTWEVIPKTVSTFPSSLQSFIHGVTSEAFAVPFFMIICLIMFYFIALAGAHKRVVIQLREQLSLVRKHSSRGSWLGTFTQDTARKVLFSWEGVKLLQPSLTTTSPKLCLEAQPRPASLIH

SEQ ID NO: 90840 - protein, 726 aa, Homo sapiens
  Payload ID: 18154
  Gene Name: transmembrane channel-like 8
  Uniprot ID: Q8IU68
  ENSP ID: ENSP00000325561
MLLPRSVSSERAPGVPEPEELWEAEMERLRGSGTPVRGLPYAMMDKRLIWQLREPAGVQTLRWQRWQRRRQTVERRLREAAQRLARGLGLWEGALYEIGGLFGTGIRSYFTFLRFLLLLNLLSLLLTASFVLLPLVWLRPPDPGPTLNLTLQCPGSRQSPPGVLRFHNQLWHVLTGRAFTNTYLFYGAYRVGPESSSVYSIRLAYLLSPLACLLLCFCGTLRRMVKGLPQKTLLGQGYQAPLSAKVFSSWDFCIRVQEAATIKKHEISNEFKVELEEGRRFQLMQQQTRAQTACRLLSYLRVNVLNGLLVVGAISAIFWATKYSQDNKEESLFLLLQYLPPGVIALVNFLGPLLFTFLVQLENYPPNTEVNLTLIWCVVLKLASLGMFSVSLGQTILCIGRDKSSCESYGYNVCDYQCWENSVGEELYKLSIFNFLLTVAFAFLVTLPRRLLVDRFSGRFWAWLEREEFLVPKNVLDIVAGQTVTWMGLFYCPLLPLLNSVFLFLTFYIKKYTLLKNSRASSRPFRASSSTFFFQLVLLLGLLLAAVPLGYVVSSIHSSWDCGLFTNYSAPWQVVPELVALGLPPIGQRALHYLGSHAFSFPLLIMLSLVLTVCVSQTQANARAIHRLRKQLVWQVQEKWHLVEDLSRLLPEPGPSDSPGPKYPASQASRPQSFCPGCPCPGSPGHQAPRPGPSVVDAAGLRSPCPGQHGAPASARRFRFPSGAEL

SEQ ID NO: 90841 - protein, 196 aa, Homo sapiens
  Payload ID: 18154
  Gene Name: transmembrane channel-like 8
  ENSP ID: ENSP00000465049
MLLPRSVSSERAPGVPEPEELWEAEMERLRGSGTPVRGLPYAMMDKRLIWQLREPAGVQTLRWQRWQRRRQTVERRLREAAQRLARGLGLWEGALYEIGGRTRATRTSPCPLWSPTAQIGKRRVASSHLPSPGSPDQSAPPPSHPFRPQAPQTSGPRSTPRPLRHRNSVLLHLPPLPAATQPAEPAAHRKLRAAAP

SEQ ID NO: 90842 - protein, 2 aa, Homo sapiens
  Payload ID: 18154
  Gene Name: transmembrane channel-like 8
  ENSP ID: ENSP00000467460
ML

SEQ ID NO: 90843 - protein, 503 aa, Homo sapiens
  Payload ID: 18154
  Gene Name: transmembrane channel-like 8
  Uniprot ID: Q8IU68
  ENSP ID: ENSP00000467482
MVKGLPQKTLLGQGYQAPLSAKVFSSWDFCIRVQEAATIKKHEISNEFKVELEEGRRFQLMQQQTRAQTACRLLSYLRVNVLNGLLVVGAISAIFWATKYSQDNKEESLFLLLQYLPPGVIALVNFLGPLLFTFLVQLENYPPNTEVNLTLIWCVVLKLASLGMFSVSLGQTILCIGRDKSSCESYGYNVCDYQCWENSVGEELYKLSIFNFLLTVAFAFLVTLPRRLLVDRFSGRFWAWLEREEFLVPKNVLDIVAGQTVTWMGLFYCPLLPLLNSVFLFLTFYIKKYTLLKNSRASSRPFRASSSTFFFQLVLLLGLLLAAVPLGYVVSSIHSSWDCGLFTNYSAPWQVVPELVALGLPPIGQRALHYLGSHAFSFPLLIMLSLVLTVCVSQTQANARAIHRLRKQLVWQVQEKWHLVEDLSRLLPEPGPSDSPGPKYPASQASRPQSFCPGCPCPGSPGHQAPRPGPSVVDAAGLRSPCPGQHGAPASARRFRFPSGAEL

SEQ ID NO: 90844 - protein, 273 aa, Homo sapiens
  Payload ID: 18155
  Gene Name: transmembrane epididymal protein 1
  Uniprot ID: Q5T9Z0
  ENSP ID: ENSP00000356536
MILKGCLLYPLCSPRNKQRCARLWKIAYGGLLKIVTGSLLTFYVVLCLDGGMVLMRKQVPSRFMYPKEWQHLTMFILLTLNGCVDFMSKNVLPQRCVGLEKGTLVLIIYELLLLMVSHVKDSEGVELHVYSLLILVVFLLLLVLTAELWAPNMCHLQLMETFLILMMGSWLMQAGFILYRPVSGYPWQDDDISDIMFVTTFFCWHVMINASFLLGIYGFSSFWYHCFRPSLKLTGPKEAPYYASTPGPLYKLLQEVEQSEKEDQALLLPKSSP

SEQ ID NO: 90845 - protein, 156 aa, Homo sapiens
  Payload ID: 18156
  Gene Name: transmembrane inner ear
  Uniprot ID: Q8NEW7
  ENSP ID: ENSP00000324775
MAGWPGAGPLCVLGGAALGVCLAGVAGQLVEPSTAPPKPKPPPLTKETVVFWDMRLWHVVGIFSLFVLSIIITLCCVFNCRVPRTRKEIEARYLQRKAAKMYTDKLETVPPLNELTEVPGEDKKKKKKKKKDSVDTVAIKVEEDEKNEAKKKKGEK

SEQ ID NO: 90846 - protein, 227 aa, Homo sapiens
  Payload ID: 18157
  Gene Name: transmembrane p24 trafficking protein 1
  Uniprot ID: Q13445
  ENSP ID: ENSP00000214869
MMAAGAALALALWLLMPPVEVGGAGPPPIQDGEFTFLLPAGRKQCFYQSAPANASLETEYQVIGGAGLDVDFTLESPQGVLLVSESRKADGVHTVEPTEAGDYKLCFDNSFSTISEKLVFFELIFDSLQDDEEVEGWAEAVEPEEMLDVKMEDIKESIETMRTRLERSIQMLTLLRAFEARDRNLQEGNLERVNFWSAVNVAVLLLVAVLQVCTLKRFFQDKRPVPT

SEQ ID NO: 90847 - protein, 82 aa, Homo sapiens
  Payload ID: 18157
  Gene Name: transmembrane p24 trafficking protein 1
  ENSP ID: ENSP00000464824
MLDVKMEDIKESIETMRTRLERSIQMLTLLRAFEARDRNLQEGNLERVNFWSAVNVAVLLLVAVLQVCTLKRFFQDKRPVPT

SEQ ID NO: 90848 - protein, 65 aa, Homo sapiens
  Payload ID: 18157
  Gene Name: transmembrane p24 trafficking protein 1
  ENSP ID: ENSP00000464856
  MOD_RES (1)..(1): Any amino acid
XEVEGWAEAVEPEEMLDVKMEDIKVCPGCAGATPSRSLGFTWGAPLGLTQPPLRSCALQLNYRVH

SEQ ID NO: 90849 - protein, 191 aa, Homo sapiens
  Payload ID: 18157
  Gene Name: transmembrane p24 trafficking protein 1
  ENSP ID: ENSP00000467690
MMAAGAALALALWLLMPPVEVGGAGPPPIQDGEFTFLLPAGRKQCFYQSAPANASLETEYQVIGGAGLDVDFTLESPQGVLLVSESRKADGVHTTISEKLVFFELIFDSLQDDEEVEGWAEAVEPEEMLDVKMEDIKESIETMRTRLERSIQMLTLLRAFEARDRNLQEGNLERVNFWSAVNVAVLLLVAV

SEQ ID NO: 90850 - protein, 74 aa, Homo sapiens
  Payload ID: 18157
  Gene Name: transmembrane p24 trafficking protein 1
  ENSP ID: ENSP00000468054
MMAAGAALALALWLLMPPVEVGGAGPPPIQDGEFTFLLPAGRKQCFYQSAPANASLETEYQGGANGGRGLQAVL

SEQ ID NO: 90851 - protein, 185 aa, Homo sapiens
  Payload ID: 18157
  Gene Name: transmembrane p24 trafficking protein 1
  ENSP ID: ENSP00000468294
MMAAGAALALALWLLMPPVEVGGAGPPPIQDGEFTFLLPAGRKQCFYQSAPANASLETEYQVIGGAGLDVDFTLESPQGVLLVSESRKADGVHTSPLRPCGPGWSAASRCSRYCGPSRHVTATCKRATWSGSTSGQLSTWRCCCWWLCCRSARSSASSRTSARCPRSPCHGRKNGTKEGQQGVCI

SEQ ID NO: 90852 - protein, 95 aa, Homo sapiens
  Payload ID: 18157
  Gene Name: transmembrane p24 trafficking protein 1
  ENSP ID: ENSP00000468492
MMAAGAALALALWLLMPPVEVGGAGPPPIQDGEFTFLLPAGRKQCFYQSAPANASLETEYQVIGGAGLDVDFTLESPQGVLLGGANGGRGLQAVL

SEQ ID NO: 90853 - protein, 219 aa, Homo sapiens
  Payload ID: 18158
  Gene Name: transmembrane p24 trafficking protein 10
  Uniprot ID: P49755
  ENSP ID: ENSP00000303145
MSGLSGPPARRGPFPLALLLLFLLGPRLVLAISFHLPINSRKCLREEIHKDLLVTGAYEISDQSGGAGGLRSHLKITDSAGHILYSKEDATKGKFAFTTEDYDMFEVCFESKGTGRIPDQLVILDMKHGVEAKNYEEIAKVEKLKPLEVELRRLEDLSESIVNDFAYMKKREEEMRDTNESTNTRVLYFSIFSMFCLIGLATWQVFYLRRFFKAKKLIE

SEQ ID NO: 90854 - protein, 153 aa, Homo sapiens
  Payload ID: 18158
  Gene Name: transmembrane p24 trafficking protein 10
  ENSP ID: ENSP00000450726
MSGLSGPPARRGPFPLALLLLFLLGPRLVLAISFHLPINSRKCLREEIHKDLLVTGAYEISDQSGGAGGLRSHLKITDSAGHILYSKEDATKGKFAFTTEDYDMFEVCFESKGTGRIPDQLVILDMKHGVEAKNYEEHSVSEEKVWKDNTSSL

SEQ ID NO: 90855 - protein, 201 aa, Homo sapiens
  Payload ID: 18159
  Gene Name: transmembrane p24 trafficking protein 2
  Uniprot ID: Q15363
  ENSP ID: ENSP00000262225
MVTLAELLVLLAALLATVSGYFVSIDAHAEECFFERVTSGTKMGLIFEVAEGGFLDIDVEITGPDNKGIYKGDRESSGKYTFAAHMDGTYKFCFSNRMSTMTPKIVMFTIDIGEAPKGQDMETEAHQNKLEEMINELAVAMTAVKHEQEYMEVRERIHRAINDNTNSRVVLWSFFEALVLVAMTLGQIYYLKRFFEVRRVV

SEQ ID NO: 90856 - protein, 166 aa, Homo sapiens
  Payload ID: 18159
  Gene Name: transmembrane p24 trafficking protein 2
  ENSP ID: ENSP00000405845
MVTLAELLVLLAALLATVSGYFVSIDAHAEECFFERVTSGTKMGLIFEVAEGGFLDIDVEITGPDNKGIYKGDRESSGKYTFAAHMDGTYKFCFSNRMSTMTPKIVMFTIDIGEAPKGQDMETEGGGDTWDAHQNKLEEMINELAVAMTAVKHEQEYMEVRERIHR

SEQ ID NO: 90857 - protein, 116 aa, Homo sapiens
  Payload ID: 18159
  Gene Name: transmembrane p24 trafficking protein 2
  ENSP ID: ENSP00000441161
MDGTYKFCFSNRMSTMTPKIVMFTIDIGEAPKGQDMETEAHQNKLEEMINELAVAMTAVKHEQEYMEVRERIHRAINDNTNSRVVLWSFFEALVLVAMTLGQIYYLKRFFEVRRVV

SEQ ID NO: 90858 - protein, 217 aa, Homo sapiens
  Payload ID: 18160
  Gene Name: transmembrane p24 trafficking protein 3
  Uniprot ID: Q9Y3Q3
  ENSP ID: ENSP00000299705
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQMESACVTIHEALKTVIDSQTHYRLREAQDRARAEDLNSRVSYWSVGETIALFVVSFSQVLLLKSFFTEKRPISRAVHS

SEQ ID NO: 90859 - protein, 173 aa, Homo sapiens
  Payload ID: 18160
  Gene Name: transmembrane p24 trafficking protein 3
  Uniprot ID: Q9Y3Q3
  ENSP ID: ENSP00000414983
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQRFRGAYWKEVDKMVDYMQPGGTPATEGLGRLAPS

SEQ ID NO: 90860 - protein, 146 aa, Homo sapiens
  Payload ID: 18160
  Gene Name: transmembrane p24 trafficking protein 3
  ENSP ID: ENSP00000440228
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQGFRVFCL

SEQ ID NO: 90861 - protein, 155 aa, Homo sapiens
  Payload ID: 18160
  Gene Name: transmembrane p24 trafficking protein 3
  ENSP ID: ENSP00000446062
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQGPSASPTPTPPLRVPV

SEQ ID NO: 90862 - protein, 178 aa, Homo sapiens
  Payload ID: 18161
  Gene Name: transmembrane p24 trafficking protein 4
  ENSP ID: ENSP00000289577
MAGVGAGPLRAMGRQALLLLALCATGAQGLYFHIGETEKRCFIEEIPDETMVIGNYRTQMWDKQKEVFLPSTPGLGMHVEVKDPDGKVVLSRQYGSEGRFTFTSHTPGDHQICLHSNSTRMALFAGGKLYREERFRLTSESTNQRVLWWSIAQTVILILTGIWQMRHLKSFFEAKKLV

SEQ ID NO: 90863 - protein, 227 aa, Homo sapiens
  Payload ID: 18161
  Gene Name: transmembrane p24 trafficking protein 4
  Uniprot ID: Q7Z7H5
  ENSP ID: ENSP00000404042
MAGVGAGPLRAMGRQALLLLALCATGAQGLYFHIGETEKRCFIEEIPDETMVIGNYRTQMWDKQKEVFLPSTPGLGMHVEVKDPDGKVVLSRQYGSEGRFTFTSHTPGDHQICLHSNSTRMALFAGGKLRVHLDIQVGEHANNYPEIAAKDKLTELQLRARQLLDQVEQIQKEQDYQRYREERFRLTSESTNQRVLWWSIAQTVILILTGIWQMRHLKSFFEAKKLV

SEQ ID NO: 90864 - protein, 186 aa, Homo sapiens
  Payload ID: 18161
  Gene Name: transmembrane p24 trafficking protein 4
  Uniprot ID: Q7Z7H5
  ENSP ID: ENSP00000417443
MAGVGAGPLRAMGRQALLLLALCATGAQGLYFHIGETEKRCFIEEIPDETMVIGNYRTQMWDKQKEVFLPSTPGLGMHVEVKDPDGKVVLSRQYGSEGRFTFTSHTPGDHQICLHSNSTRMALFAGGKLRVHLDIQVGEHANNYPEIAAKDKLTELQLRARQLLDQVEQIQKEQDYQRASAYLLVI

SEQ ID NO: 90865 - protein, 162 aa, Homo sapiens
  Payload ID: 18162
  Gene Name: transmembrane p24 trafficking protein 5
  ENSP ID: ENSP00000359303
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILVSMVF

SEQ ID NO: 90866 - protein, 229 aa, Homo sapiens
  Payload ID: 18162
  Gene Name: transmembrane p24 trafficking protein 5
  Uniprot ID: Q9Y3A6
  ENSP ID: ENSP00000359305
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILESINSIKSRLSKSGHIQTLLRAFEARDRNIQESNFDRVNFWSMVNLVVMVVVSAIQVYMLKSLFEDKRKSRT

SEQ ID NO: 90867 - protein, 193 aa, Homo sapiens
  Payload ID: 18162
  Gene Name: transmembrane p24 trafficking protein 5
  Uniprot ID: Q9Y3A6
  ENSP ID: ENSP00000418992
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILDPIIKIASDVQIRLHLGIHQQHQVQTKQKWAHTNSA

SEQ ID NO: 90868 - protein, 120 aa, Homo sapiens
  Payload ID: 18162
  Gene Name: transmembrane p24 trafficking protein 5
  ENSP ID: ENSP00000471060
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTCIRSKNGPGTAVHAYNPSTFRGQV

SEQ ID NO: 90869 - protein, 240 aa, Homo sapiens
  Payload ID: 18163
  Gene Name: transmembrane p24 trafficking protein 6
  Uniprot ID: Q8WW62
  ENSP ID: ENSP00000288025
MSPLLFGAGLVVLNLVTSARSQKTEPLSGSGDQPLFRGADRYDFAIMIPPGGTECFWQFAHQTGYFYFSYEVQRTVGMSHDRHVAATAHNPQGFLIDTSQGVRGQINFSTQETGFYQLCLSNQHNHFGSVQVYLNFGVFYEGPETDHKQKERKQLNDTLDAIEDGTQKVQNNIFHMWRYYNFARMRKMADFFLIQSNYNYVNWWSTAQSLVIILSGILQLYFLKRLFNVPTTTDTKKPRC

SEQ ID NO: 90870 - protein, 224 aa, Homo sapiens
  Payload ID: 18164
  Gene Name: transmembrane p24 trafficking protein 7
  Uniprot ID: Q9Y3B3
  ENSP ID: ENSP00000405926
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVAYWSVGEALILLVVSIGQVFLLKSFFSDKRTTTTRVGS

SEQ ID NO: 90871 - protein, 81 aa, Homo sapiens
  Payload ID: 18164
  Gene Name: transmembrane p24 trafficking protein 7
  ENSP ID: ENSP00000450928
MPRPGSAQRWAAVAGRWGCRLLALLLLVPGPGGASEITFELPDNAKQCFYEDIAQGTKCTLEFQVITGGHYDVDCRLEDPD

SEQ ID NO: 90872 - protein, 235 aa, Homo sapiens
  Payload ID: 18165
  Gene Name: transmembrane p24 trafficking protein 9
  Uniprot ID: Q9BVK6
  ENSP ID: ENSP00000330945
MAVELGVLLVRPRPGTGLGRVMRTLLLVLWLATRGSALYFHIGETEKKCFIEEIPDETMVIGNYRTQLYDKQREEYQPATPGLGMFVEVKDPEDKVILARQYGSEGRFTFTSHTPGEHQICLHSNSTKFSLFAGGMLRVHLDIQVGEHANDYAEIAAKDKLSELQLRVRQLVEQVEQIQKEQNYQRWREERFRQTSESTNQRVLWWSILQTLILVAIGVWQMRHLKSFFEAKKLV

SEQ ID NO: 90873 - protein, 325 aa, Homo sapiens
  Payload ID: 18166
  Gene Name: transmembrane p24 trafficking protein family member 8
  Uniprot ID: Q6PL24
  ENSP ID: ENSP00000216468
MSDLQAAEGPGSWSPTARPGSAGGVGDCQGVEGSQAAASENEDLENKDTSLLASATDPEPCSSPHRPQMVSPVSKDATEDLRKATGPLEAQALVKQDLLPADQAQVLNEMAKYQVPQRSGDIVMIQSEHTGAIDVLSADLESADLLGDHRKVSPPLMAPPCIWTFAKVKEFKSKLGKEKNSRLVVKRGEVVTIRVPTHPEGKRVCWEFATDDYDIGFGVYFDWTPVTSTDITVQVSDSSDDEDEEEEEEEEIEEPVPAGDVERGSRSSLRGRYGEVMPVYRRDSHRDVQAGSHDYPGEGIYLLKFDNSYSLLRNKTLYFHIYYTS

SEQ ID NO: 90874 - protein, 533 aa, Homo sapiens
  Payload ID: 18167
  Gene Name: transmembrane phosphatase with tensin homology
  Uniprot ID: P56180
  ENSP ID: ENSP00000482040
MNESPDPTDLAGVIIELGPNDSPQTSEFKGATEEAPAKESVLARLSKFEVEDAENVASYDSKIKKIVHSIVSSFAFGLFGVFLVLLDVTLILADLIFTDSKLYIPLEYRSISLAIALFFLMDVLLRVFVERRQQYFSDLFNILDTAIIVILLLVDVVYIFFDIKLLRNIPRWTHLLRLLRLIILLRIFHLFHQKRQLEKLIRRRVSENKRRYTRDGFDLDLTYVTERIIAMSFPSSGRQSFYRNPIKEVVRFLDKKHRNHYRVYNLCSERAYDPKHFHNRVVRIMIDDHNVPTLHQMVVFTKEVNEWMAQDLENIVAIHCKGGTDRTGTMVCAFLIASEICSTAKESLYYFGERRTDKTHSEKFQGVKTPSQKRYVAYFAQVKHLYNWNLPPRRILFIKHFIIYSIPRYVRDLKIQIEMEKKVVFSTISLGKCSVLDNITTDKILIDVFDGLPLYDDVKVQFFYSNLPTYYDNCSFYFWLHTSFIENNRLYLPKNELDNLHKQKARRIYPSDFAVEILFGEKMTSSDVVAGSD

SEQ ID NO: 90875 - protein, 513 aa, Homo sapiens
  Payload ID: 18167
  Gene Name: transmembrane phosphatase with tensin homology
  Uniprot ID: P56180
  ENSP ID: ENSP00000482488
MNESPDPTDLAGVIIELGPNDSPQTSEFKGATEEAPAKESSKIKKIVHSIVSSFAFGLFGVFLVLLDVTLILADLIFTDSKLYIPLEYRSISLAIALFFLMDVLLRVFVERRQQYFSDLFNILDTAIIVILLLVDVVYIFFDIKLLRNIPRWTHLLRLLRLIILLRIFHLFHQKRQLEKLIRRRVSENKRRYTRDGFDLDLTYVTERIIAMSFPSSGRQSFYRNPIKEVVRFLDKKHRNHYRVYNLCSERAYDPKHFHNRVVRIMIDDHNVPTLHQMVVFTKEVNEWMAQDLENIVAIHCKGGTDRTGTMVCAFLIASEICSTAKESLYYFGERRTDKTHSEKFQGVKTPSQKRYVAYFAQVKHLYNWNLPPRRILFIKHFIIYSIPRYVRDLKIQIEMEKKVVFSTISLGKCSVLDNITTDKILIDVFDGLPLYDDVKVQFFYSNLPTYYDNCSFYFWLHTSFIENNRLYLPKNELDNLHKQKARRIYPSDFAVEILFGEKMTSSDVVAGSD

SEQ ID NO: 90876 - protein, 413 aa, Homo sapiens
  Payload ID: 18167
  Gene Name: transmembrane phosphatase with tensin homology
  Uniprot ID: P56180
  ENSP ID: ENSP00000483087
MDVLLRVFVERRQQYFSDLFNILDTAIIVILLLVDVVYIFFDIKLLRNIPRWTHLLRLLRLIILLRIFHLFHQKRQLEKLIRRRVSENKRRYTRDGFDLDLTYVTERIIAMSFPSSGRQSFYRNPIKEVVRFLDKKHRNHYRVYNLCSERAYDPKHFHNRVVRIMIDDHNVPTLHQMVVFTKEVNEWMAQDLENIVAIHCKGGTDRTGTMVCAFLIASEICSTAKESLYYFGERRTDKTHSEKFQGVKTPSQKRYVAYFAQVKHLYNWNLPPRRILFIKHFIIYSIPRYVRDLKIQIEMEKKVVFSTISLGKCSVLDNITTDKILIDVFDGLPLYDDVKVQFFYSNLPTYYDNCSFYFWLHTSFIENNRLYLPKNELDNLHKQKARRIYPSDFAVEILFGEKMTSSDVVAGSD

SEQ ID NO: 90877 - protein, 140 aa, Homo sapiens
  Payload ID: 18167
  Gene Name: transmembrane phosphatase with tensin homology
  ENSP ID: ENSP00000484064
MNESPDPTDLAGVIIELGPNDSPHTSEFKGAARVSPISESVLARLSKFEVEDAENVASYDSKIKKIVHSIVSSFAFGLFGVFLVLLDVTLILADLIFTDSKLYIPLEYRSISLAIALFFLMDVLLRVFVERRQQYFSDLF

SEQ ID NO: 90878 - protein, 551 aa, Homo sapiens
  Payload ID: 18167
  Gene Name: transmembrane phosphatase with tensin homology
  Uniprot ID: P56180
  ENSP ID: ENSP00000484403
MNESPDPTDLAGVIIELGPNDSPQTSEFKGATEEAPAKESPHTSEFKGAARVSPISESVLARLSKFEVEDAENVASYDSKIKKIVHSIVSSFAFGLFGVFLVLLDVTLILADLIFTDSKLYIPLEYRSISLAIALFFLMDVLLRVFVERRQQYFSDLFNILDTAIIVILLLVDVVYIFFDIKLLRNIPRWTHLLRLLRLIILLRIFHLFHQKRQLEKLIRRRVSENKRRYTRDGFDLDLTYVTERIIAMSFPSSGRQSFYRNPIKEVVRFLDKKHRNHYRVYNLCSERAYDPKHFHNRVVRIMIDDHNVPTLHQMVVFTKEVNEWMAQDLENIVAIHCKGGTDRTGTMVCAFLIASEICSTAKESLYYFGERRTDKTHSEKFQGVKTPSQKRYVAYFAQVKHLYNWNLPPRRILFIKHFIIYSIPRYVRDLKIQIEMEKKVVFSTISLGKCSVLDNITTDKILIDVFDGLPLYDDVKVQFFYSNLPTYYDNCSFYFWLHTSFIENNRLYLPKNELDNLHKQKARRIYPSDFAVEILFGEKMTSSDVVAGSD

SEQ ID NO: 90879 - protein, 445 aa, Homo sapiens
  Payload ID: 18168
  Gene Name: transmembrane phosphoinositide 3-phosphatase and tensin homolog 2
  Uniprot ID: Q6XPS3
  ENSP ID: ENSP00000255310
MNESPQTNEFKGTTEEAPAKESPHTSEFKGAALVSPISKRIFGVFLVLLDVTLLLADLIFTDSKLYIPLEYRSISLAIGLFFLMDVLLRVFVEGWTHLVRLLRLIILIRIFHLLHQKRQLEKLMRRLVSENKRRYTRDGFDLDLTYVTERIIAMSFPSSGRQSFYRNPIEEVVRFLDKKHRNHYRVYNLCSERAYDPKHFHNRVSRIMIDDHNVPTLHEMVVFTKEVNEWMAQDLENIVAIHCKGGKGRTGTMVCALLIASEIFLTAEESLYYFGERRTNKTHSNKFQGVETPSQNRYVGYFAQVKHLYNWNLPPRRILFIKRFIIYSIRGDVCDLKVQVVMEKKVVFSSTSLGNCSILHDIETDKILINVYDGPPLYDDVKVQFFSSNLPKYYDNCPFFFWFNTSFIQNNRLCLPRNELDNPHKQKAWKIYPPEFAVEILFGEK

SEQ ID NO: 90880 - protein, 482 aa, Homo sapiens
  Payload ID: 18168
  Gene Name: transmembrane phosphoinositide 3-phosphatase and tensin homolog 2
  Uniprot ID: Q6XPS3
  ENSP ID: ENSP00000372438
MNESPQTNEFKGTTEEAPAKESPHTSEFKGAALVSPISKSMLERLSKFEVEDAENVASYDSKIKKIVHSIVSSFAFGIFGVFLVLLDVTLLLADLIFTDSKLYIPLEYRSISLAIGLFFLMDVLLRVFVEGWTHLVRLLRLIILIRIFHLLHQKRQLEKLMRRLVSENKRRYTRDGFDLDLTYVTERIIAMSFPSSGRQSFYRNPIEEVVRFLDKKHRNHYRVYNLCSERAYDPKHFHNRVSRIMIDDHNVPTLHEMVVFTKEVNEWMAQDLENIVAIHCKGGKGRTGTMVCALLIASEIFLTAEESLYYFGERRTNKTHSNKFQGVETPSQNRYVGYFAQVKHLYNWNLPPRRILFIKRFIIYSIRGDVCDLKVQVVMEKKVVFSSTSLGNCSILHDIETDKILINVYDGPPLYDDVKVQFFSSNLPKYYDNCPFFFWFNTSFIQNNRLCLPRNELDNPHKQKAWKIYPPEFAVEILFGEK

SEQ ID NO: 90881 - protein, 445 aa, Homo sapiens; identical to SEQ ID NO: 90879
  Payload ID: 18168
  Gene Name: transmembrane phosphoinositide 3-phosphatase and tensin homolog 2
  Uniprot ID: Q6XPS3
  ENSP ID: ENSP00000375098

SEQ ID NO: 90882 - protein, 411 aa, Homo sapiens
  Payload ID: 18168
  Gene Name: transmembrane phosphoinositide 3-phosphatase and tensin homolog 2
  Uniprot ID: Q6XPS3
  ENSP ID: ENSP00000382974
MNESPQTNEFKGTTEEAPAKESPHTSEFKGAALVSPISKSMLERLSKFEVEDAENVASYEWTHLVRLLRLIILIRIFHLLHQKRQLEKLMRRLVSENKRRYTRDGFDLDLTYVTERIIAMSFPSSGRQSFYRNPIEEVVRFLDKKHRNHYRVYNLCSERAYDPKHFHNRVSRIMIDDHNVPTLHEMVVFTKEVNEWMAQDLENIVAIHCKGGKGRTGTMVCALLIASEIFLTAEESLYYFGERRTNKTHSNKFQGVETPSQNRYVGYFAQVKHLYNWNLPPRRILFIKRFIIYSIRGDVCDLKVQVVMEKKVVFSSTSLGNCSILHDIETDKILINVYDGPPLYDDVKVQFFSSNLPKYYDNCPFFFWFNTSFIQNNRLCLPRNELDNPHKQKAWKIYPPEFAVEILFGEK

SEQ ID NO: 90883 - protein, 522 aa, Homo sapiens [sequence omitted]

SEQ ID NO: 90884 - protein, 337 aa, Homo sapiens
  Payload ID: 18168
  Gene Name: transmembrane phosphoinositide 3-phosphatase and tensin homolog 2
  ENSP ID: ENSP00000432402
MNESPQTNEFKGTTEEAPAKESPHTSEFKGAALVSPISKRWTHLVRLLRLIILIRIFHLLHQKRQLEKLMRRLVSENKRRYTRDGFDLDLTYVTERIIAMSFPSSGRQSFYRNPIEEVVRFLDKKHRNHYRVYNLCSERAYDPKHFHNRVSRIMIDDHNVPTLHEMVVFTKEVNEWMAQDLENIVAIHCKGGKGRTGTMVCALLIASEIFLTAEESLYYFGERRTNKTHSNKFQGVETPSQNRYVGYFAQVKHLYNWNLPPRRILFIKRFIIYSIRGDVCDLKVQVVMEKKVVFSSTSLGNCSREEGSTQGQLEGGAIQETCARLMGGSNSEREGGT

SEQ ID NO: 90885 - protein, 421 aa, Homo sapiens
  Payload ID: 18169
  Gene Name: transmembrane protease, serine 11A
  ENSP ID: ENSP00000334611
MMYRTVGFGTRSRNLKPWMIAVLIVLSLTVVAVTIGLLVHFLVFDQKKEYYHGSFKILDPQINNNFGQSNTYQLKDLRETTENLVSQVDEIFIDSAWKKNYIKNQVVRLTPEEDGVKVDVIMVFQFPSTEQRAVREKKIQSILNQKIRNLRALPINASSVQVNAMSSSTGELTVQASCGKRVVPLNVNRIASGVIAPKAAWPWQASLQYDNIHQCGATLISNTWLVTAAHCFQKYKNPHQWTVSFGTKINPPLMKRNVRRFIIHEKYRSAAREYDIAVVQVSSRVTFSDDIRQICLPEASASFQPNLTVHITGFGALYYGGESQNDLREARVKIISDDVCKQPQVYGNDIKPGMFCAGYMEGIYDACRGDSGGPLVTRDLKDTWYLIGIVSWGDNCGQKDKPGVYTQVTYYRNWIASKTGI

SEQ ID NO: 90886 - protein, 390 aa, Homo sapiens
  Payload ID: 18169
  Gene Name: transmembrane protease, serine 11A
  ENSP ID: ENSP00000379491
MMYRTVGFGTRSRNLKPWMIAVLIVLSLTVVAVTIGLLVHFLVFDQKKEYYHGSFKILDPQINNNFGQSNTYQLKDLRETTENLVDEIFIDSAWKKNYIKNQVVRLTPEEDGVKVDVIMVFQFPSTEQRAVREKKIQSILNQKIRNLRALPINASSVQVNAMSSSTGELTVQASCGKRVVPLNVNRIASGVIAPKAAWPWQASLQYDNIHQCGATLISNTWLVTAAHCFQKYKNPHQWTVSFGTKINPPLMKRNVRRFIIHEKYRSAAREYDIAVVQVSSRVTFSDDIRQICLPEASASFQPNLTVHITGFGALYYGGESQNDLREARVKIISDDVCKQPQVYGNDIKPGMFCAGYMEGIYDACRGDSGTFSHKGSERYVVSHWNCKLGR

SEQ ID NO: 90887 - protein, 418 aa, Homo sapiens
  Payload ID: 18169
  Gene Name: transmembrane protease, serine 11A
  Uniprot ID: Q6ZMR5
  ENSP ID: ENSP00000426911
MMYRTVGFGTRSRNLKPWMIAVLIVLSLTVVAVTIGLLVHFLVFDQKKEYYHGSFKILDPQINNNFGQSNTYQLKDLRETTENLVDEIFIDSAWKKNYIKNQVVRLTPEEDGVKVDVIMVFQFPSTEQRAVREKKIQSILNQKIRNLRALPINASSVQVNAMSSSTGELTVQASCGKRVVPLNVNRIASGVIAPKAAWPWQASLQYDNIHQCGATLISNTWLVTAAHCFQKYKNPHQWTVSFGTKINPPLMKRNVRRFIIHEKYRSAAREYDIAVVQVSSRVTFSDDIRQICLPEASASFQPNLTVHITGFGALYYGGESQNDLREARVKIISDDVCKQPQVYGNDIKPGMFCAGYMEGIYDACRGDSGGPLVTRDLKDTWYLIGIVSWGDNCGQKDKPGVYTQVTYYRNWIASKTGI

SEQ ID NO: 90888 - protein, 385 aa, Homo sapiens
  Payload ID: 18169
  Gene Name: transmembrane protease, serine 11A
  ENSP ID: ENSP00000427621
GFGTRSRNLKPWMIAVLIVLSLTVVAVTIGLLVHFLVFDPQINNNFGQSNTYQLKDLRETTENLVDEIFIDSAWKKNYIKNQVVRLTPEEDGVKVDVIMVFQFPSTEQRAVREKKIQSILNQKIRNLRALPINASSVQVNGCGKRVVPLNVNRIASGVIAPKAAWPWQASLQYDNIHQCGATLISNTWLVTAAHCFQKYKNPHQWTVSFGTKINPPLMKRNVRRFIIHEKYRSAAREYDIAVVQVSSRVTFSDDIRQICLPEASASFQPNLTVHITGFGALYYGGESQNDLREARVKIISDDVCKQPQVYGNDIKPGMFCAGYMEGIYDACRGDSGGPLVTRDLKDTWYLIGIVSWGDNCGQKDKPGVYTQVTYYRNWIASKTGI

SEQ ID NO: 90889 - protein, 416 aa, Homo sapiens
  Payload ID: 18170
  Gene Name: transmembrane protease, serine 11B
  Uniprot ID: Q86T26
  ENSP ID: ENSP00000330475
MYRHGISSQRSWPLWTTIFIFLGVAAILGVTIGLLVHFLAVEKTYYYQGDFHISGVTYNDNCENAASQASTNLSKDIETKMLNAFQNSSIYKEYVKSEVIKLLPNANGSNVQLQLKFKFPPAEGVSMRTKIKAKLHQMLKNNMASWNAVPASIKLMEISKAASEMLTNNCCGRQVANSIITGNKIVNGKSSLEGAWPWQASMQWKGRHYCGASLISSRWLLSAAHCFAKKNNSKDWTVNFGIVVNKPYMTRKVQNIIFHENYSSPGLHDDIALVQLAEEVSFTEYIRKICLPEAKMKLSENDNVVVTGWGTLYMNGSFPVILQEDFLKIIDNKICNASYAYSGFVTDTMLCAGFMSGEADACQNDSGGPLAYPDSRNIWHLVGIVSWGDGCGKKNKPGVYTRVTSYRNWITSKTGL

SEQ ID NO: 90890 - protein, 418 aa, Homo sapiens
  Payload ID: 18171
  Gene Name: transmembrane protease, serine 11D
  Uniprot ID: O60235
  ENSP ID: ENSP00000283916
MYRPARVTSTSRFLNPYVVCFIVVAGVVILAVTIALLVYFLAFDQKSYFYRSSFQLLNVEYNSQLNSPATQEYRTLSGRIESLITKTFKESNLRNQFIRAHVAKLRQDGSGVRADVVMKFQFTRNNNGASMKSRIESVLRQMLNNSGNLEINPSTEITSLTDQAAANWLINECGAGPDLITLSEQRILGGTEAEEGSWPWQVSLRLNNAHHCGGSLINNMWILTAAHCFRSNSNPRDWIATSGISTTFPKLRMRVRNILIHNNYKSATHENDIALVRLENSVTFTKDIHSVCLPAATQNIPPGSTAYVTGWGAQEYAGHTVPELRQGQVRIISNDVCNAPHSYNGAILSGMLCAGVPQGGVDACQGDSGGPLVQEDSRRLWFIVGIVSWGDQCGLPDKPGVYTRVTAYLDWIRQQTGI

SEQ ID NO: 90891 - protein, 65 aa, Homo sapiens
  Payload ID: 18171
  Gene Name: transmembrane protease, serine 11D
  ENSP ID: ENSP00000421381
  MOD_RES (1)..(1): Any amino acid
XMKSRIESVLRQMLNNSGNLEINPSTEITSLTDQAAANWLINGHTVPELRQGQVRIISNDVCNAP

SEQ ID NO: 90892 - protein, 423 aa, Homo sapiens
  Payload ID: 18172
  Gene Name: transmembrane protease, serine 11E
  Uniprot ID: Q9UL52
  ENSP ID: ENSP00000307519
MMYRPDVVRARKRVCWEPWVIGLVIFISLIVLAVCIGLTVHYVRYNQKKTYNYYSTLSFTTDKLYAEFGREASNNFTEMSQRLESMVKNAFYKSPLREEFVKSQVIKFSQQKHGVLAHMLLICRFHSTEDPETVDKIVQLVLHEKLQDAVGPPKVDPHSVKIKKINKTETDSYLNHCCGTRRSKTLGQSLRIVGGTEVEEGEWPWQASLQWDGSHRCGATLINATWLVSAAHCFTTYKNPARWTASFGVTIKPSKMKRGLRRIIVHEKYKHPSHDYDISLAELSSPVPYTNAVHRVCLPDASYEFQPGDVMFVTGFGALKNDGYSQNHLRQAQVTLIDATTCNEPQAYNDAITPRMLCAGSLEGKTDACQGDSGGPLVSSDARDIWYLAGIVSWGDECAKPNKPGVYTRVTALRDWITSKTGI

SEQ ID NO: 90893 - protein, 125 aa, Homo sapiens
  Payload ID: 18172
  Gene Name: transmembrane protease, serine 11E
  ENSP ID: ENSP00000424109
  MOD_RES (1)..(1): Any amino acid
XPDVVRARKRVCWEPWVIGLVIFISLIVLAVCIGLTVHYVRYNQKKTYNYYSTLSFTTDKLYAEFGREASNNFTEMSQRLESMVKNAFYKSPLREEFVKSQVIKFRNQQDRNRQLSKPLLRNTKK

SEQ ID NO: 90894 - protein, 423 aa, Homo sapiens
  Payload ID: 18172
  Gene Name: transmembrane protease, serine 11E
  ENSP ID: ENSP00000481425
MMYRPDVVRARKRVCWEPWVIGLVIFISLIVLAVCIGLTVHYVRYNQKKTYNYYSTLSFTTDKLYAEFGREASNNFTEMSQRLESMVKNAFYKSPLREEFVKSQVIKFSQQKHGVLAHMLLICRFHSTEDPETVDKIVQLVLHEKLQDAVGPPKVDPQSVKIKKINKTETDSYLNHCCGTRRSKTLGQSLRIVGGTEVEEGEWPWQASLQWDGSHRCGATLINATWLVSAAHCFTTYKNPARWTASFGVTIKPSKMKRGLRRIIVHEKYKHPSHDYDISLAELSSPVPYTNAVHRVCLPDASYEFQPGDVMFVTGFGALKNDGYSQNHLRQAQVTLIDATTCNEPQAYNDAITPRMLCAGSLEGKTDACQGDSGGPLVSSDARDIWYLAGIVSWGDECAKPNKPGVYTRVTALRDWITSKTGI

SEQ ID NO: 90895 - protein, 125 aa, Homo sapiens; identical to SEQ ID NO: 90893
  Payload ID: 18172
  Gene Name: transmembrane protease, serine 11E
  ENSP ID: ENSP00000486191
  MOD_RES (1)..(1): Any amino acid

SEQ ID NO: 90896 - protein, 438 aa, Homo sapiens
  Payload ID: 18173
  Gene Name: transmembrane protease, serine 11F
  Uniprot ID: Q6ZWK6
  ENSP ID: ENSP00000348639
MMYAPVEFSEAEFSRAEYQRKQQFWDSVRLALFTLAIVAIIGIAIGIVTHFVVEDDKSFYYLASFKVTNIKYKENYGIRSSREFIERSHQIERMMSRIFRHSSVGGRFIKSHVIKLSPDEQGVDILIVLIFRYPSTDSAEQIKKKIEKALYQSLKTKQLSLTINKPSFRLTPIDSKKMRNLLNSRCGIRMTSSNMPLPASSSTQRIVQGRETAMEGEWPWQASLQLIGSGHQCGASLISNTWLLTAAHCFWKNKDPTQWIATFGATITPPAVKRNVRKIILHENYHRETNENDIALVQLSTGVEFSNIVQRVCLPDSSIKLPPKTSVFVTGFGSIVDDGPIQNTLRQARVETISTDVCNRKDVYDGLITPGMLCAGFMEGKIDACKGDSGGPLVYDNHDIWYIVGIVSWGQSCALPKKPGVYTRVTKYRDWIASKTGM

SEQ ID NO: 90897 - protein, 563 aa, Homo sapiens
  Payload ID: 18174
  Gene Name: transmembrane protease, serine 13
  Uniprot ID: Q9BYE2
  ENSP ID: ENSP00000387702
MERDSHGNASPARTPSAGASPAQASPAGTPPGRASPAQASPAQASPAGTPPGRASPAQASPAGTPPGRASPGRASPAQASPAQASPARASPALASLSRSSSGRSSSARSASVTTSPTRVYLVRATPVGAVPIRSSPARSAPATRATRESPGTSLPKFTWREGQKQLPLIGCVLLLIALVVSLIILFQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSAHIHPACLPMHGQTFSLNETCWITGFGKTRETDDKTSPFLREVQVNLIDFKKCNDYLVYDSYLTPRMMCAGDLRGGRDSCQGDSGGPLVCEQNNRWYLAGVTSWGTGCGQRNKPGVYTKVTEVLPWIYSKMESSAG

SEQ ID NO: 90898 - protein, 586 aa, Homo sapiens
  Payload ID: 18174
  Gene Name: transmembrane protease, serine 13
  ENSP ID: ENSP00000394114
MERDSHGNASPARTPSAGASPAQASPAGTPPGRASPAQASPAQASPAGTPPGRASPAQASPAGTPPGRASPGRASPAQASPAQASPARASPALASLSRSSSGRSSSARSASVTTSPTRVYLVRATPVGAVPIRSSPARSAPATRATRESPGTSLPKFTWREGQKQLPLIGCVLLLIALVVSLIILFQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSAHIHPACLPMHGQTFSLNETCWITGFGKTRETDDKTSPFLREVQVNLIDFKKCNDYLVYDSYLTPRMMCAGDLRGGRDSCQGDSGGPLVCEQNNRWYLAGVTSWGTGCGQRNKPGVYTKVTEVLPWIYSKMEVRSLQQDTAPSRLGTSSGGDPGGAPRL

SEQ ID NO: 90899 - protein, 567 aa, Homo sapiens
  Payload ID: 18174
  Gene Name: transmembrane protease, serine 13
  ENSP ID: ENSP00000434279
MERDSHGNASPARTPSAGASPAQASPAGTPPGRASPAQASPAQASPAGTPPGRASPAQASPAGTPPGRASPGRASPAQASPAQASPARASPALASLSRSSSGRSSSARSASVTTSPTRVYLVRATPVGAVPIRSSPARSAPATRATRESPGTSLPKFTWREGQKQLPLIGCVLLLIALVVSLIILFQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSAHIHPACLPMHGQTFSLNETCWITGFGKTRETDDKTSPFLREVQVNLIDFKKCNDYLVYDSYLTPRMMCAGDLRGGRDSCQGDSGGPLVCEQNNRWYLAGVTSWGTGCGQRNKPGVYTKVTEVLPWIYSKMESEVRFRKS

SEQ ID NO: 90900 - protein, 532 aa, Homo sapiens
  Payload ID: 18174
  Gene Name: transmembrane protease, serine 13
  Uniprot ID: Q9BYE2
  ENSP ID: ENSP00000435813
MERDSHGNASPARTPSAGASPAQASPAGTPPGRASPAQASPAQASPAGTPPGRASPAQASPAGTPPGRASPGRASPAQASPAQASPARASPALASLSRSSSGRSSSARSASVTTSPTRVYLVRATPVGAVPIRSSPARSAPATRATRESPVQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSAHIHPACLPMHGQTFSLNETCWITGFGKTRETDDKTSPFLREVQVNLIDFKKCNDYLVYDSYLTPRMMCAGDLRGGRDSCQGDSGGPLVCEQNNRWYLAGVTSWGTGCGQRNKPGVYTKVTEVLPWIYSKMESEVRFRKS

SEQ ID NO: 90901 - protein, 40 aa, Homo sapiens
  Payload ID: 18174
  Gene Name: transmembrane protease, serine 13
  ENSP ID: ENSP00000436025
MERDSHGSSSGRATQGSGTRSRGRAVPSTLFAVTGWWTAS

SEQ ID NO: 90902 - protein, 491 aa, Homo sapiens
  Payload ID: 18174
  Gene Name: transmembrane protease, serine 13
  Uniprot ID: Q9BYE2
  ENSP ID: ENSP00000436502
MERDSHGNASPARTPSAGASPAQASPAGTPPGRASPAQASPAQASPAGTPPGRASPAQASPAGTPPGRASPGRASPAQASPAQASPARASPALASLSRSSSGRSSSARSASVTTSPTRVYLVRATPVGAVPIRSSPARSAPATRATRESPGTSLPKFTWREGQKQLPLIGCVLLLIALVVSLIILFQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSGEGICTPRSPAPQPQHPLQPSHLSASVNSYPGPKASAGQKSKTLKDPYMEHFCFIIRETEAQGL

SEQ ID NO: 90903 - protein, 562 aa, Homo sapiens
  Payload ID: 18174
  Gene Name: transmembrane protease, serine 13
  ENSP ID: ENSP00000480143
MERDSHGNASPARTPSAGASPAQASPAGTPPGRASPAQASPAQASPAGTPPGRASPAQASPAGTPPGRASPGRASPLQASPARASPALASLSRSSSGRSSSARSASVTTSPTRVYLVRATPVGAVPIRSSPARSAPATRATRESPGTSLPKFTWREGQKQLPLIGCVLLLIALVVSLIILFQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSAHIHPACLPMHGQTFSLNETCWITGFGKTRETDDKTSPFLREVQVNLIDFKKCNDYLVYDSYLTPRMMCAGDLRGGRDSCQGDSGGPLVCEQNNRWYLAGVTSWGTGCGQRNKPGVYTKVTEVLPWIYSKMESEVRFRKS

SEQ ID NO: 90904 - protein, 1019 aa, Homo sapiens
  Payload ID: 18175
  Gene Name: transmembrane protease, serine 15
  Uniprot ID: P98073
  ENSP ID: ENSP00000284885
MGSKRGISSRHHSLSSYEIMFAALFAILVVLCAGLIAVSCLTIKESQRGAALGQSHEARATFKITSGVTYNPNLQDKLSVDFKVLAFDLQQMIDEIFLSSNLKNEYKNSRVLQFENGSIIVVFDLFFAQWVSDENVKEELIQGLEANKSSQLVTFHIDLNSVDILDKLTTTSHLATPGNVSIECLPGSSPCTDALTCIKADLFCDGEVNCPDGSDEDNKMCATVCDGRFLLTGSSGSFQATHYPKPSETSVVCQWIIRVNQGLSIKLSFDDFNTYYTDILDIYEGVGSSKILRASIWETNPGTIRIFSNQVTATFLIESDESDYVGFNATYTAFNSSELNNYEKINCNFEDGFCFWVQDLNDDNEWERIQGSTFSPFTGPNFDHTFGNASGFYISTPTGPGGRQERVGLLSLPLDPTLEPACLSFWYHMYGENVHKLSINISNDQNMEKTVFQKEGNYGDNWNYGQVTLNETVKFKVAFNAFKNKILSDIALDDISLTYGICNGSLYPEPTLVPTPPPELPTDCGGPFELWEPNTTFSSTNFPNSYPNLAFCVWILNAQKGKNIQLHFQEFDLENINDVVEIRDGEEADSLLLAVYTGPGPVKDVFSTTNRMTVLLITNDVLARGGFKANFTTGYHLGIPEPCKADHFQCKNGECVPLVNLCDGHLHCEDGSDEADCVRFFNGTTNNNGLVRFRIQSIWHTACAENWTTQISNDVCQLLGLGSGNSSKPIFPTDGGPFVKLNTAPDGHLILTPSQQCLQDSLIRLQCNHKSCGKKLAAQDITPKIVGGSNAKEGAWPWVVGLYYGGRLLCGASLVSSDWLVSAAHCVYGRNLEPSKWTAILGLHMKSNLTSPQTVPRLIDEIVINPHYNRRRKDNDIAMMHLEFKVNYTDYIQPICLPEENQVFPPGRNCSIAGWGTVVYQGTTANILQEADVPLLSNERCQQQMPEYNITENMICAGYEEGGIDSCQGDSGGPLMCQENNRWFLAGVTSFGYKCALPNRPGVYARVSRFTEWIQSFLH

SEQ ID NO: 90905 - protein, 227 aa, Homo sapiens
  Payload ID: 18175
  Gene Name: transmembrane protease, serine 15
  ENSP ID: ENSP00000398253
MWNCAALGQSHEARATFKITSGVTYNPNLQDKLSVDFKVLAFDLQQMIDEIFLSSNLKNEYKNSRVLQFENGSIIVVFDLFFAQWVSDENVKEELIQGLEANKSSQLVTFHIDLNSVDILASLENFSTVSPATTSDKLTTTSHLATPGNVSIECLPGSSPCTDALTCIKADLFCDGEVNCPDGSDEDNKMCATVCDGRFLLTGSSGSFQATHYPKPSETSVVCQWII

SEQ ID NO: 90906 - protein, 5 aa, Homo sapiens
  Payload ID: 18175
  Gene Name: transmembrane protease, serine 15
  ENSP ID: ENSP00000474811
MCATV

SEQ ID NO: 90907 - protein, 492 aa, Homo sapiens
  Payload ID: 18176
  Gene Name: transmembrane protease, serine 2
  Uniprot ID: O15393
  ENSP ID: ENSP00000330330
MALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQVYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMRADG

SEQ ID NO: 90908 - protein, 529 aa, Homo sapiens
  Payload ID: 18176
  Gene Name: transmembrane protease, serine 2
  Uniprot ID: O15393
  ENSP ID: ENSP00000381588
MPPAPPGGESGCEERGAAGHIEHSRYLSLLDAVDNSKMALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQVYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMRADG

SEQ ID NO: 90909 - protein, 489 aa, Homo sapiens
  Payload ID: 18176
  Gene Name: transmembrane protease, serine 2
  ENSP ID: ENSP00000389006
MALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQVYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMR

SEQ ID NO: 90910 - protein, 492 aa, Homo sapiens; identical to SEQ ID NO: 90907
  Payload ID: 18176
  Gene Name: transmembrane protease, serine 2
  Uniprot ID: O15393
  ENSP ID: ENSP00000391216

SEQ ID NO: 90911 - protein, 79 aa, Homo sapiens
  Payload ID: 18176
  Gene Name: transmembrane protease, serine 2
  ENSP ID: ENSP00000391784
MALNSGSPPAIGPYYENHGYQPENPYPAQPTVVPTVYEVHPAQYYPSPVPQYAPRVLTQASNPVVCTQPKSPSGTVCTS

SEQ ID NO: 90912 - protein, 219 aa, Homo sapiens
  Payload ID: 18176
  Gene Name: transmembrane protease, serine 2
  ENSP ID: ENSP00000397846
MALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFIRLYGPNFILQVYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGG

SEQ ID NO: 90913 - protein, 454 aa, Homo sapiens
  Payload ID: 18177
  Gene Name: transmembrane protease, serine 3
  Uniprot ID: P57727
  ENSP ID: ENSP00000291532
MGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGAGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 90914 - protein, 344 aa, Homo sapiens
  Payload ID: 18177
  Gene Name: transmembrane protease, serine 3
  Uniprot ID: P57727
  ENSP ID: ENSP00000381434
MGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNGTSGSLCGSAALPLFQEDLQLLIEAFL

SEQ ID NO: 90915 - protein, 451 aa, Homo sapiens
  Payload ID: 18177
  Gene Name: transmembrane protease, serine 3
  ENSP ID: ENSP00000381442
MGENDPPAVEAPFSFRSLFGLDDLKISPVAPDAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 90916 - protein, 453 aa, Homo sapiens
  Payload ID: 18177
  Gene Name: transmembrane protease, serine 3
  Uniprot ID: P57727
  ENSP ID: ENSP00000411013
MGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 90917 - protein, 437 aa, Homo sapiens
  Payload ID: 18178
  Gene Name: transmembrane protease, serine 4
  Uniprot ID: Q9NRS4
  ENSP ID: ENSP00000416037
MLQDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGVEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 90918 - protein, 62 aa, Homo sapiens
  Payload ID: 18178
  Gene Name: transmembrane protease, serine 4
  ENSP ID: ENSP00000428246
  MOD_RES (1)..(1): Any amino acid
XKVRAGSDKLGSFPSLAVAKIIIIEFNPMYPKDNDIALMKLQFPLTFSAYLNWIYNVWKAEL

SEQ ID NO: 90919 - protein, 173 aa, Homo sapiens
  Payload ID: 18178
  Gene Name: transmembrane protease, serine 4
  ENSP ID: ENSP00000428407
MDPDSDQPLNSLDVKPLRKPRIPMETFRKVGIPIIIALLSLASIIIVVVLIRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGVEEASVDSWPWQVSIQYDK

SEQ ID NO: 90920 - protein, 290 aa, Homo sapiens
  Payload ID: 18178
  Gene Name: transmembrane protease, serine 4
  ENSP ID: ENSP00000428814
MGYSRAVEIGPDQDLDVVEITENSQELRMRNSSGPCLSGSLVSLHCLACGKSLKTPRVVGVEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 90921 - protein, 397 aa, Homo sapiens
  Payload ID: 18178
  Gene Name: transmembrane protease, serine 4
  Uniprot ID: Q9NRS4
  ENSP ID: ENSP00000429209
MDPDSDQPLNSLVKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGVEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 90922 - protein, 148 aa, Homo sapiens
  Payload ID: 18178
  Gene Name: transmembrane protease, serine 4
  ENSP ID: ENSP00000429833
  MOD_RES (1)..(1): Any amino acid
XPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSG

SEQ ID NO: 90923 - protein, 335 aa, Homo sapiens
  Payload ID: 18178
  Gene Name: transmembrane protease, serine 4
  ENSP ID: ENSP00000429889
MDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGVEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGG

SEQ ID NO: 90924 - protein, 432 aa, Homo sapiens
  Payload ID: 18178
  Gene Name: transmembrane protease, serine 4
  Uniprot ID: Q9NRS4
  ENSP ID: ENSP00000430547
MLQDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSRAVEIGPDQDLDVVEITENSQELRMRNSSGPCLSGSLVSLHCLACGKSLKTPRVVGVEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 90925 - protein, 59 aa, Homo sapiens
  Payload ID: 18178
  Gene Name: transmembrane protease, serine 4
  ENSP ID: ENSP00000431062
MDPDSDQPLNSLGKFRCQTPAQTPYPHGDLQKGGDPHHHSTTEPGEYHHCGCPHQGDSG

SEQ ID NO: 90926 - protein, 435 aa, Homo sapiens
  Payload ID: 18178
  Gene Name: transmembrane protease, serine 4
  Uniprot ID: Q9NRS4
  ENSP ID: ENSP00000435184
MDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGVEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 90927 - protein, 437 aa, Homo sapiens; identical to SEQ ID NO: 90917
  Payload ID: 18178
  Gene Name: transmembrane protease, serine 4
  Uniprot ID: Q9NRS4
  ENSP ID: ENSP00000477949

SEQ ID NO: 90928 - protein, 399 aa, Homo sapiens
  Payload ID: 18178
  Gene Name: transmembrane protease, serine 4
  ENSP ID: ENSP00000478147
MLQDPDSDQPLNSLVKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGVEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 90929 - protein, 422 aa, Homo sapiens
  Payload ID: 18178
  Gene Name: transmembrane protease, serine 4
  ENSP ID: ENSP00000480370
MSNPCANPVSPWRPSERWIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGVEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 90930 - protein, 457 aa, Homo sapiens
  Payload ID: 18179
  Gene Name: transmembrane protease, serine 5
  Uniprot ID: Q9H3S3
  ENSP ID: ENSP00000299882
MSLMLDDQPPMEAQYAEEGPGPGIFRAEPGDQQHPISQAVCWRSMRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPRNNCTSGQVVSLRCSECGARPLASRIVGGQSVAPGRWPWQASVALGFRHTCGGSVLAPRWVVTAAHCMHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 90931 - protein, 198 aa, Homo sapiens
  Payload ID: 18179
  Gene Name: transmembrane protease, serine 5
  ENSP ID: ENSP00000437761
MHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 90932 - protein, 147 aa, Homo sapiens
  Payload ID: 18179
  Gene Name: transmembrane protease, serine 5
  ENSP ID: ENSP00000437937
MHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQDSLL

SEQ ID NO: 90933 - protein, 388 aa, Homo sapiens
  Payload ID: 18179
  Gene Name: transmembrane protease, serine 5
  ENSP ID: ENSP00000440783
MSLMLDDQPPMEAQYAEEGPGPGIFRAEPGDQQHPISQAVCWRSMRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 90934 - protein, 44 aa, Homo sapiens
  Payload ID: 18179
  Gene Name: transmembrane protease, serine 5
  ENSP ID: ENSP00000440976
MSLMLDDQPPMEAQYAEEGPGPGIFRAEPGDQQHPSRPDWAIGE

SEQ ID NO: 90935 - protein, 448 aa, Homo sapiens
  Payload ID: 18179
  Gene Name: transmembrane protease, serine 5
  ENSP ID: ENSP00000441104
MTGWGQWRAIILHSPDPPWGQPHMIDVSQAVCWRSMRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPRNNCTSGQVVSLRCSECGARPLASRIVGGQSVAPGRWPWQASVALGFRHTCGGSVLAPRWVVTAAHCMHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 90936 - protein, 17 aa, Homo sapiens
  Payload ID: 18179
  Gene Name: transmembrane protease, serine 5
  ENSP ID: ENSP00000443681
MHSFRLARLSSWRVHAG

SEQ ID NO: 90937 - protein, 10 aa, Homo sapiens
  Payload ID: 18179
  Gene Name: transmembrane protease, serine 5
  ENSP ID: ENSP00000445502
MHSFRLARLS

SEQ ID NO: 90938 - protein, 413 aa, Homo sapiens
  Payload ID: 18179
  Gene Name: transmembrane protease, serine 5
  ENSP ID: ENSP00000445528
MRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPRNNCTSGQVVSLRCSECGARPLASRIVGGQSVAPGRWPWQASVALGFRHTCGGSVLAPRWVVTAAHCMHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 90939 - protein, 344 aa, Homo sapiens
  Payload ID: 18179
  Gene Name: transmembrane protease, serine 5
  ENSP ID: ENSP00000445930
MRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 90940 - protein, 811 aa, Homo sapiens
  Payload ID: 18180
  Gene Name: transmembrane protease, serine 6
  Uniprot ID: Q8IU80
  ENSP ID: ENSP00000334962
MLLLFHSKRMPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCISLPKVCDGQPDCLNGSDEEQCQEGVPCGTFTFQCEDRSCVKKPNPQCDGRPDCRDGSDEEHCDCGLQGPSSRIVGGAVSSEGEWPWQASLQVRGRHICGGALIADRWVITAAHCFQEDSMASTVLWTVFLGKVWQNSRWPGEVSFKVSRLLLHPYHEEDSHDYDVALLQLDHPVVRSAAVRPVCLPARSHFFEPGLHCWITGWGALREGGPISNALQKVDVQLIPQDLCSEVYRYQVTPRMLCAGYRKGKKDACQGDSGGPLVCKALSGRWFLAGLVSWGLGCGRPNYFGVYTRITGVISWIQQVVT

SEQ ID NO: 90941 - protein, 824 aa, Homo sapiens
  Payload ID: 18180
  Gene Name: transmembrane protease, serine 6
  Uniprot ID: Q8IU80
  ENSP ID: ENSP00000371211
MPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCISLPKVCDGQPDCLNGSDEEQCQEGVPCGTFTFQCEDRSCVKKPNPQCDGRPDCRDGSDEEHCDCGLQGPSSRIVGGAVSSEGEWPWQASLQVRGRHICGGALIADRWVITAAHCFQEDSMASTVLWTVFLGKVWQNSRWPGEVSFKVSRLLLHPYHEEDSHDYDVALLQLDHPVVRSAAVRPVCLPARSHFFEPGLHCWITGWGALREGALRADAVALFYGWRNQGSETCCCPISNALQKVDVQLIPQDLCSEVYRYQVTPRMLCAGYRKGKKDACQGDSGGPLVCKALSGRWFLAGLVSWGLGCGRPNYFGVYTRITGVISWIQQVVT

SEQ ID NO: 90942 - protein, 824 aa, Homo sapiens; identical to SEQ ID NO: 90941
  Payload ID: 18180
  Gene Name: transmembrane protease, serine 6
  Uniprot ID: Q8IU80
  ENSP ID: ENSP00000384964

SEQ ID NO: 90943 - protein, 802 aa, Homo sapiens
  Payload ID: 18180
  Gene Name: transmembrane protease, serine 6
  Uniprot ID: Q8IU80
  ENSP ID: ENSP00000385453
MPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCISLPKVCDGQPDCLNGSDEEQCQEGVPCGTFTFQCEDRSCVKKPNPQCDGRPDCRDGSDEEHCDCGLQGPSSRIVGGAVSSEGEWPWQASLQVRGRHICGGALIADRWVITAAHCFQEDSMASTVLWTVFLGKVWQNSRWPGEVSFKVSRLLLHPYHEEDSHDYDVALLQLDHPVVRSAAVRPVCLPARSHFFEPGLHCWITGWGALREGGPISNALQKVDVQLIPQDLCSEVYRYQVTPRMLCAGYRKGKKDACQGDSGGPLVCKALSGRWFLAGLVSWGLGCGRPNYFGVYTRITGVISWIQQVVT

SEQ ID NO: 90944 - protein, 71 aa, Homo sapiens
  Payload ID: 18180
  Gene Name: transmembrane protease, serine 6
  ENSP ID: ENSP00000392433
LTLDNRLDSQGVLSTPYFPSYYSPQTHCSWHLTVPSLDYGLALWFDAYALRRQKYDLPCTQGQWTIQNRRV

SEQ ID NO: 90945 - protein, 461 aa, Homo sapiens
  Payload ID: 18180
  Gene Name: transmembrane protease, serine 6
  ENSP ID: ENSP00000397691
MLLLFHSKRMPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRYHFLSSLWLPFLPPPPSLPSSIVTPSLEAQVPNLRGAARGASRGWGWCQACCP

SEQ ID NO: 90946 - protein, 141 aa, Homo sapiens
  Payload ID: 18180
  Gene Name: transmembrane protease, serine 6
  ENSP ID: ENSP00000400317
MPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTC

SEQ ID NO: 90947 - protein, 843 aa, Homo sapiens
  Payload ID: 18181
  Gene Name: transmembrane protease, serine 7
  Uniprot ID: Q7RTY8
  ENSP ID: ENSP00000398236
MDKENSDVSAAPADLKISNISVQVVSAQKKLPVRRPPLPGRRLPLPGRRPPQRPIGKAKPKKQSKKKVPFWNVQNKIILFTVFLFILAVIAWTLLWLYISKTESKDAFYFAGMFRITNIEFLPEYRQKESREFLSVSRTVQQVINLVYTTSAFSKFYEQSVVADVSSNNKGGLLVHFWIVFVMPRAKGHIFCEDCVAAILKDSIQTSIINRTSVGSLQGLAVDMDSVVLNAGLRSDYSSTIGSDKGCSQYFYAEHLSLHYPLEISAASGRLMCHFKLVAIVGYLIRLSIKSIQIEADNCVTDSLTIYDSLLPIRSSILYRICEPTRTLMSFVSTNNLMLVTFKSPHIRRLSGIRAYFEVIPEQKCENTVLVKDITGFEGKISSPYYPSYYPPKCKCTWKFQTSLSTLGIALKFYNYSITKKSMKGCEHGWWEINEHMYCGSYMDHQTIFRVPSPLVHIQLQCSSRLSDKPLLAEYGSYNISQPCPVGSFRCSSGLCVPQAQRCDGVNDCFDESDELFCVSPQPACNTSSFRQHGPLICDGFRDCENGRDEQNCTQSIPCNNRTFKCGNDICFRKQNAKCDGTVDCPDGSDEEGCTCSRSSSALHRIIGGTDTLEGGWPWQVSLHFVGSAYCGASVISREWLLSAAHCFHGNRLSDPTPWTAHLGMYVQGNAKFVSPVRRIVVHEYYNSQTFDYDIALLQLSIAWPETLKQLIQPICIPPTGQRVRSGEKCWVTGWGRRHEADNKGSLVLQQAEVELIDQTLCVSTYGIITSRMLCAGIMSGKRDACKGDSGGPLSCRRKSDGKWILTGIVSWGHGSGRPNFPGVYTRVSNFVPWIHKYVPSLL

SEQ ID NO: 90948 - protein, 717 aa, Homo sapiens
  Payload ID: 18181
  Gene Name: transmembrane protease, serine 7
  Uniprot ID: Q7RTY8
  ENSP ID: ENSP00000411645
MFRITNIEFLPEYRQKESREFLSVSRTVQQVINLVYTTSAFSKFYEQSVVADVSNNKGGLLVHFWIVFVMPRAKGHIFCEDCVAAILKDSIQTSIINRTSVGSLQGLAVDMDSVVLNDKGCSQYFYAEHLSLHYPLEISAASGRLMCHFKLVAIVGYLIRLSIKSIQIEADNCVTDSLTIYDSLLPIRSSILYRICEPTRTLMSFVSTNNLMLVTFKSPHIRRLSGIRAYFEVIPEQKCENTVLVKDITGFEGKISSPYYPSYYPPKCKCTWKFQTSLSTLGIALKFYNYSITKKSMKGCEHGWWEINEHMYCGSYMDHQTIFRVPSPLVHIQLQCSSRLSDKPLLAEYGSYNISQPCPVGSFRCSSGLCVPQAQRCDGVNDCFDESDELFCVSPQPACNTSSFRQHGPLICDGFRDCENGRDEQNCTQSIPCNNRTFKCGNDICFRKQNAKCDGTVDCPDGSDEEGCTCSRSSSALHRIIGGTDTLEGGWPWQVSLHFVGSAYCGASVISREWLLSAAHCFHGNRLSDPTPWTAHLGMYVQGNAKFVSPVRRIVVHEYYNSQTFDYDIALLQLSIAWPETLKQLIQPICIPPTGQRVRSGEKCWVTGWGRRHEADNKGSLVLQQAEVELIDQTLCVSTYGIITSRMLCAGIMSGKRDACKGDSGGPLSCRRKSDGKWILTGIVSWGHGSGRPNFPGVYTRVSNFVPWIHKYVPSLL

SEQ ID NO: 90949 - protein, 129 aa, Homo sapiens
  Payload ID: 18181
  Gene Name: transmembrane protease, serine 7
  ENSP ID: ENSP00000415472
MFRITNIEFLPEYRQKESREFLSVSRTVQQVINLVYTTSAFSKFYEQSVVADVSNNKGGLLVHFWIVFVMPRAKGHIFCEDCVAAILKDSIQTSIINRTSVGSLQGLAVDMDSVVLNEVLGLTLIVWID

SEQ ID NO: 90950 - protein, 182 aa, Homo sapiens
  Payload ID: 18181
  Gene Name: transmembrane protease, serine 7
  ENSP ID: ENSP00000447563
MPAIYWINLVYTTSAFSKFYEQSVVADVSSNNKGGLLVHFWIVFVMPRAKGHIFCEDCVAAILKDSIQTSIINRTSVGSLQGLAVDMDSVVLNAGLRSDYSSTIGSDKGCSQYFYAEHLSLHYPLEISAASGRLMCHFKLVAIVGYLIRLSIKSIQIEADNCVTDSLTIYDSLLPIRSSILY

SEQ ID NO: 90951 - protein, 717 aa, Homo sapiens; identical to SEQ ID NO: 90948
  Payload ID: 18181
  Gene Name: transmembrane protease, serine 7
  Uniprot ID: Q7RTY8
  ENSP ID: ENSP00000478830

SEQ ID NO: 90952 - protein, 1059 aa, Homo sapiens
  Payload ID: 18182
  Gene Name: transmembrane protease, serine 9
  Uniprot ID: Q7Z410
  ENSP ID: ENSP00000330264
MEPTVADVHLVPRTTKEVPALDAACCRAASIGVVATSLVVLTLGVLLAFLSTQGFHVDHTAELRGIRWTSSLRRETSDYHRTLTPTLEALLHFLLRPLQTLSLGLEEELLQRGIRARLREHGISLAAYGTIVSAELTGRHKGPLAERDFKSGRCPGNSFSCGNSQCVTKVNPECDDQEDCSDGSDEAHCECGLQPAWRMAGRIVGGMEASPGEFPWQASLRENKEHFCGAAIINARWLVSAAHCFNEFQDPTKWVAYVGATYLSGSEASTVRAQVVQIVKHPLYNADTADFDVAVLELTSPLPFGRHIQPVCLPAATHIFPPSKKCLISGWGYLKEDFLVKPEVLQKATVELLDQALCASLYGHSLTDRMVCAGYLDGKVDSCQGDSGGPLVCEEPSGRFFLAGIVSWGIGCAEARRPGVYARVTRLRDWILEATTKASMPLAPTMAPAPAAPSTAWPTSPESPVVSTPTKSMQALSTVPLDWVTVPKLQECGARPAMEKPTRVVGGFGAASGEVPWQVSLKEGSRHFCGATVVGDRWLLSAAHCFNHTKVEQVRAHLGTASLLGLGGSPVKIGLRRVVLHPLYNPGILDFDLAVLELASPLAFNKYIQPVCLPLAIQKFPVGRKCMISGWGNTQEGNATKPELLQKASVGIIDQKTCSVLYNFSLTDRMICAGFLEGKVDSCQGDSGGPLACEEAPGVFYLAGIVSWGIGCAQVKKPGVYTRITRLKGWILEIMSSQPLPMSPPSTTRMLATTSPRTTAGLTVPGATPSRPTPGAASRVTGQPANSTLSAVSTTARGQTPFPDAPEATTHTQLPDCGLAPAALTRIVGGSAAGRGEWPWQVSLWLRRREHRCGAVLVAERWLLSAAHCFDVYGDPKQWAAFLGTPFLSGAEGQLERVARIYKHPFYNLYTLDYDVALLELAGPVRRSRLVRPICLPEPAPRPPDGTRCVITGWGSVREGGSMARQLQKAAVRLLSEQTCRRFYPVQISSRMLCAGFPQGGVDSCSGDAGGPLACREPSGRWVLTGVTSWGYGCGRPHFPGVYTRVAAVRGWIGQHIQE

SEQ ID NO: 90953 - protein, 855 aa, Homo sapiens
  Payload ID: 18182
  Gene Name: transmembrane protease, serine 9
  ENSP ID: ENSP00000482424
MEPTVADVHLVPRTTKEVPALDAACCRAASIGVVATSLVVLTLGVLLAFLSTQGFHVDHTAELRGIRWTSSLRRETSDYHRTLTPTLEALLHFLLRPLQTLSLGLEEELLQRGIRARLREHGISLAAYGTIVSAELTGRHKGPLAERDFKSGRCPGNSFSCGNSQCVTKVNPECDDQEDCSDGSDEAHCECGLQPAWRMAGRIVGGMEASPGEFPWQASLRENKEHFCGAAIINARWLVSAAHCFNEFQDPTKWVAYVGATYLSGSEASTVRAQVVQIVKHPLYNADTADFDVAVLELTSPLPFGRHIQPVCLPAATHIFPPSKKCLISGWGYLKEDFLVKPEVLQKATVELLDQALCASLYGHSLTDRMVCAGYLDGKVDSCQGDSGGPLVCEEPSGRFFLAGIVSWGIGCAEARRPGVYARVTRLRDWILEATTKASMPLAPTMAPAPAAPSTAWPTSPESPVVSTPTKSMQALSTVPLDWVTVPKLQECGARPAMEKPTRVVGGFGAASGEVPWQVSLKEGSRHFCGATVVGDRWLLSAAHCFNHTKVEQVRAHLGTASLLGLGGSPVKIGLRRVVLHPLYNPGILDFDLAVLELASPLAFNKYIQPVCLPLAIQKFPVGRKCMISGWGNTQEGNATKPELLQKASVGIIDQKTCSVLYNFSLTDRMICAGFLEGKVDSCQGDSGGPLACEEAPGVFYLAGIVSWGIGCAQVKKPGVYTRITRLKGWILEIMSSQPLPMSPPSTTRMLATTSPRTTAGLTVPGATPSRPTPGAASRVTGQPANSTLSAVSTTARGQTPFPDAPEATTHTQLPDCGLAPGNTVAGPCWWQRGGCCRRRTASTSTGTPSSGRPS

SEQ ID NO: 90954 - protein, 134 aa, Homo sapiens
  Payload ID: 18183
  Gene Name: transmembrane protein 100
  Uniprot ID: Q9NV29
  ENSP ID: ENSP00000395328
MTEEPIKEILGAPKAHMAATMEKSPKSEVVITTVPLVSEIQLMAATGGTELSCYRCIIPFAVVVFIAGIVVTAVAYSFNSHGSIISIFGLVVLSSGLFLLASSALCWKVRQRSKKAKRRESQTALVANQRSLFA

SEQ ID NO: 90955 - protein, 129 aa, Homo sapiens
  Payload ID: 18183
  Gene Name: transmembrane protein 100
  ENSP ID: ENSP00000459290
MTEEPIKEILGAPKAHMAATMEKSPKSEVVITTVPLVSEIQLMAATGGTELSCYRCIIPFAVVVFIAGIVVTAVAYSFNSHGSIISIFGLVVLSSGLFLLASSALCWKVRQRSKKAKRRESQTALVANQ

SEQ ID NO: 90956 - protein, 134 aa, Homo sapiens; identical to SEQ ID NO: 90954
  Payload ID: 18183
  Gene Name: transmembrane protein 100
  Uniprot ID: Q9NV29
  ENSP ID: ENSP00000465638

SEQ ID NO: 90957 - protein, 257 aa, Homo sapiens
  Payload ID: 18184
  Gene Name: transmembrane protein 101
  Uniprot ID: Q96IK0
  ENSP ID: ENSP00000206380
MASKIGSRRWMLQLIMQLGSVLLTRCPFWGCFSQLMLYAERAEARRKPDIPVPYLYFDMGAAVLCASFMSFGVKRRWFALGAALQLAISTYAAYIGGYVHYGDWLKVRMYSRTVAIIGGFLVLASGAGELYRRKPRSRSLQSTGQVFLGIYLICVAYSLQHSKEDRLAYLNHLPGGELMIQLFFVLYGILALAFLSGYYVTLAAQILAVLLPPVMLLIDGNVAYWHNTRRVEFWNQMKLLGESVGIFGTAVILATDG

SEQ ID NO: 90958 - protein, 3 aa, Homo sapiens
  Payload ID: 18184
  Gene Name: transmembrane protein 101
  ENSP ID: ENSP00000465903
MGA

SEQ ID NO: 90959 - protein, 171 aa, Homo sapiens
  Payload ID: 18184
  Gene Name: transmembrane protein 101
  ENSP ID: ENSP00000466307
MASKIGSRRWMLQLIMQLGSVLLTRCPFWGCFSQLMLYAERAEARRKPDIPVPYLYFDMGAAVLCASFMSFGVKRRWFALGAALQLAISTYAAYIGGYVHYGDWLKVRMYSRTVAIIGGFLVLASGAGELYRRKPRSRSLQSTGQVFLGIYLICVVCWGTVGWRCLAGSEL

SEQ ID NO: 90960 - protein, 97 aa, Homo sapiens
  Payload ID: 18184
  Gene Name: transmembrane protein 101
  ENSP ID: ENSP00000466385
MGAAVLCASFMSFGVKRRWFALGAALQLAISTYAAYIGGYVHYGDWLKVRMYSRTVAIIGGFLVLASGAGELYRRKPRSRSLQSTGQVFLGIYLICV

SEQ ID NO: 90961 - protein, 51 aa, Homo sapiens
  Payload ID: 18184
  Gene Name: transmembrane protein 101
  ENSP ID: ENSP00000467545
MGAAVLCASFMSFGVKRRWFALGAALQLAISTYAAYIGGYVHYGDWLKVRM

SEQ ID NO: 90962 - protein, 257 aa, Homo sapiens; identical to SEQ ID NO: 90957
  Payload ID: 18184
  Gene Name: transmembrane protein 101
  Uniprot ID: Q96IK0
  ENSP ID: ENSP00000468025

SEQ ID NO: 90963 - protein, 88 aa, Homo sapiens
  Payload ID: 18184
  Gene Name: transmembrane protein 101
  ENSP ID: ENSP00000468388
MGAAVLCASFMSFGVKRRWFALGAALQLAISTYAAYIGGYVHYGDWLKVRMYSRTVAIIGGFLVLASGAGELYRRKPRSRSLQSTGQV

SEQ ID NO: 90964 - protein, 508 aa, Homo sapiens
  Payload ID: 18185
  Gene Name: transmembrane protein 102
  Uniprot ID: Q8N9M5
  ENSP ID: ENSP00000315387
MASAVWGSAPWWGPPPPAPARPLTDIDFCSGAQLQELTQLIQELGVQESWSDGPKPGADLLRAKDFVFSLLGLVHRRDPRFPPQAELLLLRGGIREGSLDLGHAPLGPYARGPHYDAGFTLLVPMFSLDGTELQLDLESCYAQVCLPEMVCGTPIREMWQDCLGPPVPGARDSIHRTESEESSKDWQSSVDQPHSYVTEHEAPVSLEKSPSDVSASESPQHDVVDLGSTAPLKTMSSDVTKAAVESPVPKPSEAREAWPTLCSAQVAAWFFATLAAVAESLIPVPGAPRLVHAARHAGFTTVLLATPEPPRRLLLFDLIPVVSVAGWPEGARSHSWAGPLASESASFYLVPGGGTERPCASAWQLCFARQELALKARIPAPLLQAHAAAQALLRPLVAGTRAAAPYLLRTLLYWACERLPALYLARPENAGACCLGLLDELGRVLEAGTLPHYFLNGRQLRTGDDSAALLGELARLRGDPARALRAAVEEAKVARKGGGLAGVGGGAH

SEQ ID NO: 90965 - protein, 508 aa, Homo sapiens; identical to SEQ ID NO: 90964
  Payload ID: 18185
  Gene Name: transmembrane protein 102
  Uniprot ID: Q8N9M5
  ENSP ID: ENSP00000379815

SEQ ID NO: 90966 - protein, 496 aa, Homo sapiens
  Payload ID: 18186
  Gene Name: transmembrane protein 104
  Uniprot ID: Q8NE00
  ENSP ID: ENSP00000334849
MAGEITETGELYSSYVGLVYMFNLIVGTGALTMPKAFATAGWLVSLVLLVFLGFMSFVTTTFVIEAMAAANAQLHWKRMENLKEEEDDDSSTASDSDVLIRDNYERAEKRPILSVQRRGSPNPFEITDRVEMGQMASMFFNKVGVNLFYFCIIVYLYGDLAIYAAAVPFSLMQVTCSATGNDSCGVEADTKYNDTDRCWGPLRRVDAYRIYLAIFTLLLGPFTFFDVQKTKYLQILTSLMRWIAFAVMIVLALIRIGHGQGEGHPPLADFSGVRNLFGVCVYSFMCQHSLPSLITPVSSKRHLTRLVFLDYVLILAFYGLLSFTAIFCFRGDSLMDMYTLNFARCDVVGLAAVRFFLGLFPVFTISTNFPIIAVTLRNNWKTLFHREGGTYPWVVDRVVFPTITLVPPVLVAFCTHDLESLVGITGAYAGTGIQYVIPAFLVYHCRRDTQLAFGCGVSNKHRSPFRHTFWVGFVLLWAFSCFIFVTANIILSETKL

SEQ ID NO: 90967 - protein, 327 aa, Homo sapiens
  Payload ID: 18186
  Gene Name: transmembrane protein 104
  ENSP ID: ENSP00000397676
MAGEITETGELYSSYVFVRVVKPNKIAMLFIMLIPGWARWLTPVIPALWEAEAGRSPEVRSSRPAWPTCFVTTTFVIEAMAAANAQLHWKRMENLKEEEDDDSSTASDSDVLIRDNYERAEKRPILSVQRRGSPNPFEITDRVEMGQMASMFFNKVGVNLFYFCIIVYLYGDLAIYAAAVPFSLMQVTCSATGNDSCGVEADTKYNDTDRCWGPLRRVDAYRIYLAIFTLLLGPFTFFDVQKTKYLQILTSLMRWIDGPPGSVMGRAEEDASPAWPRSRCRCGGKLKLNSLYPTSATCMAPDAPGAGQVKVGVNFLCLPPHRSTRPT

SEQ ID NO: 90968 - protein, 496 aa, Homo sapiens; identical to SEQ ID NO: 90966
  Payload ID: 18186
  Gene Name: transmembrane protein 104
  Uniprot ID: Q8NE00
  ENSP ID: ENSP00000461922

SEQ ID NO: 90969 - protein, 314 aa, Homo sapiens
  Payload ID: 18186
  Gene Name: transmembrane protein 104
  Uniprot ID: Q8NE00
  ENSP ID: ENSP00000463205
MAGEITETGELYSSYVGLVYMFNLIVGTGALTMPKAFATAGWLVSLVLLVFLGFMSFVTTTFVIEAMAAANAQLHWKRMENLKEEEDDDSSTASDSDVLIRDNYERAEKRPILSVQRRGSPNPFEITDRVEMGQMASMFFNKVGVNLFYFCIIVYLYGDLAIYAAAVPFSLMQVTCSATGNDSCGVEADTKYNDTDRCWGPLRRVDAYRIYLAIFTLLLGPFTFFDVQKTKYLQILTSLMRWIDGPPGSVMGRAEEDASPAWPRSRCRCGGKLKLNSLYPTSATCMAPDAPGAGQVKVGVNFLCLPPHRSTRPT

SEQ ID NO: 90970 - protein, 129 aa, Homo sapiens
  Payload ID: 18186
  Gene Name: transmembrane protein 104
  ENSP ID: ENSP00000463774
MAGEITETGELYSSYEEEDDDSSTASDSDVLIRDNYERAEKRPILSVQRRGSPNPFEITDRVEMGQMASMFFNKVGVNLFYFCIIVYLYGDLAIYAAAVPFSLMQVTCSATGNDSCGVEADTKYNDTDR

SEQ ID NO: 90971 - protein, 129 aa, Homo sapiens
  Payload ID: 18187
  Gene Name: transmembrane protein 105
  Uniprot ID: Q8N8V8
  ENSP ID: ENSP00000329795
MLLKVRRASLKPPATPHQGAFRAGNVIGQLIYLLTWSLFTAWLRPPTLLQGPRTSPQGSPPRSPWGDCAEPSCLCEMKIRRRRHEGPAWGQSGFLAGGLHLVPSSLSLAACGVVRMKGLWGRGAGIRGR

SEQ ID NO: 90972 - protein, 74 aa, Homo sapiens
  Payload ID: 18187
  Gene Name: transmembrane protein 105
  ENSP ID: ENSP00000461427
MLLKVRRASLKPPATPHQAWLRPPTLLQGPRTSPQGSPPRSPWGDCAEPSCLCEMKIRRRRHEGPAWGQSGFLA

SEQ ID NO: 90973 - protein, 215 aa, Homo sapiens
  Payload ID: 18188
  Gene Name: transmembrane protein 106A
  ENSP ID: ENSP00000439835
MGKTFSQLGSWREDENKSILSSKPAIGSKAVNYSSTGSSKSFCSCVPCEGTADASFVTCPTCQGSGKIPQELEKQLVALIPYGDQRLKPKHTKLFVFLAVLICLVTSSFIVFFLFPRSVIVQPAGLNSSTVAFDEADIYLNITMFYAVATKIRDENTYKICTWLEIKVHHVLLHIQGTLTCSYLSHSEQLVFQSYEYVDCRGNASVPHQLTPHPP

SEQ ID NO: 90974 - protein, 214 aa, Homo sapiens
  Payload ID: 18188
  Gene Name: transmembrane protein 106A
  Uniprot ID: Q96A25
  ENSP ID: ENSP00000439844
MGTADASFVTCPTCQGSGKIPQELEKQLVALIPYGDQRLKPKHTKLFVFLAVLICLVTSSFIVFFLFPRSVIVQPAGLNSSTVAFDEADIYLNITNILNISNGNYYPIMVTQLTLEVLHLSLVVGQVSNNLLLHIGPLASEQMFYAVATKIRDENTYKICTWLEIKVHHVLLHIQGTLTCSYLSHSEQLVFQSYEYVDCRGNASVPHQLTPHPP

SEQ ID NO: 90975 - protein, 262 aa, Homo sapiens
  Payload ID: 18188
  Gene Name: transmembrane protein 106A
  Uniprot ID: Q96A25
  ENSP ID: ENSP00000466820
MGKTFSQLGSWREDENKSILSSKPAIGSKAVNYSSTGSSKSFCSCVPCEGTADASFVTCPTCQGSGKIPQELEKQLVALIPYGDQRLKPKHTKLFVFLAVLICLVTSSFIVFFLFPRSVIVQPAGLNSSTVAFDEADIYLNITNILNISNGNYYPIMVTQLTLEVLHLSLVVGQVSNNLLLHIGPLASEQMFYAVATKIRDENTYKICTWLEIKVHHVLLHIQGTLTCSYLSHSEQLVFQSYEYVDCRGNASVPHQLTPHPP

SEQ ID NO: 90976 - protein, 241 aa, Homo sapiens
  Payload ID: 18188
  Gene Name: transmembrane protein 106A
  ENSP ID: ENSP00000468220
MGKTFSQLGSWREDENKSILSSKPAIGSKAVNYSSTGSSKSFCSCVPCEGTADASFVTCPTCQGSGKIPQELEKQLVALIPYGDQRLKPKHTKLFVFLAVLICLVTSSFIVFFLFPRSVIVQPAGLNSSTVAFDEADIYLNITNILNISNGNYYPIMVTQLTLEVLHLSLVVGQVSNNLLLHIGPLASEQMFYAVATKIRDENTYKICTWLEIKVHHVLLHIQGTLTCSYLSHSEQLVFQS

SEQ ID NO: 90977 - protein, 262 aa, Homo sapiens; identical to SEQ ID NO: 90975
  Payload ID: 18188
  Gene Name: transmembrane protein 106A
  Uniprot ID: Q96A25
  ENSP ID: ENSP00000483246

SEQ ID NO: 90978 - protein, 274 aa, Homo sapiens
  Payload ID: 18189
  Gene Name: transmembrane protein 106B
  Uniprot ID: Q9NUM4
  ENSP ID: ENSP00000379901
MGKSLSHLPLHSSKEDAYDGVTSENMRNGLVNSEVHNEDGRNGDVSQFPYVEFTGRDSVTCPTCQGTGRIPRGQENQLVALIPYSDQRLRPRRTKLYVMASVFVCLLLSGLAVFFLFPRSIDVKYIGVKSAYVSYDVQKRTIYLNITNTLNITNNNYYSVEVENITAQVQFSKTVIGKARLNNITIIGPLDMKQIDYTVPTVIAEEMSYMYDFCTLISIKVHNIVLMMQVTVTTTYFGHSEQISQERYQYVDCGRNTTYQLGQSEYLNVLQPQQ

SEQ ID NO: 90979 - protein, 274 aa, Homo sapiens; identical to SEQ ID NO: 90978
  Payload ID: 18189
  Gene Name: transmembrane protein 106B
  Uniprot ID: Q9NUM4
  ENSP ID: ENSP00000379902

SEQ ID NO: 90980 - protein, 104 aa, Homo sapiens
  Payload ID: 18189
  Gene Name: transmembrane protein 106B
  ENSP ID: ENSP00000391016
MGKSLSHLPLHSSKEDAYDGVTSENMRNGLVNSEVHNEDGRNGDVSQFPYVEFTGRDSVTCPTCQGTGRIPRGWSFPMFPRMMSNSWAQAIIQPWPPKVLELQL

SEQ ID NO: 90981 - protein, 25 aa, Homo sapiens
  Payload ID: 18189
  Gene Name: transmembrane protein 106B
  ENSP ID: ENSP00000391985
MGKSLSHLPLHSSKEDAYDGVTSEN

SEQ ID NO: 90982 - protein, 110 aa, Homo sapiens
  Payload ID: 18189
  Gene Name: transmembrane protein 106B
  ENSP ID: ENSP00000401302
MGKSLSHLPLHSSKEDAYDGVTSENMRNGLVNSEVHNEDGRNGDVSQFPYVEFTGRDSVTCPTCQGTGRIPRGQENQLVALIPYSDQRLRPRRTKLYVMASVFVCLLLSG

SEQ ID NO: 90983 - protein, 231 aa, Homo sapiens
  Payload ID: 18190
  Gene Name: transmembrane protein 106C
  Uniprot ID: Q9BVX2
  ENSP ID: ENSP00000256686
MGSQHSAAARPSSCRRKQEDDRDGLLAEREQEEAIAQFPYVEFTGRDSITCLTCQGTGYIPTEQVNELVALIPHSDQRLRPQRTKQYVLLSILLCLLASGLVVFFLFPHSVLVDDDGIKVVKVTFNKQDSLVILTIMATLKIRNSNFYTVAVTSLSSQIQYMNTVVNFTGKAEMGGPFSYVYFFCTVPEILVHNIVIFMRTSVKISYIGLMTQSSLETHHYVDCGGNSTAI

SEQ ID NO: 90984 - protein, 250 aa, Homo sapiens
  Payload ID: 18190
  Gene Name: transmembrane protein 106C
  Uniprot ID: Q9BVX2
  ENSP ID: ENSP00000400471
MGSQHSAAARPSSCRRKQEDDRDGLLAEREQEEAIAQFPYVEFTGRDSITCLTCQGTGYIPTEQVNELVALIPHSDQRLRPQRTKQYVLLSILLCLLASGLVVFFLFPHSVLVDDDGIKVVKVTFNKQDSLVILTIMATLKIRNSNFYTVAVTSLSSQIQYMNTVVSTYVTTNVSLIPPRSEQLVNFTGKAEMGGPFSYVYFFCTVPEILVHNIVIFMRTSVKISYIGLMTQSSLETHHYVDCGGNSTAI

SEQ ID NO: 90985 - protein, 231 aa, Homo sapiens; identical to SEQ ID NO: 90983
  Payload ID: 18190
  Gene Name: transmembrane protein 106C
  Uniprot ID: Q9BVX2
  ENSP ID: ENSP00000402705

SEQ ID NO: 90986 - protein, 62 aa, Homo sapiens
  Payload ID: 18190
  Gene Name: transmembrane protein 106C
  ENSP ID: ENSP00000446622
MATLKIRNSNFYTVAVTSLSSQIQYMNTVVSTYVTTNVSLIPPRSEQLVNFTGKAEMGGPFS

SEQ ID NO: 90987 - protein, 250 aa, Homo sapiens; identical to SEQ ID NO: 90984
  Payload ID: 18190
  Gene Name: transmembrane protein 106C
  Uniprot ID: Q9BVX2
  ENSP ID: ENSP00000446657

SEQ ID NO: 90988 - protein, 147 aa, Homo sapiens
  Payload ID: 18190
  Gene Name: transmembrane protein 106C
  ENSP ID: ENSP00000447254
MGSQHSAAARPSSCRRKQEDDRDGLLASGLVVFFLFPHSVLVDDDGIKVVKVTFNKQDSLVILTIMATLKIRNSNFYTVAVTSLSSQIQYMNTVVNFTGKAEMGGPFSYVYFFCTVPEILVHNIVIFMRTSVKISYIGLMTQSSLET

SEQ ID NO: 90989 - protein, 65 aa, Homo sapiens
  Payload ID: 18190
  Gene Name: transmembrane protein 106C
  ENSP ID: ENSP00000447524
MGSQHSAAARPSSCRRKQEDDRDGLLAEREQEEAIAQFPYVEFTGRDSITCLTCQGTGYIPTELQ

SEQ ID NO: 90990 - protein, 86 aa, Homo sapiens
  Payload ID: 18190
  Gene Name: transmembrane protein 106C
  ENSP ID: ENSP00000447622
MGSQHSAAARPSSCRRKQEDDRDGLLAEREQEEAIAQFPYVEFTGRDSITCLTCQGTGYIPTEQVNELVALIPHSDQRLRPQRTPP

SEQ ID NO: 90991 - protein, 117 aa, Homo sapiens
  Payload ID: 18190
  Gene Name: transmembrane protein 106C
  ENSP ID: ENSP00000447830
  MOD_RES (1)..(1): Any amino acid
XDDGIKVVKVTFNKQDSLVILTIMATLKIRNSNFYTVAVTSLSSQIQYMNTVVNFTGKAEMGGPFSYVYFFCTVPEILVHNIVIFMRACRREHSICSQGLSSGPTPTWCKQRRNWFT

SEQ ID NO: 90992 - protein, 179 aa, Homo sapiens
  Payload ID: 18190
  Gene Name: transmembrane protein 106C
  ENSP ID: ENSP00000448268
MGSQHSAAARPSSCRRKQEDDRDGLLASGLVVFFLFPHSVLVDDDGIKVVKVTFNKQDSLVILTIMATLKIRNSNFYTVAVTSLSSQIQYMNTVVSTYVTTNVSLIPPRSEQLVNFTGKAEMGGPFSYVYFFCTVPEILVHNIVIFMRTSVKISYIGLMTQSSLETHHYVDCGGNSTAI

SEQ ID NO: 90993 - protein, 109 aa, Homo sapiens
  Payload ID: 18190
  Gene Name: transmembrane protein 106C
  ENSP ID: ENSP00000448959
  MOD_RES (1)..(1): Any amino acid
XSQHSAAARPSSCRRKQEDDRDGLLAEREQEEAIAQFPYVEFTGRDSITCLTCQGTGYIPTEQVNELVALIPHSDQRLRPQRTTSVKISYIGLMTQSSLETHHYVDCGG

SEQ ID NO: 90994 - protein, 84 aa, Homo sapiens
  Payload ID: 18190
  Gene Name: transmembrane protein 106C
  ENSP ID: ENSP00000449141
MGSQHSAAARPSSCRRKQEDDRDGLLAEREQEEAIAQFPYVEFTGRDSITCLTCQGTGYIPTEQVNELVALIPHSDQRLRPQRT

SEQ ID NO: 90995 - protein, 70 aa, Homo sapiens
  Payload ID: 18190
  Gene Name: transmembrane protein 106C
  ENSP ID: ENSP00000449181
MGSQHSAAARPSSCRRKQEDDRDGLLAEREQEEAIAQFPYVEFTGRDSITCLTCQGTGYIPTGDHGGMIP

SEQ ID NO: 90996 - protein, 231 aa, Homo sapiens; identical to SEQ ID NO: 90983
  Payload ID: 18190
  Gene Name: transmembrane protein 106C
  Uniprot ID: Q9BVX2
  ENSP ID: ENSP00000449737

SEQ ID NO: 90997 - protein, 75 aa, Homo sapiens
  Payload ID: 18190
  Gene Name: transmembrane protein 106C
  ENSP ID: ENSP00000477934
  MOD_RES (1)..(1): Any amino acid
XKQDSLVILTIMATLKIRNSNFYTVAVTSLSSQIQYMNTVVSTYVTTNVSLIPPRSEQLVNFTGKAEMGGPFSYV

SEQ ID NO: 90998 - protein, 181 aa, Homo sapiens
  Payload ID: 18190
  Gene Name: transmembrane protein 106C
  ENSP ID: ENSP00000481710
MGSQHSAAARPSSCRRKQEDDRDGLLAEREQEEAIAQFPYVEFTGRDSITCLTCQGTGYIPTEQVNELVALIPHSDQRLRPQRTKQYVLLSILLCLLASGLVVFFLFPHSVLVDDDGIKVVKVTFNKQDSLVILTIMATLKIRNSNFYTVAVTSLSSQIQYMNTVVNFTGKAEMGGPFSYV

SEQ ID NO: 90999 - protein, 146 aa, Homo sapiens
  Payload ID: 18191
  Gene Name: transmembrane protein 107
  Uniprot ID: Q6UX40
  ENSP ID: ENSP00000314116
MGRVSGLVPSRFLTLLAHLVVVITLFWSRDSNIQACLPLTFTPEEYDKQDIHPLPLCRLVAALSVTLGLFAVELAGFLSGVSMFNSTQSLISIGAHCSASVALSFFIFERWECTTYWYIFVFCSALPAVTEMALFVTVFGLKKKPF

SEQ ID NO: 91000 - protein, 74 aa, Homo sapiens
  Payload ID: 18191
  Gene Name: transmembrane protein 107
  ENSP ID: ENSP00000389420
MGRVSGLVPSRFLTLLAHLVVVITLFWSRDSNIQACLPLTFTPEEYDKQDIHALPAVTEMALFVTVFGLKKKPF

SEQ ID NO: 91001 - protein, 140 aa, Homo sapiens
  Payload ID: 18191
  Gene Name: transmembrane protein 107
  Uniprot ID: Q6UX40
  ENSP ID: ENSP00000402732
MGRVSGLVPSRFLTLLAHLVVVITLFWSRDSNIQACLPLTFTPEEYDKQDIQLVAALSVTLGLFAVELAGFLSGVSMFNSTQSLISIGAHCSASVALSFFIFERWECTTYWYIFVFCSALPAVTEMALFVTVFGLKKKPF

SEQ ID NO: 91002 - protein, 35 aa, Homo sapiens
  Payload ID: 18191
  Gene Name: transmembrane protein 107
  ENSP ID: ENSP00000404753
MGRVSGLVPSRFLTLLAHLVVVITLFWSRCPSSCH

SEQ ID NO: 91003 - protein, 107 aa, Homo sapiens
  Payload ID: 18191
  Gene Name: transmembrane protein 107
  ENSP ID: ENSP00000433148
MGRVSGLVPSRFLTLLAHLVVVITLFWSRDSNIQACLPLTFTPEEYDKQDIQLVAALSVTLGLFAVELAGFLSGVSMFNSTQSLICILSACPPFPHDPLLSGLPSAT

SEQ ID NO: 91004 - protein, 139 aa, Homo sapiens
  Payload ID: 18191
  Gene Name: transmembrane protein 107
  Uniprot ID: Q6UX40
  ENSP ID: ENSP00000436674
MGRVSGLVPSRFLTLLAHLVVVITLFWSRDSNIQACLPLTFTPEEYDKQDIHPLPLCRLVAALSVTLGLFAVELAGFLSGVSMFNSTQSLISIGAHCSASVALSFFIFERWECTTYCALPAVTEMALFVTVFGLKKKPF

SEQ ID NO: 91005 - protein, 575 aa, Homo sapiens
  Payload ID: 18192
  Gene Name: transmembrane protein 108
  Uniprot ID: Q6UXF1
  ENSP ID: ENSP00000324651
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPGSSRKGAGNSSRPVPPAPGGHSRSKEGQRGRNPSSTPLGQKRPLGKIFQIYKGNFTGSVEPEPSTLTPRTPLWGYSSSPQPQTVAATTVPSNTSWAPTTTSLGPAKDKPGLRRAAQGGGSTFTSQGGTPDATAASGAPVSPQAAPVPSQRPHHGDPQDGPSHSDSWLTVTPGTSRPLSTSSGVFTAATGPTPAAFDTSVSAPSQGIPQGASTTPQAPTHPSRVSESTISGAKEETVATLTMTDRVPSPLSTVVSTATGNFLNRLVPAGTWKPGTAGNISHVAEGDKPQHRATICLSKMDIAWVILAISVPISSCSVLLTVCCMKRKKKTANPENNLSYWNNTITMDYFNRHAVELPREIQSLETSEDQLSEPRSPANGDYRDTGMVLVNPFCQETLFVGNDQVSEI

SEQ ID NO: 91006 - protein, 575 aa, Homo sapiens; identical to SEQ ID NO: 91005
  Payload ID: 18192
  Gene Name: transmembrane protein 108
  Uniprot ID: Q6UXF1
  ENSP ID: ENSP00000376838

SEQ ID NO: 91007 - protein, 153 aa, Homo sapiens
  Payload ID: 18192
  Gene Name: transmembrane protein 108
  ENSP ID: ENSP00000421486
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRP

SEQ ID NO: 91008 - protein, 89 aa, Homo sapiens
  Payload ID: 18192
  Gene Name: transmembrane protein 108
  ENSP ID: ENSP00000422072
MVTAPHSSTRHTSVVMLTPNPDGPPSQAAAPMATPTPRAEGHPPTHTISTIAATVTAPHSESSLSTGPAPAAMATTSSKPEGRPRGQAA

SEQ ID NO: 91009 - protein, 71 aa, Homo sapiens
  Payload ID: 18192
  Gene Name: transmembrane protein 108
  ENSP ID: ENSP00000422196
MKRSLQALYCQLLSFLLILALTEALAFAIQEPSPRESLQVLPSGTPPGTMVTAPHSSTRHTSVVMLTPNPD

SEQ ID NO: 91010 - protein, 488 aa, Homo sapiens
  Payload ID: 18192
  Gene Name: transmembrane protein 108
  ENSP ID: ENSP00000423338
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPGSSRKGAGNSSRPVPPAPGGHSRSKEGQRGRNPSSTPLGQKRPLGKIFQIYKGNFTGSVEPEPSTLTPRTPLWGYSSSPQPQTVAATTVPSNTSWAPTTTSLGPAKDKPGLRRAAQGGGSTFTSQGGTPDATAASGAPVSPQAAPVPSQRPHHGDPQDGPSHSDSWLTVTPGTSRPLSTSSGVFTAATGPTPAAFDTSVSAPSQGIPQGASTTPQAPTHPSRVSESTISGAKEETVATLTMTDRVPSPLSTVVSTATGNFLNRLVPAGTWKPGTAGNISHVAEGDKPQHRATICLSKMDIAWVILAISVPISSCSDPIT

SEQ ID NO: 91011 - protein, 105 aa, Homo sapiens
  Payload ID: 18192
  Gene Name: transmembrane protein 108
  ENSP ID: ENSP00000424897
MKRSLQALYCQLLTVLLTVCCMKRKKKTANPENNLSYWNNTITMDYFNRHAVELPREIQSLETSEDQLSEPRSPANGDYRDTGMVLVNPFCQETLFVGNDQVSEI

SEQ ID NO: 91012 - protein, 148 aa, Homo sapiens
  Payload ID: 18192
  Gene Name: transmembrane protein 108
  ENSP ID: ENSP00000426301
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPG

SEQ ID NO: 91013 - protein, 121 aa, Homo sapiens
  Payload ID: 18192
  Gene Name: transmembrane protein 108
  ENSP ID: ENSP00000427447
MVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPG

SEQ ID NO: 91014 - protein, 243 aa, Homo sapiens
  Payload ID: 18193
  Gene Name: transmembrane protein 109
  Uniprot ID: Q9BVC6
  ENSP ID: ENSP00000227525
MAASSISSPWGKHVFKAILMVLVALILLHSALAQSRRDFAPPGQQKREAPVDVLTQIGRSVRGTLDAWIGPETMHLVSESSSQVLWAISSAISVAFFALSGIAAQLLNALGLAGDYLAQGLKLSPGQVQTFLLWGAGALVVYWLLSLLLGLVLALLGRILWGLKLVIFLAGFVALMRSVPDPSTRALLLLALLILYALLSRLTGSRASGAQLEAKVRGLERQVEELRWRQRRAAKGARSVEEE

SEQ ID NO: 91015 - protein, 243 aa, Homo sapiens; identical to SEQ ID NO: 91014
  Payload ID: 18193
  Gene Name: transmembrane protein 109
  Uniprot ID: Q9BVC6
  ENSP ID: ENSP00000443990

SEQ ID NO: 91016 - protein, 192 aa, Homo sapiens
  Payload ID: 18194
  Gene Name: transmembrane protein 11
  Uniprot ID: P17152
  ENSP ID: ENSP00000319992
MAAWGRRRLGPGSSGGSARERVSLSATDCYIVHEIYNGENAQDQFEYELEQALEAQYKYIVIEPTRIGDETARWITVGNCLHKTAVLAGTACLFTPLALPLDYSHYISLPAGVLSLACCTLYGISWQFDPCCKYQVEYDAYKLSRLPLHTLTSSTPVVLVRKDDLHRKRLHNTIALAALVYCVKKIYELYAV

SEQ ID NO: 91017 - protein, 294 aa, Homo sapiens
  Payload ID: 18195
  Gene Name: transmembrane protein 110
  Uniprot ID: Q86TL2
  ENSP ID: ENSP00000347195
MQGPAGNASRGLPGGPPSTVASGAGRCESGALMHSFGIFLQGLLGVVAFSTLMLKRFREPKHERRPWRIWFLDTSKQAIGMLFIHFANVYLADLTEEDPCSLYLINFLLDATVGMLLIYVGVRAVSVLVEWQQWESLRFGEYGDPLQCGAWVGQCALYIVIMIFEKSVVFIVLLILQWKKVALLNPIENPDLKLAIVMLIVPFFVNALMFWVVDNFLMRKGKTKAKLEERGANQDSRNGSKVRYRRAASHEESESEILISADDEMEESDVEEDLRRLTPLKPVKKKKHRFGLPV

SEQ ID NO: 91018 - protein, 89 aa, Homo sapiens
  Payload ID: 18195
  Gene Name: transmembrane protein 110
  ENSP ID: ENSP00000418652
  MOD_RES (1)..(1): Any amino acid
XFLDTSKQAIGMLFIHFANVYLADLTEEDPCSLYLINFLLDATVGMLLIYVGVRAVSVLVEWQQWESLRFGEYEEKAKSLLMRMRDSGK

SEQ ID NO: 91019 - protein, 39 aa, Homo sapiens
  Payload ID: 18195
  Gene Name: transmembrane protein 110
  ENSP ID: ENSP00000418967
LISADDEMEESDVEEDLRRLTPLKPVKKKKHRFGLPGPE

SEQ ID NO: 91020 - protein, 65 aa, Homo sapiens
  Payload ID: 18195
  Gene Name: transmembrane protein 110
  ENSP ID: ENSP00000420219
MQGPAGNASRGLPGGPPSTVASGAGRCESGALMHSFGIFLQGLLGVVAFSTLMLIICDNLAKIRC

SEQ ID NO: 91021 - protein, 142 aa, Homo sapiens
  Payload ID: 18196
  Gene Name: transmembrane protein 114
  ENSP ID: ENSP00000454261
MNPFRLENVTVSESSRQLLTMHGTFVILLPLSLILMVFGGMTGFLSFLLQAYLLLLLTGILFLFGAMVTLAGISVYIAYSAAAFREALCLLEEKALLDQVDISFGWSLALGWISFIAELLTGAAFLAAARELSLRRRQDQAI

SEQ ID NO: 91022 - protein, 223 aa, Homo sapiens
  Payload ID: 18196
  Gene Name: transmembrane protein 114
  Uniprot ID: B3SHH9
  ENSP ID: ENSP00000484263
MRVHLGGLAGAAALTGALSFVLLAAAIGTDFWYIIDTERLERTGPGAQDLLGSINRSQPEPLSSHSGLWRTCRVQSPCTPLMNPFRLENVTVSESSRQLLTMHGTFVILLPLSLILMVFGGMTGFLSFLLQAYLLLLLTGILFLFGAMVTLAGISVYIAYSAAAFREALCLLEEKALLDQVDISFGWSLALGWISFIAELLTGAAFLAAARELSLRRRQDQAI

SEQ ID NO: 91023 - protein, 177 aa, Homo sapiens
  Payload ID: 18196
  Gene Name: transmembrane protein 114
  ENSP ID: ENSP00000485294
MRVHLGGLAGAAALTGALSFVLLAAAIGTDFWYIIDTERLERTGPGAQDLLGSINRSQPEPLSSHSGLWRTCRVQSPCTPLMNPFRLENVTVSESSRQLLTMVTLAGISVYIAYSAAAFREALCLLEEKALLDQVDISFGWSLALGWISFIAELLTGAAFLAAARELSLRRRQDQAI

SEQ ID NO: 91024 - protein, 351 aa, Homo sapiens
  Payload ID: 18197
  Gene Name: transmembrane protein 115
  Uniprot ID: Q12893
  ENSP ID: ENSP00000266025
MQRALPGARQHLGAILASASVVVKALCAAVLFLYLLSFAVDTGCLAVTPGYLFPPNFWIWTLATHGLMEQHVWDVAISLTTVVVAGRLLEPLWGALELLIFFSVVNVSVGLLGAFAYLLTYMASFNLVYLFTVRIHGALGFLGGVLVALKQTMGDCVVLRVPQVRVSVMPMLLLALLLLLRLATLLQSPALASYGFGLLSSWVYLRFYQRHSRGRGDMADHFAFATFFPEILQPVVGLLANLVHSLLVKVKICQKTVKRYDVGAPSSITISLPGTDPQDAERRRQLALKALNERLKRVEDQSIWPSMDDDEEESGAKVDSPLPSDKAPTPPGKGAAPESSLITFEAAPPTL

SEQ ID NO: 91025 - protein, 302 aa, Homo sapiens
  Payload ID: 18198
  Gene Name: transmembrane protein 116
  Uniprot ID: Q8NCL8
  ENSP ID: ENSP00000347620
MATLSVIGSSSLIAYAVFHNIQKSPEIRPLFYLSFCDLLLGLCWLTETLLYGASVANKDIICYNLQAVGQVIDYTCRVCQMAFVFSSLIPLLLMTPVFCLGNTSECFQNFSQSHKCILMHSPPSAMAELPPSANTSVCSTLYFYGIAIFLGSFVLSLLTIMVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 91026 - protein, 85 aa, Homo sapiens
  Payload ID: 18198
  Gene Name: transmembrane protein 116
  ENSP ID: ENSP00000446491
MATLSVIGSSSLIAYAVFHNIQKSPEIRPLFYLSFCDLLLGLCWLTETLLYGASVANKDIICYNLQAVGQGRRGFAMFARLVLNA

SEQ ID NO: 91027 - protein, 175 aa, Homo sapiens
  Payload ID: 18198
  Gene Name: transmembrane protein 116
  ENSP ID: ENSP00000446516
MATLSVIGSSSLIAYAVFHNIQKSPEIRPLFYLSFCDLLLGLCWLTETLLYGASVANKDIICYNLQAVGQIFYISSFLYTVNYIWYLYTELRMKHTQSGQSTSPLVIDYTCRVCQMAFVFSSLIPLLLMTPVFCLGNTSECFQNFSQSHKCILMHSPPSAMAELPPSANTSVCST

SEQ ID NO: 91028 - protein, 74 aa, Homo sapiens
  Payload ID: 18198
  Gene Name: transmembrane protein 116
  ENSP ID: ENSP00000446766
MATLSVIGSSSLIAYAVFHNIQKSPEIRPLFYLSFCDLLLGLCWLTETLLYGASVANKDIICYNLQAVGQVSAT

SEQ ID NO: 91029 - protein, 80 aa, Homo sapiens
  Payload ID: 18198
  Gene Name: transmembrane protein 116
  ENSP ID: ENSP00000447425
MATLSVIGSSSLIAYAVFHNIQKSPEIRPLFYLSFCDLLLGLCWLTETLLYGASVANKDIICYNLQAVGQFWRLEGPRLR

SEQ ID NO: 91030 - protein, 337 aa, Homo sapiens
  Payload ID: 18198
  Gene Name: transmembrane protein 116
  Uniprot ID: Q8NCL8
  ENSP ID: ENSP00000447731
MATLSVIGSSSLIAYAVFHNIQKSPEIRPLFYLSFCDLLLGLCWLTETLLYGASVANKDIICYNLQAVGQIFYISSFLYTVNYIWYLYTELRMKHTQSGQSTSPLVIDYTCRVCQMAFVFSSLIPLLLMTPVFCLGNTSECFQNFSQSHKCILMHSPPSAMAELPPSANTSVCSTLYFYGIAIFLGSFVLSLLTIMVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 91031 - protein, 80 aa, Homo sapiens; identical to SEQ ID NO: 91029
  Payload ID: 18198
  Gene Name: transmembrane protein 116
  ENSP ID: ENSP00000448413

SEQ ID NO: 91032 - protein, 151 aa, Homo sapiens
  Payload ID: 18198
  Gene Name: transmembrane protein 116
  ENSP ID: ENSP00000449163
MFPKLQSEPQVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 91033 - protein, 106 aa, Homo sapiens
  Payload ID: 18198
  Gene Name: transmembrane protein 116
  ENSP ID: ENSP00000449774
MATLSVIGSSSLIAYAVFHNIQKSPEIRPLFYLSFCDLLLGLCWLTETLLYGASVANKDIICYNLQAVGQIFYISSFLYTVNYIWYLYTELRMKHTQSGQSTSPLV

SEQ ID NO: 91034 - protein, 51 aa, Homo sapiens
  Payload ID: 18198
  Gene Name: transmembrane protein 116
  ENSP ID: ENSP00000450060
MATLSVIGSSSLIAYAVFHNIQKSPEIRPLFYLSFCDLLLGLCWLTETLLY

SEQ ID NO: 91035 - protein, 245 aa, Homo sapiens
  Payload ID: 18198
  Gene Name: transmembrane protein 116
  Uniprot ID: Q8NCL8
  ENSP ID: ENSP00000450377
MKHTQSGQSTSPLVIDYTCRVCQMAFVFSSLIPLLLMTPVFCLGNTSECFQNFSQSHKCILMHSPPSAMAELPPSANTSVCSTLYFYGIAIFLGSFVLSLLTIMVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 91036 - protein, 104 aa, Homo sapiens
  Payload ID: 18198
  Gene Name: transmembrane protein 116
  ENSP ID: ENSP00000474027
MKHTQSGQSTSPLVIDYTCRVCQMAFVFSSLIPLLLMTPVFCLGNTSECFQNFSQSHKCILMHSPPSAMAELPPSANTSVCSTLYFYGIAIFLGSFVLSLLTIM

SEQ ID NO: 91037 - protein, 514 aa, Homo sapiens
  Payload ID: 18199
  Gene Name: transmembrane protein 117
  Uniprot ID: Q9H0C3
  ENSP ID: ENSP00000266534
MGKDFRYYFQHPWSRMIVAYLVIFFNFLIFAEDPVSHSQTEANVIVVGNCFSFVTNKYPRGVGWRILKVLLWLLAILTGLIAGKFLFHQRLFGQLLRLKMFREDHGSWMTMFFSTILFLFIFSHIYNTILLMDGNMGAYIITDYMGIRNESFMKLAAVGTWMGDFVTAWMVTDMMLQDKPYPDWGKSARAFWKKGNVRITLFWTVLFTLTSVVVLVITTDWISWDKLNRGFLPSDEVSRAFLASFILVFDLLIVMQDWEFPHFMGDVDVNLPGLHTPHMQFKIPFFQKIFKEEYRIHITGKWFNYGIIFLVLILDLNMWKNQIFYKPHEYGQYIGPGQKIYTVKDSESLKDLNRTKLSWEWRSNHTNPRTNKTYVEGDMFLHSRFIGASLDVKCLAFVPSLIAFVWFGFFIWFFGRFLKNEPRMENQDKTYTRMKRKSPSEHSKDMGITRENTQASVEDPLNDPSLVCIRSDFNEIVYKSSHLTSENLSSQLNESTSATEADQDPTTSKSTPTN

SEQ ID NO: 91038 - protein, 140 aa, Homo sapiens
  Payload ID: 18199
  Gene Name: transmembrane protein 117
  ENSP ID: ENSP00000446952
MGKDFRYYFQHPWSRMIVAYLVIFFNFLIFAEDPVSHSQTEANVIVVGNCFSFVTNKYPRGVGWRILKVLLWLLAILTGLIAGKFLFHQRLFGQLLRLKMFREDHGSWMTMFFSTILFLFIFSHIYNTILLMDGNMGSLI

SEQ ID NO: 91039 - protein, 268 aa, Homo sapiens
  Payload ID: 18199
  Gene Name: transmembrane protein 117
  ENSP ID: ENSP00000448595
MGKDFRYYFQHPWSRMIVAYLVIFFNFLIFAEDPVSHSQTEANVIVVGNCFSFVTNKYPRGVGWRILKVLLWLLAILTGLIAGKFLFHQRLFGQLLRLKMFREDHGSWMTMFFSTILFLFIFSHIYNTILLMDGNMGAYIITDYMGIRNESFMKLAAVGTWMGDFVTAWMVTDMMLQDKPYPDWGKSARAFWKKGNVRITLFWTVLFTLTSVVVLVITTDWISWDKLNRGFLPSDEVSRAFLASFILVFDLLIVMQANGLTMELSSSS

SEQ ID NO: 91040 - protein, 158 aa, Homo sapiens
  Payload ID: 18199
  Gene Name: transmembrane protein 117
  ENSP ID: ENSP00000448657
MGIRNESFMKLAAVGTWMGDFVTAWMVTDMMLQDKPYPDWGKSARAFWKKGNVRITLFWTVLFTLTSVVVLVITTDWISWDKLNRGFLPSDEVSRAFLASFILVFDLLIVMQDWEFPHFMGDVDVNLPGLHTPHMQFKIPFFQKIFKEEYRIHITGKW

SEQ ID NO: 91041 - protein, 283 aa, Homo sapiens
  Payload ID: 18200
  Gene Name: transmembrane protein 119
  Uniprot ID: Q4V9L6
  ENSP ID: ENSP00000376553
MVSAAAPSLLILLLLLLGSVPATDARSVPLKATFLEDVAGSGEAEGSSASSPSLPPPWTPALSPTSMGPQPITLGGPSPPTNFLDGIVDFFRQYVMLIAVVGSLAFLLMFIVCAAVITRQKQKASAYYPSSFPKKKYVDQSDRAGGPRAFSEVPDRAPDSRPEEALDSSRQLQADILAATQNLKSPTRAALGGGDGARMVEGRGAEEEEKGSQEGDQEVQGHGVPVETPEAQEEPCSGVLEGAVVAGEGQGELEGSLLLAQEAQGPVGPPESPCACSSVHPSV

SEQ ID NO: 91042 - protein, 44 aa, Homo sapiens
  Payload ID: 18200
  Gene Name: transmembrane protein 119
  ENSP ID: ENSP00000447120
MVSAAAPSLLILLLLLLGSVPATDARSVPLKATFLEDVAGSGEA

SEQ ID NO: 91043 - protein, 28 aa, Homo sapiens
  Payload ID: 18200
  Gene Name: transmembrane protein 119
  ENSP ID: ENSP00000447345
MVSAAAPSLLILLLLLLGSVPATDARSV

SEQ ID NO: 91044 - protein, 140 aa, Homo sapiens
  Payload ID: 18200
  Gene Name: transmembrane protein 119
  ENSP ID: ENSP00000448583
MVSAAAPSLLILLLLLLGSVPATDARSVPLKATFLEDVAGSGEAEGSSASSPSLPPPWTPALSPTSMGPQPITLGGPSPPTNFLDGIVDFFRQYVMLIAVVGSLAFLLMFIVCAAVITRQKQKASAYYPSSFPKKKYVDQ

SEQ ID NO: 91045 - protein, 343 aa, Homo sapiens
  Payload ID: 18201
  Gene Name: transmembrane protein 120A
  Uniprot ID: Q9BXJ8
  ENSP ID: ENSP00000473983
MQPPPPGPLGDCLRDWEDLQQDFQNIQETHRLYRLKLEELTKLQNNCTSSITRQKKRLQELALALKKCKPSLPAEAEGAAQELENQMKERQGLFFDMEAYLPKKNGLYLSLVLGNVNVTLLSKQAKFAYKDEYEKFKLYLTIILILISFTCRFLLNSRVTDAAFNFLLVWYYCTLTIRESILINNGSRIKGWWVFHHYVSTFLSGVMLTWPDGLMYQKFRNQFLSFSMYQSFVQFLQYYYQSGCLYRLRALGERHTMDLTVEGFQSWMWRGLTFLLPFLFFGHFWQLFNALTLFNLAQDPQCKEWQVLMCGFPFLLLFLGNFFTTLRVVHHKFHSQRHGSKKD

SEQ ID NO: 91046 - protein, 229 aa, Homo sapiens
  Payload ID: 18201
  Gene Name: transmembrane protein 120A
  ENSP ID: ENSP00000479079
SKQAKFAYKDEYEKFKLYLTIILILISFTCRFLLNSRVTDAAFNFLLVWYYCTLTIRESILINNGSRIKGWWVFHHYVSTFLSGVMLTWPDGLMYQKFRNQFLSFSMYQSFVQFLQYYYQSGCLYRLRALGERHTMDLTVEGFQSWMWRGLTFLLPFLFFGHFWQLFNALTLFNLAQDPQCKEWQVSRGPWTGWMGGQAHVQPSPYSSGRCLCAAFPSSSFSSAISSPP

SEQ ID NO: 91047 - protein, 99 aa, Homo sapiens
  Payload ID: 18201
  Gene Name: transmembrane protein 120A
  ENSP ID: ENSP00000480239
GARTLREAGTGAGGDGGSLLQDQRLVGVPSLRVHLPVGSHADVARRSHVPEIPEPIPLLFHVPELRAVSPVLLPERLPLPPAGAGRAAHHGPHCGFLTR

SEQ ID NO: 91048 - protein, 322 aa, Homo sapiens
  Payload ID: 18201
  Gene Name: transmembrane protein 120A
  ENSP ID: ENSP00000480803
MQPPPPGPLGDCLRDWEDLQQDFQNIQETHRLYRLKLEELTKLQNNCTSSITRQKKRLQELALALKKCKPSLPAEAEGAAQELENQMKERQGLFFDMEAYLPKKNGLYLSLVLGNVNVTLLSKQAKFAYKDEYEKFKLYLTIILILISFTCRFLLNSRVTDAAFNFLLVWYYCTLTIRESILINNGSRWAGRALREGSMEWGARTLREAGTGAGGDGGSLLQDQRLVGVPSLRVHLPVGSHADVARRSHVPEIPEPIPLLFHVPELRAVSPVLLPERLPLPPAGAGRAAHHGPHCGGLPVLDVAGPHLPAAFSFLWTLLAAF

SEQ ID NO: 91049 - protein, 322 aa, Homo sapiens; identical to SEQ ID NO: 91048
  Payload ID: 18201
  Gene Name: transmembrane protein 120A
  ENSP ID: ENSP00000481336

SEQ ID NO: 91050 - protein, 174 aa, Homo sapiens
  Payload ID: 18201
  Gene Name: transmembrane protein 120A
  ENSP ID: ENSP00000482497
MQPPPPGPLGDCLRDWEDLQQDFQNIQETHRLYRLKLEELTKLQNNCTSSITRQKKRLQELALALKKCKPSLPAEAEGAAQELENQMKERQGLFFDMEAYLPKKNGFAYKDEYEKFKLYLTIILILISFTCRFLLNSRVTDAAFNFLLVWYYCTLTIRESILINNGSRIKGWWV

SEQ ID NO: 91051 - protein, 102 aa, Homo sapiens
  Payload ID: 18201
  Gene Name: transmembrane protein 120A
  ENSP ID: ENSP00000482622
  MOD_RES (1)..(1): Any amino acid
XFLLVWYYCTLTIRESILINNGSRIKGWWVFHHYVSTFLSGVMLTWPDGLMYQKFRNQFLSFSMYQSFVQFLQYYYQSGCLYRLRALGERHTMDLTVVLAAF

SEQ ID NO: 91052 - protein, 369 aa, Homo sapiens
  Payload ID: 18201
  Gene Name: transmembrane protein 120A
  ENSP ID: ENSP00000484736
MQPPPPGPLGDCLRDWEDLQQDFQNIQETHRLYRLKLEELTKLQNNCTSSITRQKKRLQELALALKKCKPSLPAEAEGAAQELENQMKERQGLFFDMEAYLPKKNGLYLSLVLGNVNVTLLSKQAKFAYKDEYEKFKLYLTIILILISFTCRFLLNSRVTDAAFNFLLVWYYCTLTIRESILINNGSRIKGWWVFHHYVSTFLSGVMLTWPDGLMYQKFRNQFLSFSMYQSFVQFLQYYYQSGCLYRLRALGERHTMDLTVEGFQSWMWRGLTFLLPFLFFGHFWQLFNALTLFNLAQDPQCKEWQGCAPQVSQSAAREQEGLRLGLPLPAQRGFCPVCCGRGWEAPLECACIRGSLLFSLGFYGRCGP

SEQ ID NO: 91053 - protein, 339 aa, Homo sapiens
  Payload ID: 18202
  Gene Name: transmembrane protein 120B
  Uniprot ID: A0PK00
  ENSP ID: ENSP00000345152
MSGQLERCEREWHELEGEFQELQETHRIYKQKLEELAALQTLCSSSISKQKKHLKDLKLTLQRCKRHASREEAELVQQMAANIKERQDVFFDMEAYLPKKNGLYLNLVLGNVNVTLLSNQAKFAYKDEYEKFKLYLTIILLLGAVACRFVLHYRVTDEVFNFLLVWYYCTLTIRESILISNGSRIKGWWVSHHYVSTFLSGVMLTWPNGPIYQKFRNQFLAFSIFQSCVQFLQYYYQRGCLYRLRALGERNHLDLTVEGFQSWMWRGLTFLLPFLFCGHFWQLYNAVTLFELSSHEECREWQVFVLAFTFLILFLGNFLTTLKVVHAKLQKNRGKTKQP

SEQ ID NO: 91054 - protein, 339 aa, Homo sapiens; identical to SEQ ID NO: 91053
  Payload ID: 18202
  Gene Name: transmembrane protein 120B
  Uniprot ID: A0PK00
  ENSP ID: ENSP00000404991

SEQ ID NO: 91055 - protein, 247 aa, Homo sapiens
  Payload ID: 18202
  Gene Name: transmembrane protein 120B
  ENSP ID: ENSP00000442105
LQETHRIYKQKLEELAALQTLCSSSISKQKKHLKDLKLTLQRCKRHASREEAELVQQMAANIKERQDVFFDMEAYLPKKNGLYLNLVLGNVNVTLLSNQAKFAYKDEYEKFKLYLTIILLLGAVACRFVLHYRVTDEVFNFLLVWYYCTLTIRESILISNGSRIKGWWVSHHYVSTFLSGVMLTWPNGPIYQKFRNQFLAFSIFQSCVQFLQYYYQRGCLYRLRALGERNHLDLTVVLAALQCRHAV

SEQ ID NO: 91056 - protein, 92 aa, Homo sapiens
  Payload ID: 18202
  Gene Name: transmembrane protein 120B
  ENSP ID: ENSP00000446159
MQRMAGVRTGVHLPHPLPRQLPDHAQSRACQAPEEQRQDKAAVSLGLLCPRPGLQTAGGSRAPSQQPSQARGIAGRGPRPWSPSGPQWSRGM

SEQ ID NO: 91057 - protein, 319 aa, Homo sapiens
  Payload ID: 18203
  Gene Name: transmembrane protein 121
  Uniprot ID: Q9BTD3
  ENSP ID: ENSP00000376304
MVLPPPDRRHVCLTTLVIMGSMAVMDAYLVEQNQGPRKIGVCIIVLVGDVCFLLVLRYVAVWVGAEVRTAKRGYAMILWFLYIFVLEIKLYFIFQNYKAARRGAADPVARKALTLLLSVCVPGLFLLLVALDRMEYVRTFRKREDLRGRLFWVALDLLDLLDMQASLWEPPRSGLPLWAEGLTFFYCYMLLLVLPCVALSEVSMQGEHIAPQKMMLYPVLSLATVNVVAVLARAANMALFRDSRVSAIFVGKNVVALATKACTFLEYRRQVRDFPPPALSLELQPPPPQRNSVPPPPPPLHGPPGRPHMSSPTRDPLDT

SEQ ID NO: 91058 - protein, 319 aa, Homo sapiens; identical to SEQ ID NO: 91057
  Payload ID: 18203
  Gene Name: transmembrane protein 121
  Uniprot ID: Q9BTD3
  ENSP ID: ENSP00000407456

SEQ ID NO: 91059 - protein, 189 aa, Homo sapiens
  Payload ID: 18204
  Gene Name: transmembrane protein 123
  Uniprot ID: Q8N131
  ENSP ID: ENSP00000355285
MGLGARGAWAALLLGTLQVLALLGAAHESAAMAETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCKMYYSRRGIRYRTIDEHDAII

SEQ ID NO: 91060 - protein, 208 aa, Homo sapiens
  Payload ID: 18204
  Gene Name: transmembrane protein 123
  Uniprot ID: Q8N131
  ENSP ID: ENSP00000381204
MGLGARGAWAALLLGTLQVLALLGAAHESAAMAASANIENSGLPHNSSANSTETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCKMYYSRRGIRYRTIDEHDAII

SEQ ID NO: 91061 - protein, 22 aa, Homo sapiens
  Payload ID: 18204
  Gene Name: transmembrane protein 123
  ENSP ID: ENSP00000433695
MKPTAASNTTTPGMVSTNMTST

SEQ ID NO: 91062 - protein, 120 aa, Homo sapiens
  Payload ID: 18204
  Gene Name: transmembrane protein 123
  ENSP ID: ENSP00000434976
MKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCKMYYSRRGIRYRTIDEHDAII

SEQ ID NO: 91063 - protein, 120 aa, Homo sapiens; identical to SEQ ID NO: 91062
  Payload ID: 18204
  Gene Name: transmembrane protein 123
  ENSP ID: ENSP00000435331

SEQ ID NO: 91064 - protein, 46 aa, Homo sapiens
  Payload ID: 18204
  Gene Name: transmembrane protein 123
  ENSP ID: ENSP00000435842
MSSISVVNHQETLQHVPSDHTNETSNSTVKPPTSVASDSSNTTVTT

SEQ ID NO: 91065 - protein, 15 aa, Homo sapiens
  Payload ID: 18205
  Gene Name: transmembrane protein 125
  ENSP ID: ENSP00000428627
MSEQEAQAPGGRGLP

SEQ ID NO: 91066 - protein, 219 aa, Homo sapiens
  Payload ID: 18205
  Gene Name: transmembrane protein 125
  Uniprot ID: Q96AQ2
  ENSP ID: ENSP00000429275
MSEQEAQAPGGRGLPPDMLAEQVELWWSQQPRRSALCFVVAVGLVAGCGAGGVALLSTTSSRSGEWRLATGTVLCLLALLVLVKQLMSSAVQDMNCIRQAHHVALLRSGGGADALVVLLSGLVLLVTGLTLAGLAAAPAPARPLAAMLSVGIALAALGSLLLLGLLLYQVGVSGHCPSICMATPSTHSGHGGHGSIFSISGQLSAGRRHETTSSIASLI

SEQ ID NO: 91067 - protein, 219 aa, Homo sapiens; identical to SEQ ID NO: 91066
  Payload ID: 18205
  Gene Name: transmembrane protein 125
  Uniprot ID: Q96AQ2
  ENSP ID: ENSP00000429775

SEQ ID NO: 91068 - protein, 195 aa, Homo sapiens
  Payload ID: 18206
  Gene Name: transmembrane protein 126A
  Uniprot ID: Q9H061
  ENSP ID: ENSP00000306887
MENHKSNNKENITIVDISRKINQLPEAERNLLENGSVYVGLNAALCGLIANSLFRRILNVTKARIAAGLPMAGIPFLTTDLTYRCFVSFPLNTGDLDCETCTITRSGLTGLVIGGLYPVFLAIPVNGGLAARYQSALLPHKGNILSYWIRTSKPVFRKMLFPILLQTMFSAYLGSEQYKLLIKALQLSEPGKEIH

SEQ ID NO: 91069 - protein, 39 aa, Homo sapiens
  Payload ID: 18206
  Gene Name: transmembrane protein 126A
  ENSP ID: ENSP00000431993
MENHKSNNKENITIVDISRKINQLPEAESSFFSPFQEST

SEQ ID NO: 91070 - protein, 125 aa, Homo sapiens
  Payload ID: 18206
  Gene Name: transmembrane protein 126A
  Uniprot ID: Q9H061
  ENSP ID: ENSP00000434357
MAGIPFLTTDLTYRCFVSFPLNTGDLDCETCTITRSGLTGLVIGGLYPVFLAIPVNGGLAARYQSALLPHKGNILSYWIRTSKPVFRKMLFPILLQTMFSAYLGSEQYKLLIKALQLSEPGKEIH

SEQ ID NO: 91071 - protein, 125 aa, Homo sapiens; identical to SEQ ID NO: 91070
  Payload ID: 18206
  Gene Name: transmembrane protein 126A
  Uniprot ID: Q9H061
  ENSP ID: ENSP00000436590

SEQ ID NO: 91072 - protein, 95 aa, Homo sapiens
  Payload ID: 18206
  Gene Name: transmembrane protein 126A
  ENSP ID: ENSP00000436723
MENHKSNNKENITIVDISRKINQLPEAERNLLENGSVYVGLNAALCGLIANSLFRRILNVTKARIAAGLPMAGIPFLTTDLTYRCFVIWIVKPVP

SEQ ID NO: 91073 - protein, 230 aa, Homo sapiens
  Payload ID: 18207
  Gene Name: transmembrane protein 126B
  Uniprot ID: Q8IUX1
  ENSP ID: ENSP00000351737
MVVFGYEAGTKPRDSGVVPVGTEEAPKVFKMAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSDNISKENCVFRSSLIGIVCGVFYPSSLAFTKNGRLATKYHTVPLPPKGRVLIHWMTLCQTQMKLMAIPLVFQIMFGILNGLYHYAVFEETLEKTIHEE

SEQ ID NO: 91074 - protein, 200 aa, Homo sapiens
  Payload ID: 18207
  Gene Name: transmembrane protein 126B
  Uniprot ID: Q8IUX1
  ENSP ID: ENSP00000377039
MAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSDNISKENCVFRSSLIGIVCGVFYPSSLAFTKNGRLATKYHTVPLPPKGRVLIHWMTLCQTQMKLMAIPLVFQIMFGILNGLYHYAVFEETLEKTIHEE

SEQ ID NO: 91075 - protein, 125 aa, Homo sapiens
  Payload ID: 18207
  Gene Name: transmembrane protein 126B
  ENSP ID: ENSP00000433116
  MOD_RES (1)..(1): Any amino acid
XGTKPRDSGVVPVGTEEAPKDTKYISNGDIWNNSWFLWNILKLPVQTLLQDNISKENCVFRSSLIGIVCGVFYPSSLAFTKNGRLATKYHTVPLPPKGRVLIHWMTLCQTQMKLMAIPLVFQIMF

SEQ ID NO: 91076 - protein, 40 aa, Homo sapiens
  Payload ID: 18207
  Gene Name: transmembrane protein 126B
  ENSP ID: ENSP00000433444
MVVFGYEAGTKPRDSGVVPVGTEEAPKEMKHDFQNELNLS

SEQ ID NO: 91077 - protein, 58 aa, Homo sapiens
  Payload ID: 18207
  Gene Name: transmembrane protein 126B
  ENSP ID: ENSP00000433449
MVVFGYEAGTKPRDSGVVPVGTEEAPKDTKYISNGDIWNNSWFLWNILKLPVQTLLQG

SEQ ID NO: 91078 - protein, 170 aa, Homo sapiens
  Payload ID: 18207
  Gene Name: transmembrane protein 126B
  Uniprot ID: Q8IUX1
  ENSP ID: ENSP00000433471
MVVFGYEAGTKPRDSGVVPVGTEEAPKVFKMAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSDNISKENCVFRSSLIGIVCGVFYPSSLAFTKNGRLATK

SEQ ID NO: 91079 - protein, 43 aa, Homo sapiens
  Payload ID: 18207
  Gene Name: transmembrane protein 126B
  ENSP ID: ENSP00000435541
MVVFGYEAGTKPRDSGVVPVGTEEAPKLFCSELPLRCGFLRMG

SEQ ID NO: 91080 - protein, 40 aa, Homo sapiens
  Payload ID: 18207
  Gene Name: transmembrane protein 126B
  ENSP ID: ENSP00000435779
  MOD_RES (1)..(1): Any amino acid
XGYEAGTKPRDSGVVPVGTEEAPKLFCSELPLRCGFLRMG

SEQ ID NO: 91081 - protein, 40 aa, Homo sapiens; identical to SEQ ID NO: 91076
  Payload ID: 18207
  Gene Name: transmembrane protein 126B
  ENSP ID: ENSP00000435998

SEQ ID NO: 91082 - protein, 43 aa, Homo sapiens; identical to SEQ ID NO: 91079
  Payload ID: 18207
  Gene Name: transmembrane protein 126B
  ENSP ID: ENSP00000436468

SEQ ID NO: 91083 - protein, 40 aa, Homo sapiens; identical to SEQ ID NO: 91076
  Payload ID: 18207
  Gene Name: transmembrane protein 126B
  ENSP ID: ENSP00000436813

SEQ ID NO: 91084 - protein, 238 aa, Homo sapiens
  Payload ID: 18208
  Gene Name: transmembrane protein 127
  Uniprot ID: O75204
  ENSP ID: ENSP00000258439
MYAPGGAGLPGGRRRRSPGGSALPKQPERSLASALPGALSITALCTALAEPAWLHIHGGTCSRQELGVSDVLGYVHPDLLKDFCMNPQTVLLLRVIAAFCFLGILCSLSAFLLDVFGPKHPALKITRRYAFAHILTVLQCATVIGFSYWASELILAQQQQHKKYHGSQVYVTFAVSFYLVAGAGGASILATAANLLRHYPTEEEEQALELLSEMEENEPYPAEYEVINQFQPPPAYTP

SEQ ID NO: 91085 - protein, 154 aa, Homo sapiens
  Payload ID: 18208
  Gene Name: transmembrane protein 127
  ENSP ID: ENSP00000411810
MNPQTVLLLRVIAAFCFLGILCSLSAFLLDVFGPKHPALKITRRYAFAHILTVLQCATVIGFSYWASELILAQQQQHKKYHGSQVYVTFAVSFYLVAGAGGASILATAANLLRHYPTEEEEQALELLSEMEENEPYPAEYEVINQFQPPPAYTP

SEQ ID NO: 91086 - protein, 238 aa, Homo sapiens; identical to SEQ ID NO: 91084
  Payload ID: 18208
  Gene Name: transmembrane protein 127
  Uniprot ID: O75204
  ENSP ID: ENSP00000416660

SEQ ID NO: 91087 - protein, 141 aa, Homo sapiens
  Payload ID: 18209
  Gene Name: transmembrane protein 128
  Uniprot ID: Q5BJH2
  ENSP ID: ENSP00000254742
MPPFGYKTETSTAVEKKEKPLPRLNIHSGFWILASIVVTYYVDFFKTLKENFHTSSWFLCGSALLLVSLSIAFYCIVYLEWYCGIGEYDVKYPALIPITTASFIAAGICFNIALWHVWSFFTPLLLFTQFMGVVMFITLLG

SEQ ID NO: 91088 - protein, 165 aa, Homo sapiens
  Payload ID: 18209
  Gene Name: transmembrane protein 128
  ENSP ID: ENSP00000372201
MDSSRARQQLRRRFLLLPDAEAQLDREGDAGPETSTAVEKKEKPLPRLNIHSGFWILASIVVTYYVDFFKTLKENFHTSSWFLCGSALLLVSLSIAFYCIVYLEWYCGIGEYDVKYPALIPITTASFIAAGICFNIALWHVWSFFTPLLLFTQFMGVVMFITLLG

SEQ ID NO: 91089 - protein, 232 aa, Homo sapiens
  Payload ID: 18210
  Gene Name: transmembrane protein 129, E3 ubiquitin protein ligase
  Uniprot ID: A0AVI4
  ENSP ID: ENSP00000305243
MDSPEVTFTLAYLVFAVCFVFTPNEFHAAGLTVQNLLSGWLGSEDAAFVPFHLRRTAATLLCHSLLPLGYYVGMCLAASEKRLHALSQAPEAWRLFLLLAVTLPSIACILIYYWSRDRWACHPLARTLALYALPQSGWQAVASSVNTEFRRIDKFATGAPGARVIVTDTWVMKVTTYRVHVAQQQDVHLTVTESRQHELSPDSNLPVQLLTIRVASTNPAVQAFDIWSWRPA

SEQ ID NO: 91090 - protein, 362 aa, Homo sapiens
  Payload ID: 18210
  Gene Name: transmembrane protein 129, E3 ubiquitin protein ligase
  Uniprot ID: A0AVI4
  ENSP ID: ENSP00000372394
MDSPEVTFTLAYLVFAVCFVFTPNEFHAAGLTVQNLLSGWLGSEDAAFVPFHLRRTAATLLCHSLLPLGYYVGMCLAASEKRLHALSQAPEAWRLFLLLAVTLPSIACILIYYWSRDRWACHPLARTLALYALPQSGWQAVASSVNTEFRRIDKFATGAPGARVIVTDTWVMKVTTYRVHVAQQQDVHLTVTESRQHELSPDSNLPVQLLTIRVASTNPAVQAFDIWLNSTEYGELCEKLRAPIRRAAHVVIHQSLGDLFLETFASLVEVNPAYSVPSSQELEACIGCMQTRASVKLVKTCQEAATGECQQCYCRPMWCLTCMGKWFASRQDPLRPDTWLASRVPCPTCRARFCILDVCTVR

SEQ ID NO: 91091 - protein, 92 aa, Homo sapiens
  Payload ID: 18210
  Gene Name: transmembrane protein 129, E3 ubiquitin protein ligase
  ENSP ID: ENSP00000417259
  MOD_RES (1)..(1): Any amino acid
XVFTPNEFHAAGLTVQNLLSGWLGSEDAAFVPFHLRRTAATLLCHSLLPLVTGPTPNVDYYFLPTGTCWCNSSPSPWLIWTFKLSSIWPAGP

SEQ ID NO: 91092 - protein, 28 aa, Homo sapiens
  Payload ID: 18210
  Gene Name: transmembrane protein 129, E3 ubiquitin protein ligase
  ENSP ID: ENSP00000417412
  MOD_RES (1)..(1): Any amino acid
XSPDSNLPVQLLTIRVASTNPAVQAFDI

SEQ ID NO: 91093 - protein, 362 aa, Homo sapiens; identical to SEQ ID NO: 91090
  Payload ID: 18210
  Gene Name: transmembrane protein 129, E3 ubiquitin protein ligase
  Uniprot ID: A0AVI4
  ENSP ID: ENSP00000441812

SEQ ID NO: 91094 - protein, 321 aa, Homo sapiens
  Payload ID: 18211
  Gene Name: transmembrane protein 130
  Uniprot ID: Q8N3G9
  ENSP ID: ENSP00000330262
MAQAVWSRLGRILWLACLLPWAPAGVAAEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVENPEPPSGVRCCCQMCCGPFLLETPSEYLEIVRENHGLLPPLYKSVKTYTV

SEQ ID NO: 91095 - protein, 423 aa, Homo sapiens
  Payload ID: 18211
  Gene Name: transmembrane protein 130
  Uniprot ID: Q8N3G9
  ENSP ID: ENSP00000341256
MAQAVWSRLGRILWLACLLPWAPAGVAAGLYELNLTTDSPATTGAVVTISASLVAKDNGSLALPADAHLYRFHWIHTPLVLTGKMEKGLSSTIRVVGHVPGEFPVSVWVTAADCWMCQPVARGFVVLPITEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVENPEPPSGVRCCCQMCCGPFLLETPSEYLEIVRENHGLLPPLYKSVKTYTV

SEQ ID NO: 91096 - protein, 46 aa, Homo sapiens
  Payload ID: 18211
  Gene Name: transmembrane protein 130
  ENSP ID: ENSP00000389379
MEKGLSSTIRVVGHVPGEFPVSVWVTAADCWMCQPVARGFVVLPIT

SEQ ID NO: 91097 - protein, 339 aa, Homo sapiens
  Payload ID: 18211
  Gene Name: transmembrane protein 130
  ENSP ID: ENSP00000390200
MEKGLSSTIRVVGHVPGEFPVSVWVTAADCWMCQPVARGFVVLPITEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVENPEPPSGVRCCCQMCCGPFLLETPSEYLEIVRENHGLLPPLYKSVKTYTV

SEQ ID NO: 91098 - protein, 435 aa, Homo sapiens
  Payload ID: 18211
  Gene Name: transmembrane protein 130
  Uniprot ID: Q8N3G9
  ENSP ID: ENSP00000413163
MAQAVWSRLGRILWLACLLPWAPAGVAAGLYELNLTTDSPATTGAVVTISASLVAKDNGSLALPADAHLYRFHWIHTPLVLTGKMEKGLSSTIRVVGHVPGEFPVSVWVTAADCWMCQPVARGFVVLPITEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVEVADFDFSPMSDKNPEPPSGVRCCCQMCCGPFLLETPSEYLEIVRENHGLLPPLYKSVKTYTV

SEQ ID NO: 91099 - protein, 1883 aa, Homo sapiens
  Payload ID: 18212
  Gene Name: transmembrane protein 131
  Uniprot ID: Q92545
  ENSP ID: ENSP00000186436
MGKRAGGGATGATTAAVSTSAGAGLEPAAARSGGPRSAAAGLLGALHLVMTLVVAAARAEKEAFVQSESIIEVLRFDDGGLLQTETTLGLSSYQQKSISLYRGNCRPIRFEPPMLDFHEQPVGMPKMEKVYLHNPSSEETITLVSISATTSHFHASFFQNRKILPGGNTSFDVVFLARVVGNVENTLFINTSNHGVFTYQVFGVGVPNPYRLRPFLGARVPVNSSFSPIINIHNPHSEPLQVVEMYSSGGDLHLELPTGQQGGTRKLWEIPPYETKGVMRASFSSREADNHTAFIRIKTNASDSTEFIILPVEVEVTTAPGIYSSTEMLDFGTLRTQDLPKVLNLHLLNSGTKDVPITSVRPTPQNDAITVHFKPITLKASESKYTKVASISFDASKAKKPSQFSGKITVKAKEKSYSKLEIPYQAEVLDGYLGFDHAATLFHIRDSPADPVERPIYLTNTFSFAILIHDVLLPEEAKTMFKVHNFSKPVLILPNESGYIFTLLFMPSTSSMHIDNNILLITNASKFHLPVRVYTGFLDYFVLPPKIEERFIDFGVLSATEASNILFAIINSNPIELAIKSWHIIGDGLSIELVAVERGNRTTIISSLPEFEKSSLSDQSSVTLASGYFAVFRVKLTAKKLEGIHDGAIQITTDYEILTIPVKAVIAVGSLTCFPKHVVLPPSFPGKIVHQSLNIMNSFSQKVKIQQIRSLSEDVRFYYKRLRGNKEDLEPGKKSKIANIYFDPGLQCGDHCYVGLPFLSKSEPKVQPGVAMQEDMWDADWDLHQSLFKGWTGIKENSGHRLSAIFEVNTDLQKNIISKITAELSWPSILSSPRHLKFPLTNTNCSSEEEITLENPADVPVYVQFIPLALYSNPSVFVDKLVSRFNLSKVAKIDLRTLEFQVFRNSAHPLQSSTGFMEGLSRHLILNLILKPGEKKSVKVKFTPVHNRTVSSLIIVRNNLTVMDAVMVQGQGTTENLRVAGKLPGPGSSLRFKITEALLKDCTDSLKLREPNFTLKRTFKVENTGQLQIHIETIEISGYSCEGYGFKVVNCQEFTLSANASRDIIILFTPDFTASRVIRELKFITTSGSEFVFILNASLPYHMLATCAEALPRPNWELALYIIISGIMSALFLLVIGTAYLEAQGIWEPFRRRLSFEASNPPFDVGRPFDLRRIVGISSEGNLNTLSCDPGHSRGFCGAGGSSSRPSAGSHKQCGPSVHPHSSHSNRNSADVENVRAKNSSSTSSRTSAQAASSQSANKTSPLVLDSNTVTQGHTAGRKSKGAKQSQHGSQHHAHSPLEQHPQPPLPPPVPQPQEPQPERLSPAPLAHPSHPERASSARHSSEDSDITSLIEAMDKDFDHHDSPALEVFTEQPPSPLPKSKGKGKPLQRKVKPPKKQEEKEKKGKGKPQEDELKDSLADDDSSSTTTETSNPDTEPLLKEDTEKQKGKQAMPEKHESEMSQVKQKSKKLLNIKKEIPTDVKPSSLELPYTPPLESKQRRNLPSKIPLPTAMTSGSKSRNAQKTKGTSKLVDNRPPALAKFLPNSQELGNTSSSEGEKDSPPPEWDSVPVHKPGSSTDSLYKLSLQTLNADIFLKQRQTSPTPASPSPPAAPCPFVARGSYSSIVNSSSSSDPKIKQPNGSKHKLTKAASLPGKNGNPTFAAVTAGYDKSPGGNGFAKVSSNKTGFSSSLGISHAPVDSDGSDSSGLWSPVSNPSSPDFTPLNSFSAFGNSFNLTGEVFSKLGLSRSCNQASQRSWNEFNSGPSYLWESPATDPSPSWPASSGSPTHTATSVLGNTSGLWSTTPFSSSIWSSNLSSALPFTTPANTLASIGLMGTENSPAPHAPSTSSPADDLGQTYNPWRIWSPTIGRRSSDPWSNSHFPHEN

SEQ ID NO: 91100 - protein, 142 aa, Homo sapiens
  Payload ID: 18212
  Gene Name: transmembrane protein 131
  ENSP ID: ENSP00000386372
ENTGQLQIHIETIEISGYSCEGYGFKVVNCQEFTLSANASRDIIIFALFLLVIGTAYLEAQGIWEPFRRRLSFEASNPPFDVGRPFDLRRIVGISSEGNLNTLSCDPGHSRGFCGAGGSSSRPSAGSHKQCGPSVHPHSSHS

SEQ ID NO: 91101 - protein, 332 aa, Homo sapiens
  Payload ID: 18212
  Gene Name: transmembrane protein 131
  ENSP ID: ENSP00000391566
  MOD_RES (1)..(1): Any amino acid
XGLLGALHLVMTLVVAAARAEKEAFVQSESIIEVLRFDDGGLLQTETTLGLSSYQQKSISLYRGNCRPIRFEPPMLDFHEQPVGMPKMEKVYLHNPSSEETITLVSISATTSHFHASFFQNRKILPGGNTSFDVVFLARVVGNVENTLFINTSNHGVFTYQVFGVGVPNPYRLRPFLGARVPVNSSFSPIINIHNPHSEPLQVVEMYSSGGDLHLELPTGQQGGTRKLWEIPPYETKGVMRASFSSREADNHTAFIRIKTNASDSTEFIILPVEVEVTTAPGIYSSTEMLDFGTLRTQDLPKVLNLHLLNSGTKDVPITHRRQKSHLSFLGK

SEQ ID NO: 91102 - protein, 128 aa, Homo sapiens
  Payload ID: 18212
  Gene Name: transmembrane protein 131
  ENSP ID: ENSP00000411549
MLDFHEQPVGMPKMEKVYLHNPSSEETITLVSISATTSHFHASFFQNRKILPGGNTSFDVVFLARVVGNVENTLFINTSNHGVFTYQVFGVGVPNPYRLRPFLGARVPVNSSFSPIINIHNPHSEPLQ

SEQ ID NO: 91103 - protein, 1024 aa, Homo sapiens
  Payload ID: 18213
  Gene Name: transmembrane protein 132A
  Uniprot ID: Q24JP5
  ENSP ID: ENSP00000005286
MCARMAGRTTAAPRGPYGPWLCLLVALALDVVRVDCGQAPLDPVYLPAALELLDAPEHFRVQQVGHYPPANSSLSSRSETFLLLQPWPRAQPLLRASYPPFATQQVVPPRVTEPHQRPVPWDVRAVSVEAAVTPAEPYARVLFHLKGQDWPPGSGSLPCARLHATHPAGTAHQACRFQPSLGACVVELELPSHWFSQASTTRAELAYTLEPAAEGPGGCGSGEENDPGEQALPVGGVELRPADPPQYQEVPLDEAVTLRVPDMPVRPGQLFSATLLLRHNFTASLLTLRIKVKKGLHVTAARPAQPTLWTAKLDRFKGSRHHTTLITCHRAGLTEPDSSSPLELSEFLWVDFVVENSTGGGVAVTRPVTWQLEYPGQAPEAEKDKMVWEILVSERDIRALIPLAKAEELVNTAPLTGVPQHVPVRLVTVDGGGALVEVTEHVGCESANTQVLQVSEACDAVFVAGKESRGARGVRVDFWWRRLRASLRLTVWAPLLPLRIELTDTTLEQVRGWRVPGPAEGPAEPAAEASDEAERRARGCHLQYQRAGVRFLAPFAAHPLDGGRRLTHLLGPDWLLDVSHLVAPHARVLDSRVASLEGGRVVVGREPGVTSIEVRSPLSDSILGEQALAVTDDKVSVLELRVQPVMGISLTLSRGTAHPGEVTATCWAQSALPAPKQEVALSLWLSFSDHTVAPAELYDRRDLGLSVSAEEPGAILPAEEQGAQLGVVVSGAGAEGLPLHVALHPPEPCRRGRHRVPLASGTAWLGLPPASTPAPALPSSPAWSPPATEATMGGKRQVAGSVGGNTGVRGKFERAEEEARKEETEAREEEEEEEEEMVPAPQHVTELELGMYALLGVFCVAIFIFLVNGVVFVLRYQRKEPPDSATDPTSPQPHNWVWLGTDQEELSRQLDRQSPGPPKGEGSCPCESGGGGEAPTLAPGPPGGTTSSSSTLARKEAGGRRKRVEFVTFAPAPPAQSPEEPVGAPAVQSILVAGEEDIRWVCEDMGLKDPEELRNYMERIRGSS

SEQ ID NO: 91104 - protein, 1023 aa, Homo sapiens
  Payload ID: 18213
  Gene Name: transmembrane protein 132A
  Uniprot ID: Q24JP5
  ENSP ID: ENSP00000405823
MCARMAGRTTAAPRGPYGPWLCLLVALALDVVRVDCGQAPLDPVYLPAALELLDAPEHFRVQQVGHYPPANSSLSSRSETFLLLQPWPRAQPLLRASYPPFATQQVVPPRVTEPHQRPVPWDVRAVSVEAAVTPAEPYARVLFHLKGQDWPPGSGSLPCARLHATHPAGTAHQACRFQPSLGACVVELELPSHWFSQASTTRAELAYTLEPAAEGPGGCGSGEENDPGEQALPVGGVELRPADPPQYQEVPLDEAVTLRVPDMPVRPGQLFSATLLLRHNFTASLLTLRIKVKKGLHVTAARPAQPTLWTAKLDRFKGSRHHTTLITCHRAGLTEPDSSPLELSEFLWVDFVVENSTGGGVAVTRPVTWQLEYPGQAPEAEKDKMVWEILVSERDIRALIPLAKAEELVNTAPLTGVPQHVPVRLVTVDGGGALVEVTEHVGCESANTQVLQVSEACDAVFVAGKESRGARGVRVDFWWRRLRASLRLTVWAPLLPLRIELTDTTLEQVRGWRVPGPAEGPAEPAAEASDEAERRARGCHLQYQRAGVRFLAPFAAHPLDGGRRLTHLLGPDWLLDVSHLVAPHARVLDSRVASLEGGRVVVGREPGVTSIEVRSPLSDSILGEQALAVTDDKVSVLELRVQPVMGISLTLSRGTAHPGEVTATCWAQSALPAPKQEVALSLWLSFSDHTVAPAELYDRRDLGLSVSAEEPGAILPAEEQGAQLGVVVSGAGAEGLPLHVALHPPEPCRRGRHRVPLASGTAWLGLPPASTPAPALPSSPAWSPPATEATMGGKRQVAGSVGGNTGVRGKFERAEEEARKEETEAREEEEEEEEEMVPAPQHVTELELGMYALLGVFCVAIFIFLVNGVVFVLRYQRKEPPDSATDPTSPQPHNWVWLGTDQEELSRQLDRQSPGPPKGEGSCPCESGGGGEAPTLAPGPPGGTTSSSSTLARKEAGGRRKRVEFVTFAPAPPAQSPEEPVGAPAVQSILVAGEEDIRWVCEDMGLKDPEELRNYMERIRGSS

SEQ ID NO: 91105 - protein, 113 aa, Homo sapiens
  Payload ID: 18213
  Gene Name: transmembrane protein 132A
  ENSP ID: ENSP00000437848
  MOD_RES (1)..(1): Any amino acid
XWLLDVSHLVAPHARVLDSRVASLEGGRVVVGREPGVTSIEVRSPLSDSILGEQALAVTDDKVSVLELRVQPVMGISLTLSRGTAHPGEVTATCWAQSALPAPKQVTVGGSGG

SEQ ID NO: 91106 - protein, 103 aa, Homo sapiens
  Payload ID: 18213
  Gene Name: transmembrane protein 132A
  ENSP ID: ENSP00000439716
SVLELRVQPVMGISLTLSRGTAHPGEVTATCWAQSALPAPKQEVALSLWLSFSDHTVAPAELYDRRDLGLSVSAEEPGAILPAEEQGAQLGVVPLQPSHLRSL

SEQ ID NO: 91107 - protein, 152 aa, Homo sapiens
  Payload ID: 18213
  Gene Name: transmembrane protein 132A
  ENSP ID: ENSP00000439717
  MOD_RES (1)..(1): Any amino acid
XAVTRPVTWQLEYPGQAPEAEKDKMVWEILVSERDIRALIPLAKVSEACDAVFVAGKESRGARGVRVDFWWRRLRASLRLTVWAPLLPLRIELTDTTLEQVRGWRVPGPAEGPAEPAAEASDEAERRARGCHLQYQRAGVRFLAPFAAHPLD

SEQ ID NO: 91108 - protein, 76 aa, Homo sapiens
  Payload ID: 18213
  Gene Name: transmembrane protein 132A
  ENSP ID: ENSP00000442754
MPVRPGQLFSATLLLRHNFTASLLTLRIKVKKGLHVTAARPAQPTLWTAKLDRFKGSRHHTTLITCHRAGLTEPDS

SEQ ID NO: 91109 - protein, 1078 aa, Homo sapiens
  Payload ID: 18214
  Gene Name: transmembrane protein 132B
  Uniprot ID: Q14DG7
  ENSP ID: ENSP00000299308
MFGAASRMDTTAVCTGGVTESRGIVDSLQKFSSLPAYLPTNLHISNAEESFFLKEANQDLTRNSSLQARVEPFFIYRARTPPIINASYGPFSVEKIIPQELLLTSTAFGNMDKFPFNWKLKSHILDSSIYSNRPKVQTLFYVTGMGWDDSDLTEDLPCVKMFAFPEAREVAASCRLQGAPGLCVAELELLPEWFSSGLDLEPEEEIPALLGGTTMELFFTLYPADKAGQCPLEEEGKWENNIHSGLESPQQAFPARERIGSVVVYPTQDDLKWSLVSLDENVVISVPLNLVREGDTATFLVSLTSSSVADQFTLRIKAAAGVKITAVRVSSEDQWAVQEEIDNGSTQTSATLTCMGHRPDTQSRVNGSFYEILQVDFGIDNSSDLAGAQQITWQVEYPIEDSMSELVVSEIFVSQTTFVGIVPLAMDTEVLNTAILTGKPVSVPVKVVGVQEDGSVVDVSESVECKSADEDVIKVSNNCDSIFVNGKEMKSKVDTIVNFTHQHFTSQFEVTVWAPRLPLQIEISDTELSQIKGWRIPVAANRRPTRESDDEDDEEKKGRGCSLQYQHATVRVLTQFVAESPDLGQLTYMLGPDWQFDITDLVTEFMKVEEPKIAQLQDGRTLAGREPGITTVQVLSPLSDSILAEKTVIVLDDRVTIAELGVQLVAGMSLSLQPHRADKRAIVSTAAALDVLQSPQQEAIVSSWILFSDGSVTPLDIYDPKDYSVTVSSLDEMVVSVQANLESKWPIVVAEGEGQGPLIKLEMMISEPCQKTKRKSVLAVGKGNVKVKFEPSSDEHQGGSNDIEGINREYKDHLSNSIEREGNQERAVQEWFHRGTPVGQEESTNKSTTPQSPMEGKNKLLKSGGPDAFTSFPTQGKSPDPNNPSDLTVTSRGLTDLEIGMYALLCVFCLAILVFLINCVAFAWKYRHKRFAVSEQGNIPHSHDWVWLGNEVELLENPVDITLPSEECTTMIDRGLQFEERNFLLNGSSQKTFHSQLLRPSDYVYEKEIKNEPMNSSGPKRKRVKFTSYTTILPEDGGPYTNSILFDSDDNIKWVCQDMGLGDSQDFRDYMESLQDQM

SEQ ID NO: 91110 - protein, 590 aa, Homo sapiens
  Payload ID: 18214
  Gene Name: transmembrane protein 132B
  Uniprot ID: Q14DG7
  ENSP ID: ENSP00000482788
MKSKVDTIVNFTHQHFTSQFEVTVWAPRLPLQIEISDTELSQIKGWRIPVAANRRPTRESDDEDDEEKKGRGCSLQYQHATVRVLTQFVAESPDLGQLTYMLGPDWQFDITDLVTEFMKVEEPKIAQLQDGRTLAGREPGITTVQVLSPLSDSILAEKTVIVLDDRVTIAELGVQLVAGMSLSLQPHRADKRAIVSTAAALDVLQSPQQEAIVSSWILFSDGSVTPLDIYDPKDYSVTVSSLDEMVVSVQANLESKWPIVVAEGEGQGPLIKLEMMISEPCQKTKRKSVLAVGKGNVKVKFEPSSDEHQGGSNDIEGINREYKDHLSNSIEREGNQERAVQEWFHRGTPVGQEESTNKSTTPQSPMEGKNKLLKSGGPDAFTSFPTQGKSPDPNNPSDLTVTSRGLTDLEIGMYALLCVFCLAILVFLINCVAFAWKYRHKRFAVSEQGNIPHSHDWVWLGNEVELLENPVDITLPSEECTTMIDRGLQFEERNFLLNGSSQKTFHSQLLRPSDYVYEKEIKNEPMNSSGPKRKRVKFTSYTTILPEDGGPYTNSILFDSDDNIKWVCQDMGLGDSQDFRDYMESLQDQM

SEQ ID NO: 91111 - protein, 1108 aa, Homo sapiens
  Payload ID: 18215
  Gene Name: transmembrane protein 132C
  Uniprot ID: Q8N3T6
  ENSP ID: ENSP00000410852
MRSEGAAPGPAAPLCGALSLLLGALLGKVIEGHGVTDNIQRFSSLPPYLPVSYHILRAETSFFLKEANQDLLRNSSLQARVESFFTYKTRQPPVLNASYGPFSVEKVVPLDLMLTSNFLGPTNKFSFDWKLKAHILRDKVYLSRPKVQVLFHIMGRDWDDHGAGEKLPCLRVFAFRETREVRGSCRLKGDLGLCVAELELLSSWFSAPTVGAGRKKSMDQPEGTPVELYYTVHPGNERGDCAGGDFRKGNAIRPGKDGLEETTSHLQRIGTVGLYRAQDSAQLSELRLDGNVVIWLPSRPVKQGEVVTAYVTISSNSSVDLFILRAKVKKGVNILSAQTREPRQWGVKQEVGSGGKHVTATVACQRLGPSPRNRSSSLFNEVVQMNFEIASFSSLSGTQPITWQVEYPRKGTTDIAVSEIFVSQKDLVGIVPLAMDTEILNTAVLTGKTVAMPIKVVSVEENSAVMDISESVECKSTDEDVIKVSERCDYIFVNGKEIKGKMDAVVNFTYQYLSAPLCVTVWVPRLPLQIEVSDTELSQIKGWRVPIVTNKRPTRESEDEDEEERRGRGCALQYQHATVRVLTQFVSEGAGPWGQPNYLLSPNWQFDITHLVADFMKLEEPHVATLQDSRVLVGREVGMTTIQVLSPLSDSILAEKTITVLDDKVSVTDLAIQLVAGLSVALYPNAENSKAVTAVVTAEEVLRTPKQEAVFSTWLQFSDGSVTPLDIYDTKDFSLAATSQDEAVVSVPQPRSPRWPVVVAEGEGQGPLIRVDMTIAEACQKSKRKSILAVGVGNVRVKFGQNDADSSPGGDYEEDEIKNHASDRRQKGQHHERTGQDGHLYGSSPVEREEGALRRATTTARSLLDNKVVKNSRADGGRLAGEGQLQNIPIDFTNFPAHVDLPKAGSGLEENDLVQTPRGLSDLEIGMYALLGVFCLAILVFLINCATFALKYRHKQVPLEGQASMTHSHDWVWLGNEAELLESMGDAPPPQDEHTTIIDRGPGACEESNHLLLNGGSHKHVQSQIHRSADSGGRQGREQKQDPLHSPTSKRKKVKFTTFTTIPPDDSCPTVNSIVSSNDEDIKWVCQDVAVGAPKELRNYLEKLKDKA

SEQ ID NO: 91112 - protein, 637 aa, Homo sapiens
  Payload ID: 18216
  Gene Name: transmembrane protein 132D
  Uniprot ID: Q14C87
  ENSP ID: ENSP00000374092
MQRDESSPFPPLFSLTSSQVSDRCDYVFVNGKEMKGKVNVVVNFTYQHLSSPLEMTVWVPRLPLQIEVSDTELNQIKGWRVPIVSSRRPAGDSEEEEDDERRGRGCTLQYQHAMVRVLTQFVAEAAGPGGHLAHLLGSDWQVDITELINDFMQVEEPRIAKLQGGQILMGQELGMTTIQILSPLSDTILAEKTITVLDEKVTITDLGVQLVTGLSLSLQLSPGSNRAIFATAVAQELLQRPKQEAAISCWVQFSDGSVTPLDIYDGKDFSLMATSLDEKVVSIHQDPKFKWPIIAAETEGQGTLVKVEMVISESCQKSKRKSVLAVGTANIKVKFGQNDANPNTSDSRHTGAGVHMENNVSDRRPKKPSQEWGSQEGQYYGSSSMGLMEGRGTTTDRSILQKKKGQESLLDDNSHLQTIPSDLTSFPAQVDLPRSNGEMDGNDLMQASKGLSDLEIGMYALLGVFCLAILVFLINCVTFALKYRHKQVPFEEQEGMSHSHDWVGLSNRTELLENHINFASSQDEQITAIDRGMDFEESKYLLSTNSQKSINGQLFKPLGPIIIDGKDQKSEPPTSPTSKRKRVKFTTFTAVSSDDEYPTRNSIVMSSEDDIKWVCQDLDPGDCKELHNYMERLHENV

SEQ ID NO: 91113 - protein, 1099 aa, Homo sapiens
  Payload ID: 18216
  Gene Name: transmembrane protein 132D
  Uniprot ID: Q14C87
  ENSP ID: ENSP00000408581
MCPSEMGTLWHHWSPVLISLAALFSKVTEGRGILESIQRFSLLPTYLPVTYHINNADVSFFLKEANQDIMRNSSLQSRVESFLIYKSRRLPVLNASYGPFSIEQVVPQDLMLPSNPFGFTNKFSLNWKLKAHILRDKVYLSRPKVQVLFHIMGRDWDDRSAGEKLPCLRVFAFRETREVRGSCRLQGDLGLCVAELELLSSWFSPPTVVAGRRKSVDQPEGTPVELYYTVHPGGERGDCVREDARRSNGIRTGHSDIDESGPPLQRIGSIFLYQTHRKPSLRELRLDNSVAIHYIPKTVRKGDVLTFPVSISRNSTEDRFTLRAKVKKGVNIIGVRASSPSIWDVKERTDYTGKYAPAVIVCQKKAAGSENSADGASYEVMQIDVEVEEPGDLPATQLVTWQVEYPGEITSDLGVSKIYVSPKDLIGVVPLAMEAEILNTAILTGKTVAVPVKVVSVEDDGTVTELLESVECRSSDEDVIKVSDRCDYVFVNGKEMKGKVNVVVNFTYQHLSSPLEMTVWVPRLPLQIEVSDTELNQIKGWRVPIVSSRRPAGDSEEEEDDERRGRGCTLQYQHAMVRVLTQFVAEAAGPGGHLAHLLGSDWQVDITELINDFMQVEEPRIAKLQGGQILMGQELGMTTIQILSPLSDTILAEKTITVLDEKVTITDLGVQLVTGLSLSLQLSPGSNRAIFATAVAQELLQRPKQEAAISCWVQFSDGSVTPLDIYDGKDFSLMATSLDEKVVSIHQDPKFKWPIIAAETEGQGTLVKVEMVISESCQKSKRKSVLAVGTANIKVKFGQNDANPNTSDSRHTGAGVHMENNVSDRRPKKPSQEWGSQEGQYYGSSSMGLMEGRGTTTDRSILQKKKGQESLLDDNSHLQTIPSDLTSFPAQVDLPRSNGEMDGNDLMQASKGLSDLEIGMYALLGVFCLAILVFLINCVTFALKYRHKQVPFEEQEGMSHSHDWVGLSNRTELLENHINFASSQDEQITAIDRGMDFEESKYLLSTNSQKSINGQLFKPLGPIIIDGKDQKSEPPTSPTSKRKRVKFTTFTAVSSDDEYPTRNSIVMSSEDDIKWVCQDLDPGDCKELHNYMERLHENV

SEQ ID NO: 91114 - protein, 1079 aa, Homo sapiens
  Payload ID: 18216
  Gene Name: transmembrane protein 132D
  ENSP ID: ENSP00000478824
ALRFPTVTEGRGILESIQRFSLLPTYLPVTYHINNADVSFFLKEANQDIMRNSSLQSRVESFLIYKSRRLPVLNASYGPFSIEQVVPQDLMLPSNPFGFTNKFSLNWKLKAHILRDKVYLSRPKVQVLFHIMGRDWDDRSAGEKLPCLRVFAFRETREVRGSCRLQGDLGLCVAELELLSSWFSPPTVVAGRRKSVDQPEGTPVELYYTVHPGGERGDCVREDARRSNGIRTGHSDIDESGPPLQRIGSIFLYQTHRKPSLRELRLDNSVAIHYIPKTVRKGDVLTFPVSISRNSTEDRFTLRAKVKKGVNIIGVRASSPSIWDVKERTDYTGKYAPAVIVCQKKAAGSENSADGASYEVMQIDVEVEEPGDLPATQLVTWQVEYPGEITSDLGVSKIYVSPKDLIGVVPLAMEAEILNTAILTGKTVAVPVKVVSVEDDGTVTELLESVECRSSDEDVIKVSDRCDYVFVNGKEMKGKVNVVVNFTYQHLSSPLEMTVWVPRLPLQIEVSDTELNQIKGWRVPIVSSRRPAGDSEEEEDDERRGRGCTLQYQHAMVRVLTQFVAEAAGPGGHLAHLLGSDWQVDITELINDFMQVEEPRIAKLQGGQILMGQELGMTTIQILSPLSDTILAEKTITVLDEKVTITDLGVQLVTGLSLSLQLSPGSNRAIFATAVAQELLQRPKQEAAISCWVQFSDGSVTPLDIYDGKDFSLMATSLDEKVVSIHQDPKFKWPIIAAETEGQGTLVKVEMVISESCQKSKRKSVLAVGTANIKVKFGQNDANPNTSDSRHTGAGVHMENNVSDRRPKKPSQEWGSQEGQYYGSSSMGLMEGRGTTTDRSILQKKKGQESLLDDNSHLQTIPSDLTSFPAQVDLPRSNGEMDGNDLMQASKGLSDLEIGMYALLGVFCLAILVFLINCVTFALKYRHKQVPFEEQEGMSHSHDWVGLSNRTELLENHINFASSQDEQITAIDRGMDFEESKYLLSTNSQKSINGQLFKPLGPIIIDGKDQKSEPPTSPTSKRKRVKFTTFTAVSSDDEYPTRNSIVMSSEDDIKWVCQDLDPGDCKELHNYMERLHENV

SEQ ID NO: 91115 - protein, 984 aa, Homo sapiens
  Payload ID: 18217
  Gene Name: transmembrane protein 132E
  Uniprot ID: Q6IEE7
  ENSP ID: ENSP00000316532
MAPGMSGRGGAALLCLSALLAHASGRSHPASPSPPGPQASPVLPVSYRLSHTRLAFFLREARPPSPAVANSSLQRSEPFVVFQTKELPVLNVSLGPFSTSQVVARELLQPSSTLDIPERLTVNWKVRAFIVRSHVPASQPVVQVLFYVAGRDWDDFGVTERLPCVRLHAFRDAREHPLLRIGSISLFRPPPRRTLQEHRLDSNLMIRLPDRPLKPGEVLSILLYLAPNSSSPSSPSVEHFTLRVKAKKGVTLLGTKSRSGQWHVTSELLTGAKHSTATVDVAWAQSTPLPPREGQGPLEILQLDFEMENFTSQSVKRRIMWHIDYRGHGALPDLERAVTELTVIQRDVQAILPLAMDTEIINTAILTGRTVAIPVKVIAIEVNGLVLDISALVECESDNEDIIKVSSSCDYVFVSGKESRGSMNARVTFRYDVLNAPLEMTVWVPKLPLHIELSDARLSQVKGWRVPILPDRRSVRESEDEDEEEEERRQSASRGCTLQYQHATLQVFTQFHTTSSEGTDQVVTMLGPDWLVEVTDLVSDFMRVGDPRVAHMVDSSTLAGLEPGTTPFKVVSPLTEAVLGETLLTVTEEKVSITQLQAQVVASLALSLRPSPGSSHTILATTAAQQTLSFLKQEALLSLWLSYSDGTTAPLSLYSPRDYGLLVSSLDEHVATVTQDRAFPLVVAEAEGSGELLRAELTIAESCQKTKRKSVLATTPVGLRVHFGRDEEDPTYDYPGPSQPGPGGGEDEARGAGPPGSALPAPEAPGPGTASPVVPPTEDFLPLPTGFLQVPRGLTDLEIGMYALLGVFCLAILVFLINCIVFVLRYRHKRIPPEGQTSMDHSHHWVFLGNGQPLRVQGELSPPAGNPLETVPAFCHGDHHSSGSSQTSVQSQVHGRGDGSSGGSARDQAEDPASSPTSKRKRVKFTTFTTLPSEELAYDSVPAGEEDEEEEEDLGWGCPDVAGPTRPTAPPDLHNYMRRIKEIA

SEQ ID NO: 91116 - protein, 1074 aa, Homo sapiens
  Payload ID: 18217
  Gene Name: transmembrane protein 132E
  ENSP ID: ENSP00000487800
MAPGMSGRGGAALLCLSALLAHASGRSHPASPSPPGPQASPVLPVSYRLSHTRLAFFLREARPPSPAVANSSLQRSEPFVVFQTKELPVLNVSLGPFSTSQVVARELLQPSSTLDIPERLTVNWKVRAFIVRSHVPASQPVVQVLFYVAGRDWDDFGVTERLPCVRLHAFRDAREVKSSCRLSGGLATCLVRAELPLAWFGPPAPAAPPTARRKSPDGLEPEATGESQQAELYYTLHAPDASGGCGGSRRGAGPGVGARAESPTQHPLLRIGSISLFRPPPRRTLQEHRLDSNLMIRLPDRPLKPGEVLSILLYLAPNSSSPSSPSVEHFTLRVKAKKGVTLLGTKSRSGQWHVTSELLTGAKHSTATVDVAWAQSTPLPPREGQGPLEILQLDFEMENFTSQSVKRRIMWHIDYRGHGALPDLERAVTELTVIQRDVQAILPLAMDTEIINTAILTGRTVAIPVKVIAIEVNGLVLDISALVECESDNEDIIKVSSSCDYVFVSGKESRGSMNARVTFRYDVLNAPLEMTVWVPKLPLHIELSDARLSQVKGWRVPILPDRRSVRESEDEDEEEEERRQSASRGCTLQYQHATLQVFTQFHTTSSEGTDQVVTMLGPDWLVEVTDLVSDFMRVGDPRVAHMVDSSTLAGLEPGTTPFKVVSPLTEAVLGETLLTVTEEKVSITQLQAQVVASLALSLRPSPGSSHTILATTAAQQTLSFLKQEALLSLWLSYSDGTTAPLSLYSPRDYGLLVSSLDEHVATVTQDRAFPLVVAEAEGSGELLRAELTIAESCQKTKRKSVLATTPVGLRVHFGRDEEDPTYDYPGPSQPGPGGGEDEARGAGPPGSALPAPEAPGPGTASPVVPPTEDFLPLPTGFLQVPRGLTDLEIGMYALLGVFCLAILVFLINCIVFVLRYRHKRIPPEGQTSMDHSHHWVFLGNGQPLRVQGELSPPAGNPLETVPAFCHGDHHSSGSSQTSVQSQVHGRGDGSSGGSARDQAEDPASSPTSKRKRVKFTTFTTLPSEELAYDSVPAGEEDEEEEEDLGWGCPDVAGPTRPTAPPDLHNYMRRIKEIA

SEQ ID NO: 91117 - protein, 129 aa, Homo sapiens
  Payload ID: 18218
  Gene Name: transmembrane protein 133
  Uniprot ID: Q9H2Q1
  ENSP ID: ENSP00000303999
MTSHHCVGPGNHISWSGHEKEHRLDYCPEVTFPLTKGFPLGYTLLFNFASYPFLLPSKIKTLLRNKDSFLNILCPACLLLIRRCNIEYSSTGLNFLNTFTVSLIVTVIPLLQNVPVPLGNNVGKMQVYE

SEQ ID NO: 91118 - protein, 195 aa, Homo sapiens
  Payload ID: 18219
  Gene Name: transmembrane protein 134
  Uniprot ID: Q9H6X4
  ENSP ID: ENSP00000312615
MSAARPQFSIDDAFELSLEDGGPGPESSGVARFGPLHFERRARFEVADEDKQSRLRYQNLENDEDGAQASPEPDGGVGTRDSSRTSIRSSQWSFSTISSSTQRSYNTCCSWTQHPLIQKNRRVVLASFLLLLLGLVLILVGVGLEATPSPGVSSAIFFVPGFLLLVPGVYHVIFIYCAVKGHRGFQFFYLPYFEK

SEQ ID NO: 91119 - protein, 180 aa, Homo sapiens
  Payload ID: 18219
  Gene Name: transmembrane protein 134
  Uniprot ID: Q9H6X4
  ENSP ID: ENSP00000377455
MSAARPQFSIDDAFELSLEDGGPGPESSGVARFGPLHFERRARFEVADEDKQSRLRYQNLENDEDGAQASPEPDGGVGTRDSSRTSIRSSQWSFSTISSSTQRSYNTCCSWTQHPLIQKNRRVVLASFLLLLLGLGVSSAIFFVPGFLLLVPGVYHVIFIYCAVKGHRGFQFFYLPYFEK

SEQ ID NO: 91120 - protein, 192 aa, Homo sapiens
  Payload ID: 18219
  Gene Name: transmembrane protein 134
  Uniprot ID: Q9H6X4
  ENSP ID: ENSP00000438439
MSAARPQFSIDDAFELSLEDGGPGPESSGVARFGPLHFERRARFEVADEDKQSRLRYQNLENDEDGAQASPEPDGGVGTRDSSRTSIRSSQWSFSTISSSTQRSYNTCCSWTQHPLIQKNRRVVLASFLLLLLGLGPAQCLALETELGELPGEGLCLGHLQLRWWVSRAGGGSPRPHHCSCPHPRGSVCVQC

SEQ ID NO: 91121 - protein, 110 aa, Homo sapiens
  Payload ID: 18219
  Gene Name: transmembrane protein 134
  ENSP ID: ENSP00000440630
MSAARPQFSIDDAFELSLEDGGPGPESSGVARFGPLHFERRARFEVADEDKQSRLRYQNLENDEDGAQASPEPDGGVGTRLGPAPSGPSAPSAAAPSAPTTPAAAGPNTL

SEQ ID NO: 91122 - protein, 119 aa, Homo sapiens
  Payload ID: 18219
  Gene Name: transmembrane protein 134
  ENSP ID: ENSP00000441975
MSAARPQFSIDDAFELSLEDGGPGPESSGVARFGPLHFERRARFEVADEDKQSRLRYQNLENDEDGAQASPEPDGGVGTRLGPGIPAELPSAAPSGPSAPSAAAPSAPTTPAAAGPNTL

SEQ ID NO: 91123 - protein, 98 aa, Homo sapiens
  Payload ID: 18219
  Gene Name: transmembrane protein 134
  ENSP ID: ENSP00000481549
  MOD_RES (1)..(1): Any amino acid
XDSSRTSIRSSQWSFSTISSSTQRSYNTCCSWTQHPLIQKNRRVVLASFLLLLLGLVLILVGVGLEATPSPVYHVIFIYCAVKGHRGFQFFYLPYFEK

SEQ ID NO: 91124 - protein, 41 aa, Homo sapiens
  Payload ID: 18219
  Gene Name: transmembrane protein 134
  ENSP ID: ENSP00000483083
  MOD_RES (1)..(1): Any amino acid
XSTQRSYNTCCSWTQHPLIQKNRRVVLASFLLLLLGLGEWP

SEQ ID NO: 91125 - protein, 458 aa, Homo sapiens
  Payload ID: 18220
  Gene Name: transmembrane protein 135
  Uniprot ID: Q86UB9
  ENSP ID: ENSP00000306344
MAALSKSIPHNCYEIGHTWHPSCRVSFLQITGGALEESLKIYAPLYLIAAILRKRKLDYYLHKLLPEILQSASFLTANGALYMAFFCILRKILGKFYSWTPGFGAALPASYVAILIERKSRRGLLTIYMANLATETLFRMGVARGTITTLRNGEVLLFCITAAMYMFFFRCKDGLKGFTFSALRFIVGKEEIPTHSFSPEAAYAKVEQKREQHEEKPGRMNMIGLVRKFVDSICKHGPRHRCCKHYEDNCISYCIKGFIRMFSVGYLIQCCLRIPSAFRHLFTQPSRLLSLFYNKENFQLGAFLGSFVSIYKGTSCFLRWIRNLDDELHAIIAGFLAGISMMFYKSTTISMYLASKLVETMYFKGIEAGKVPYFPHADTIIYSISTAICFQAAVMEVQTLRPSYWKFLLRLTKGKFAVMNRKVLDVFGTGASKHFQDFIPRLDPRYTTVTPELPTEFS

SEQ ID NO: 91126 - protein, 436 aa, Homo sapiens
  Payload ID: 18220
  Gene Name: transmembrane protein 135
  Uniprot ID: Q86UB9
  ENSP ID: ENSP00000345513
MAALSKSIPHNCYEIGHTWHPSCRVSFLQITGGALEESLKIYAPLYLIAAILRKRKLDYYLHKLLPEILQSASFLTANGALYMAFFCILRKILGKFYSWTPGFGAALPASYVAILIERKSRRGLLTIYMANLVLLFCITAAMYMFFFRCKDGLKGFTFSALRFIVGKEEIPTHSFSPEAAYAKVEQKREQHEEKPGRMNMIGLVRKFVDSICKHGPRHRCCKHYEDNCISYCIKGFIRMFSVGYLIQCCLRIPSAFRHLFTQPSRLLSLFYNKENFQLGAFLGSFVSIYKGTSCFLRWIRNLDDELHAIIAGFLAGISMMFYKSTTISMYLASKLVETMYFKGIEAGKVPYFPHADTIIYSISTAICFQAAVMEVQTLRPSYWKFLLRLTKGKFAVMNRKVLDVFGTGASKHFQDFIPRLDPRYTTVTPELPTEFS

SEQ ID NO: 91127 - protein, 123 aa, Homo sapiens
  Payload ID: 18220
  Gene Name: transmembrane protein 135
  ENSP ID: ENSP00000433674
MAALSKSIPHNCYEIGHTWHPSCRVSFLQITGGALEESLKIYAPLYLIAAILRKRKLDYYLHKLLPEILQSASFLTANGALYMAFFCILRRGLLTIYMANLATETLFRMGVARGTITTLRNGE

SEQ ID NO: 91128 - protein, 230 aa, Homo sapiens
  Payload ID: 18220
  Gene Name: transmembrane protein 135
  ENSP ID: ENSP00000433927
MAALSKSIPHNCYEIGHTWHPSCRVSFLQITGGALEESLKIYAPLYLIAAILRKRKLDYYLHKLLPEILQSASFLTANGALYMAFFCILRKILGKFYSWTPGFGAALPASYVAILIERKSRRGLLTIYMANLTESRFVAQAGVQWCDLSSLQPAPPGFKRFLFLSHLSSWDYRFVPPCLANFCIFVEMRFHHVSQAGLEFLALSDPPALASQSAEITGVSHCAWPKNKIF

SEQ ID NO: 91129 - protein, 329 aa, Homo sapiens
  Payload ID: 18220
  Gene Name: transmembrane protein 135
  ENSP ID: ENSP00000436179
MRSATETLFRMGVARGTITTLRNGEVLLFCITAAMYMFFFRCKDGLKGFTFSALRFIVGKEEIPTHSFSPEAAYAKVEQKREQHEEKPGRMNMIGLVRKFVDSICKHGPRHRCCKHYEDNCISYCIKGFIRMFSVGYLIQCCLRIPSAFRHLFTQPSRLLSLFYNKENFQLGAFLGSFVSIYKGTSCFLRWIRNLDDELHAIIAGFLAGISMMFYKSTTISMYLASKLVETMYFKGIEAGKVPYFPHADTIIYSISTAICFQAAVMEVQTLRPSYWKFLLRLTKGKFAVMNRKVLDVFGTGASKHFQDFIPRLDPRYTTVTPELPTEFS

SEQ ID NO: 91130 - protein, 267 aa, Homo sapiens
  Payload ID: 18221
  Gene Name: transmembrane protein 136
  Uniprot ID: Q6ZRR5
  ENSP ID: ENSP00000312672
MTQCCFLRVHPLFFWFWSFHHRMALALCLQVLCSLCGWLSLYISFCHLNKHRSYEWSCRLVTFTHGVLSIGLSAYIGFIDGPWPFTHPGSPNTPLQVHVLCLTLGYFIFDLGWCVYFQSEGALMLAHHTLSILGIIMALVLGESGTEVNAVLFGSELTNPLLQMRWFLRETGHYHSFTGDVVDFLFVALFTGVRIGVGACLLFCEMVSPTPKWFVKAGGVAMYAVSWCFMFSIWRFAWRKSIKKYHAWRSRRSEERQLKHNGHLKIH

SEQ ID NO: 91131 - protein, 245 aa, Homo sapiens
  Payload ID: 18221
  Gene Name: transmembrane protein 136
  Uniprot ID: Q6ZRR5
  ENSP ID: ENSP00000364236
MALALCLQVLCSLCGWLSLYISFCHLNKHRSYEWSCRLVTFTHGVLSIGLSAYIGFIDGPWPFTHPGSPNTPLQVHVLCLTLGYFIFDLGWCVYFQSEGALMLAHHTLSILGIIMALVLGESGTEVNAVLFGSELTNPLLQMRWFLRETGHYHSFTGDVVDFLFVALFTGVRIGVGACLLFCEMVSPTPKWFVKAGGVAMYAVSWCFMFSIWRFAWRKSIKKYHAWRSRRSEERQLKHNGHLKIH

SEQ ID NO: 91132 - protein, 148 aa, Homo sapiens
  Payload ID: 18221
  Gene Name: transmembrane protein 136
  Uniprot ID: Q6ZRR5
  ENSP ID: ENSP00000434862
MTQCCFLRVHPLFFWFWSFHHRMALALCLQVLCSLCGWLSLYISFCHLNKHRSYEWSCRLVTFTHGVLSIGLSAYIGFIDGPWPFTHPGSPNTPLQVHVLCLTLGYFIFDLGCIWRFAWRKSIKKYHAWRSRRSEERQLKHNGHLKIH

SEQ ID NO: 91133 - protein, 162 aa, Homo sapiens
  Payload ID: 18222
  Gene Name: transmembrane protein 138
  Uniprot ID: Q9NPI0
  ENSP ID: ENSP00000278826
MLQTSNYSLVLSLQFLLLSYDLFVNSFSELLQKTPVIQLVLFIIQDIAVLFNIIIIFLMFFNTFVFQAGLVNLLFHKFKGTIILTAVYFALSISLHVWVMNLRWKNSNSFIWTDGLQMLFVFQRLAAVLYCYFYKRTAVRLGDPHFYQDSLWLRKEFMQVRR

SEQ ID NO: 91134 - protein, 104 aa, Homo sapiens
  Payload ID: 18222
  Gene Name: transmembrane protein 138
  ENSP ID: ENSP00000371206
MFFNTFVFQAGLVNLLFHKFKGTIILTAVYFALSISLHVWVMNLRWKNSNSFIWTDGLQMLFVFQRLAAVLYCYFYKRTAVRLGDPHFYQDSLWLRKEFMQVRR

SEQ ID NO: 91135 - protein, 105 aa, Homo sapiens
  Payload ID: 18222
  Gene Name: transmembrane protein 138
  Uniprot ID: Q9NPI0
  ENSP ID: ENSP00000445792
MLQTSNYSLVLSLQFLLLSYDLFVNSFSELLQKTPVIQLVLFIIQDIAVLFNIIIIFLMFFNTFVFQAGLVNLLFHKFKGTIILTAVYFALSISLHVWVMVRVAV

SEQ ID NO: 91136 - protein, 216 aa, Homo sapiens
  Payload ID: 18223
  Gene Name: transmembrane protein 139
  Uniprot ID: Q8IV31
  ENSP ID: ENSP00000352284
MVPMHLLGRLEKPLLLLCCASFLLGLALLGIKTDITPVAYFFLTLGGFFLFAYLLVRFLEWGLRSQLQSMQTESPGPSGNARDNEAFEVPVYEEAVVGLESQCRPQELDQPPPYSTVVIPPAPEEEQPSHPEGSRRAKLEQRRMASEGSMAQEGSPGRAPINLRLRGPRAVSTAPDLQSLAAVPTLEPLTPPPAYDVCFGHPDDDSVFYEDNWAPP

SEQ ID NO: 91137 - protein, 216 aa, Homo sapiens; identical to SEQ ID NO: 91136
  Payload ID: 18223
  Gene Name: transmembrane protein 139
  Uniprot ID: Q8IV31
  ENSP ID: ENSP00000386335

SEQ ID NO: 91138 - protein, 216 aa, Homo sapiens; identical to SEQ ID NO: 91136
  Payload ID: 18223
  Gene Name: transmembrane protein 139
  Uniprot ID: Q8IV31
  ENSP ID: ENSP00000386564

SEQ ID NO: 91139 - protein, 216 aa, Homo sapiens; identical to SEQ ID NO: 91136
  Payload ID: 18223
  Gene Name: transmembrane protein 139
  Uniprot ID: Q8IV31
  ENSP ID: ENSP00000386879

SEQ ID NO: 91140 - protein, 216 aa, Homo sapiens; identical to SEQ ID NO: 91136
  Payload ID: 18223
  Gene Name: transmembrane protein 139
  Uniprot ID: Q8IV31
  ENSP ID: ENSP00000387044

SEQ ID NO: 91141 - protein, 185 aa, Homo sapiens
  Payload ID: 18224
  Gene Name: transmembrane protein 140
  Uniprot ID: Q9NV12
  ENSP ID: ENSP00000275767
MAGPRPRWRDQLLFMSIIVLVIVVICLMFYALLWEAGNLTDLPNLRIGFYNFCLWNEDTSTLQCHQFPELEALGVPRVGLGLARLGVYGSLVLTLFAPQPLLLAQCNSDERAWRLAVGFLAVSSVLLAGGLGLFLSYVWKWVRLSLPGPGFLALGSAQALLILLLIAMAVFPLRAERAESKLESC

SEQ ID NO: 91142 - protein, 108 aa, Homo sapiens
  Payload ID: 18225
  Gene Name: transmembrane protein 141
  Uniprot ID: Q96I45
  ENSP ID: ENSP00000290079
MVNLGLSRVDDAVAAKHPGLGEYAACQSHAFMKGVFTFVTGTGMAFGLQMFIQRKFPYPLQWSLLVAVVAGSVVSYGVTRVESEKCNNLWLFLETGQLPKDRSTDQRS

SEQ ID NO: 91143 - protein, 459 aa, Homo sapiens
  Payload ID: 18226
  Gene Name: transmembrane protein 143
  Uniprot ID: Q96AN5
  ENSP ID: ENSP00000293261
MTVELWLRLRGKGLAMLHVTRGVWGSRVRVWPLLPALLGPPRALSSLAAKMGEYRKMWNPREPRDWAQQYRERFIPFSKEQLLRLLIQEFHSSPAEKAALEAFSAHVDFCTLFHYHQILARLQALYDPINPDRETLDQPSLTDPQRLSNEQEVLRALEPLLAQANFSPLSEDTLAYALVVHHPQDEVQVTVNLDQYVYIHFWALGQRVGQMPLKSSVGSRRGFFTKLPPAERRYFKRVVLAARTKRGHLVLKSFKDTPLEGLEQLLPELKVRTPTLQRALLNLMLVVSGVAIFVNVGMVVLTDLKVATSLLLLLFAIFMGLRASKMFGQRRSAQALELAHMLYYRSTSNNSELLSALALRAQDEHTKEALLAHSFLARRPGGTQGSPEETSRWLRSEVENWLLAKSGCEVTFNGTRALAHLQALTPSMGLYPPPGFPKLDPVAPITSEPPQATPSSNIS

SEQ ID NO: 91144 - protein, 359 aa, Homo sapiens
  Payload ID: 18226
  Gene Name: transmembrane protein 143
  Uniprot ID: Q96AN5
  ENSP ID: ENSP00000366649
MTVELWLRLRGKGLAMLHVTRGVWGSRVRVWPLLPALLGPPRALSSLAAKMGEYRKMWNPREPRDWAQQYRERFIPFSKEQLLRLLIQVTVNLDQYVYIHFWALGQRVGQMPLKSSVGSRRGFFTKLPPAERRYFKRVVLAARTKRGHLVLKSFKDTPLEGLEQLLPELKVRTPTLQRALLNLMLVVSGVAIFVNVGMVVLTDLKVATSLLLLLFAIFMGLRASKMFGQRRSAQALELAHMLYYRSTSNNSELLSALALRAQDEHTKEALLAHSFLARRPGGTQGSPEETSRWLRSEVENWLLAKSGCEVTFNGTRALAHLQALTPSMGLYPPPGFPKLDPVAPITSEPPQATPSSNIS

SEQ ID NO: 91145 - protein, 424 aa, Homo sapiens
  Payload ID: 18226
  Gene Name: transmembrane protein 143
  ENSP ID: ENSP00000397038
MTVELWLRLRGKGLAMLHVTRGVWGSRVRVWPLLPALLGPPRALSSLAAKMGEYRKMWNPREPRDWAQQYRERFIPFSKEQLLRLLIQALYDPINPDRETLDQPSLTDPQRLSNEQEVLRALEPLLAQANFSPLSEDTLAYALVVHHPQDEVQVTVNLDQYVYIHFWALGQRVGQMPLKSSVGSRRGFFTKLPPAERRYFKRVVLAARTKRGHLVLKSFKDTPLEGLEQLLPELKVRTPTLQRALLNLMLVVSGVAIFVNVGMVVLTDLKVATSLLLLLFAIFMGLRASKMFGQRRSAQALELAHMLYYRSTSNNSELLSALALRAQDEHTKEALLAHSFLARRPGGTQGSPEETSRWLRSEVENWLLAKSGCEVTFNGTRALAHLQALTPSMGLYPPPGFPKLDPVAPITSEPPQATPSSNIS

SEQ ID NO: 91146 - protein, 135 aa, Homo sapiens
  Payload ID: 18226
  Gene Name: transmembrane protein 143
  ENSP ID: ENSP00000470195
MLHVTRGVWGSRVRVWPLLPALLGPPRALSSLAAKMGEYRKMWNPREPRDWAQQYRERFIPFSKEQLLRLLIQEFHSSPAEKAALEAFSAHVDFCTLFHYHQILARLQALYDPINPDRETLDQPSLTDPQRLSNE

SEQ ID NO: 91147 - protein, 102 aa, Homo sapiens
  Payload ID: 18226
  Gene Name: transmembrane protein 143
  ENSP ID: ENSP00000471640
MTVELWLRLRGKGLAMLHVTRGVWGSRVRVWPLLPALLGPPRALSSLAAKMGEYRKMWNPREPRDWAQQYRERFIPFSKEQLLRLLIQRQDFTMLATLVLNS

SEQ ID NO: 91148 - protein, 170 aa, Homo sapiens
  Payload ID: 18226
  Gene Name: transmembrane protein 143
  ENSP ID: ENSP00000471875
MGSAPCLGLRGKGLAMLHVTRGVWGSRVRVWPLLPALLGPPRALSSLAAKMGEYRKMWNPREPRDWAQQYRERFIPFSKEQLLRLLIQEFHSSPAEKAALEAFSAHVDFCTLFHYHQILARLQVTVNLDQYVYIHFWALGQRVGQMPLKSSVGSRRGFFTKLPPAERRYF

SEQ ID NO: 91149 - protein, 93 aa, Homo sapiens
  Payload ID: 18226
  Gene Name: transmembrane protein 143
  ENSP ID: ENSP00000472952
MTVELWLRLRGKGLAMLHVTRGVWGSRVRVWPLLPALLGPPRALSSLAAKMGEYRKMWNPREPRDWAQQYRERFIPFSKEQLLRLLIQSLDVV

SEQ ID NO: 91150 - protein, 345 aa, Homo sapiens
  Payload ID: 18227
  Gene Name: transmembrane protein 144
  Uniprot ID: Q7Z5S9
  ENSP ID: ENSP00000296529
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVVSAFIFLFIKSEIPNNTCSMDTTPLITEHVINTTQDPCSWVDKLSTVHHRIVGCSLAVISGVLYGSTFVPIIYIKDHSKRNDSIYAGASQYDLDYVFAHFSGIFLTSTVYFLAYCIAMKNSPKLYPEAVLPGFLSGVLWAIATCCWFIANHSLSAVVSFPIITAGPGFIAAMWGIFMFKEIKGLQNYLLMILAFCIILTGALCTAFSKI

SEQ ID NO: 91151 - protein, 194 aa, Homo sapiens
  Payload ID: 18227
  Gene Name: transmembrane protein 144
  ENSP ID: ENSP00000420930
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVVSAFIFLFIKSEIPNNTCSMDTTPLITEHGLQSCSDIWSTLWIYICANHLHQGPQQKK

SEQ ID NO: 91152 - protein, 110 aa, Homo sapiens
  Payload ID: 18227
  Gene Name: transmembrane protein 144
  ENSP ID: ENSP00000420990
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASS

SEQ ID NO: 91153 - protein, 87 aa, Homo sapiens
  Payload ID: 18227
  Gene Name: transmembrane protein 144
  ENSP ID: ENSP00000421289
MSNNGADLTFGYISCFVAILLFGSNFVPLKKFDTGDGMFLQWVLCAAIWLVALVVNLILHCPKFWPFAMLGGCIWATGNIAVVPIIK

SEQ ID NO: 91154 - protein, 137 aa, Homo sapiens
  Payload ID: 18227
  Gene Name: transmembrane protein 144
  ENSP ID: ENSP00000422082
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVV

SEQ ID NO: 91155 - protein, 10 aa, Homo sapiens
  Payload ID: 18227
  Gene Name: transmembrane protein 144
  ENSP ID: ENSP00000422255
MSNNGADLTF

SEQ ID NO: 91156 - protein, 167 aa, Homo sapiens
  Payload ID: 18227
  Gene Name: transmembrane protein 144
  ENSP ID: ENSP00000422297
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVVSAFIFLFIKSEIPNNTCSMDTTPLITEHVI

SEQ ID NO: 91157 - protein, 91 aa, Homo sapiens
  Payload ID: 18227
  Gene Name: transmembrane protein 144
  ENSP ID: ENSP00000422899
MSNNGADLTFGYISCFVAILLFGSNFVPLKKFDTGDGMFLQWVLCAAIWLVALVVNLILHCPKFWPFAMLGGCIWATGNIAVVPIIKTIGL

SEQ ID NO: 91158 - protein, 87 aa, Homo sapiens; identical to SEQ ID NO: 91153
  Payload ID: 18227
  Gene Name: transmembrane protein 144
  ENSP ID: ENSP00000424659

SEQ ID NO: 91159 - protein, 77 aa, Homo sapiens
  Payload ID: 18227
  Gene Name: transmembrane protein 144
  ENSP ID: ENSP00000425266
MSNNGADLTFGYISCFVAILLFGSNFVPLKKFDTGDGMFLQWVLCAAIWLVALVVNLILHCPKFWPFAMLGGCIWAT

SEQ ID NO: 91160 - protein, 73 aa, Homo sapiens
  Payload ID: 18227
  Gene Name: transmembrane protein 144
  ENSP ID: ENSP00000425815
MSNNGADLTFGYISCFVAILLFGSNFVPLKKFDTGDGNYFSLIVNVILFLKMKFLFWSFKSIATKINHVDLDT

SEQ ID NO: 91161 - protein, 77 aa, Homo sapiens; identical to SEQ ID NO: 91159
  Payload ID: 18227
  Gene Name: transmembrane protein 144
  ENSP ID: ENSP00000425907

SEQ ID NO: 91162 - protein, 169 aa, Homo sapiens
  Payload ID: 18227
  Gene Name: transmembrane protein 144
  Uniprot ID: Q7Z5S9
  ENSP ID: ENSP00000426211
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVVSAFIFLFIKSEIPNNTCSMDTTPLITEHVSIV

SEQ ID NO: 91163 - protein, 493 aa, Homo sapiens
  Payload ID: 18228
  Gene Name: transmembrane protein 145
  Uniprot ID: Q8NBT3
  ENSP ID: ENSP00000301204
MEPLRAPALRRLLPPLLLLLLSLPPRARAKYVRGNLSSKEDWVFLTRFCFLSDYGRLDFRFRYPEAKCCQNILLYFDDPSQWPAVYKAGDKDCLAKESVIRPENNQVINLTTQYAWSGCQVVSEEGTRYLSCSSGRSFRSGDGLQLEYEMVLTNGKSFWTRHFSADEFGILETDVTFLLIFILIFFLSCYFGYLLKGRQLLHTTYKMFMAAAGVEVLSLLFFCIYWGQYATDGIGNESVKILAKLLFSSSFLIFLLMLILLGKGFTVTRGRISHAGSVKLSVYMTLYTLTHVVLLIYEAEFFDPGQVLYTYESPAGYGLIGLQVAAYVWFCYAVLVSLRHFPEKQPFYVPFFAAYTLWFFAVPVMALIANFGIPKWAREKIVNGIQLGIHLYAHGVFLIMTRPSAANKNFPYHVRTSQIASAGVPGPGGSQSADKAFPQHVYGNVTFISDSVPNFTELFSIPPPATSPLPRAAPDSGLPLFRDLRPPGPLRDL

SEQ ID NO: 91164 - protein, 78 aa, Homo sapiens
  Payload ID: 18228
  Gene Name: transmembrane protein 145
  ENSP ID: ENSP00000470602
HPQVGPGEDCQWHPAGDPLVRPWRVSGSPASASGVAGTTGARHHARRDGVSLCWPGWSRSPDLMIRPPRPPKVLGLQE

SEQ ID NO: 91165 - protein, 488 aa, Homo sapiens
  Payload ID: 18228
  Gene Name: transmembrane protein 145
  ENSP ID: ENSP00000470827
MEPLRAPALRRLLPPLLLLLLSLPPRARAKYVRGNLSSKEDWVFLTRFCFLSDYGRLDFRFRYPELPVPNISGLQAKCCQNILLYFDDPSQWPAVYKAGDKDCLAKESVIRPENNQVINLTTQYAWSGCQVVSEEGTRYLSCSSGRSFRSVRERWWYIALSKCGGDGLQLEYEMVLTNGKSFWTRHFSADEFGILETDVTFLLIFILIFFLSCYFGYLLKGRQLLHTTYKMFMAAAGVEVLSLLFFCIYWGQYATDGIGNESVKILAKLLFSSSFLIFLLMLILLGKGFTVTRGRISHAGSVKLSVYMTLYTLTHVVLLIYEAEFFDPGQVLYTYESPAGYGLIGLQVAAYVWFCYAVLVSLRHFPEKQPFYVPFFAAYTLWFFAVPVMALIANFGIPKWAREKIVNGIQLGIHLYAHGVFLILPFLFCIPTAFPTLLDLSTLPLPLPKFCHHRPLFRKKHLGWHRVKLLGSWVGNRRVQHHIFFFFF

SEQ ID NO: 91166 - protein, 224 aa, Homo sapiens
  Payload ID: 18229
  Gene Name: transmembrane protein 147
  Uniprot ID: Q9BVK8
  ENSP ID: ENSP00000222284
MTLFHFGNCFALAYFPYFITYKCSGLSEYNAFWKCVQAGVTYLFVQLCKMLFLATFFPTWEGGIYDFIGEFMKASVDVADLIGLNLVMSRNAGKGEYKIMVAALGWATAELIMSRCIPLWVGARGIEFDWKYIQMSIDSNISLVHYIVASAQVWMITRYDLYHTFRPAVLLLMFLSVYKAFVMETFVHLCSLGSWAALLARAVVTGLLALSTLALYVAVVNVHS

SEQ ID NO: 91167 - protein, 175 aa, Homo sapiens
  Payload ID: 18229
  Gene Name: transmembrane protein 147
  Uniprot ID: Q9BVK8
  ENSP ID: ENSP00000376040
MLFLATFFPTWEGGIYDFIGEFMKASVDVADLIGLNLVMSRNAGKGEYKIMVAALGWATAELIMSRCIPLWVGARGIEFDWKYIQMSIDSNISLVHYIVASAQVWMITRYDLYHTFRPAVLLLMFLSVYKAFVMETFVHLCSLGSWAALLARAVVTGLLALSTLALYVAVVNVHS

SEQ ID NO: 91168 - protein, 184 aa, Homo sapiens
  Payload ID: 18229
  Gene Name: transmembrane protein 147
  ENSP ID: ENSP00000376041
MTLFHFGNCFALAYFPYFITYKCSGLSEYNAFWKCVQAGVTYLFVQLCKMLFLATFFPTWEGGIYDFIGEFMKASVDVADLIGLNLVMSRNAGKGEYKIMVAALGWATAELIMSRCIPLWVGARGIEFDWKYIQMSIDSNISLVHYIVASAQVWMITRYDLYHTFRPAVLLLMFLSVYKAFVME

SEQ ID NO: 91169 - protein, 31 aa, Homo sapiens
  Payload ID: 18229
  Gene Name: transmembrane protein 147
  ENSP ID: ENSP00000466262
MRPGWSHLPLCPTLQDAVLGHFLSHLGRRHL

SEQ ID NO: 91170 - protein, 99 aa, Homo sapiens
  Payload ID: 18230
  Gene Name: transmembrane protein 14A
  Uniprot ID: Q9Y6G1
  ENSP ID: ENSP00000211314
MDLIGFGYAALVTFGSIFGYKRRGGVPSLIAGLFVGCLAGYGAYRVSNDKRDVKVSLFTAFFLATIMGVRFKRSKKIMPAGLVAGLSLMMILRLVLLLL

SEQ ID NO: 91171 - protein, 80 aa, Homo sapiens
  Payload ID: 18231
  Gene Name: transmembrane protein 14B
  Uniprot ID: Q9NUH8
  ENSP ID: ENSP00000368845
MEKPLFPLVPLHWFGFGYTALVVSGGIVGYVKTAATSVTFVGVMGMRSYYYGKFMPVGLIAGASLLMAAKVGVRMLMTSD

SEQ ID NO: 91172 - protein, 114 aa, Homo sapiens
  Payload ID: 18231
  Gene Name: transmembrane protein 14B
  Uniprot ID: Q9NUH8
  ENSP ID: ENSP00000368858
MEKPLFPLVPLHWFGFGYTALVVSGGIVGYVKTGSVPSLAAGLLFGSLAGLGAYQLYQDPRNVWGFLAATSVTFVGVMGMRSYYYGKFMPVGLIAGASLLMAAKVGVRMLMTSD

SEQ ID NO: 91173 - protein, 35 aa, Homo sapiens
  Payload ID: 18231
  Gene Name: transmembrane protein 14B
  ENSP ID: ENSP00000417095
MEKPLFPLVPLHWFGFGYTALVVSGGIVGYVKTGI

SEQ ID NO: 91174 - protein, 35 aa, Homo sapiens; identical to SEQ ID NO: 91173
  Payload ID: 18231
  Gene Name: transmembrane protein 14B
  ENSP ID: ENSP00000417416

SEQ ID NO: 91175 - protein, 101 aa, Homo sapiens
  Payload ID: 18231
  Gene Name: transmembrane protein 14B
  ENSP ID: ENSP00000418334
MEKPLFPLVPLHWFGFGYTALVVSGGIVGYVKTAATSVTFVGVMGMRSYYYGKFMPVGLIAGARYFHSITLLYHVEFSLLPRILYAFKTLLVSEYLMLCIN

SEQ ID NO: 91176 - protein, 135 aa, Homo sapiens
  Payload ID: 18231
  Gene Name: transmembrane protein 14B
  ENSP ID: ENSP00000418730
MEKPLFPLVPLHWFGFGYTALVVSGGIVGYVKTGSVPSLAAGLLFGSLAGLGAYQLYQDPRNVWGFLAATSVTFVGVMGMRSYYYGKFMPVGLIAGARYFHSITLLYHVEFSLLPRILYAFKTLLVSEYLMLCIN

SEQ ID NO: 91177 - protein, 47 aa, Homo sapiens
  Payload ID: 18231
  Gene Name: transmembrane protein 14B
  ENSP ID: ENSP00000418927
VSGGIVGYVKTGSVPSLAAGLLFGSLAGLGAYQLYQDPRNVWGFLGI

SEQ ID NO: 91178 - protein, 35 aa, Homo sapiens; identical to SEQ ID NO: 91173
  Payload ID: 18231
  Gene Name: transmembrane protein 14B
  ENSP ID: ENSP00000419156

SEQ ID NO: 91179 - protein, 35 aa, Homo sapiens; identical to SEQ ID NO: 91173
  Payload ID: 18231
  Gene Name: transmembrane protein 14B
  ENSP ID: ENSP00000419208

SEQ ID NO: 91180 - protein, 59 aa, Homo sapiens
  Payload ID: 18231
  Gene Name: transmembrane protein 14B
  ENSP ID: ENSP00000419731
  MOD_RES (1)..(1): Any amino acid
XSLAGLGAYQLYQDPRNVWGFLAATSVTFVGVMGMRSYYYGKFMPVGLIAGARNLENCI

SEQ ID NO: 91181 - protein, 35 aa, Homo sapiens; identical to SEQ ID NO: 91173
  Payload ID: 18231
  Gene Name: transmembrane protein 14B
  ENSP ID: ENSP00000419806

SEQ ID NO: 91182 - protein, 117 aa, Homo sapiens
  Payload ID: 18231
  Gene Name: transmembrane protein 14B
  ENSP ID: ENSP00000420172
MEKPLFPLVPLHWFGFGYTALVVSGGIVGYVKTAATSVTFVGVMGMRSYYYGKFMPVGLIAGARWSMALVAQAGVQWCDLSSLQPPPPRFKRFSCLTLLSSWDFRCAPPHPANFLYF

SEQ ID NO: 91183 - protein, 53 aa, Homo sapiens
  Payload ID: 18231
  Gene Name: transmembrane protein 14B
  ENSP ID: ENSP00000420580
MEKPLFPFRYICYFCWCYGNEILLLWKIHACRFNCRCQFADGRQSWSSYVDDI

SEQ ID NO: 91184 - protein, 151 aa, Homo sapiens
  Payload ID: 18231
  Gene Name: transmembrane protein 14B
  ENSP ID: ENSP00000420658
MEKPLFPLVPLHWFGFGYTALVVSGGIVGYVKTGSVPSLAAGLLFGSLAGLGAYQLYQDPRNVWGFLAATSVTFVGVMGMRSYYYGKFMPVGLIAGARWSMALVAQAGVQWCDLSSLQPPPPRFKRFSCLTLLSSWDFRCAPPHPANFLYF

SEQ ID NO: 91185 - protein, 103 aa, Homo sapiens
  Payload ID: 18231
  Gene Name: transmembrane protein 14B
  ENSP ID: ENSP00000478448
MQAWGSLLSGLRREEWRSPSSHCSVPSLAAGLLFGSLAGLGAYQLYQDPRNVWGFLAATSVTFVGVMGMRSYYYGKFMPVGLIAGASLLMAAKVGVRMLMTSD

SEQ ID NO: 91186 - protein, 112 aa, Homo sapiens
  Payload ID: 18232
  Gene Name: transmembrane protein 14C
  Uniprot ID: Q9P0S9
  ENSP ID: ENSP00000229563
MQDTGSVVPLHWFGFGYAALVASGGIIGYVKAGSVPSLAAGLLFGSLAGLGAYQLSQDPRNVWVFLATSGTLAGIMGMRFYHSGKFMPAGLIAGASLLMVAKVGVSMFNRPH

SEQ ID NO: 91187 - protein, 112 aa, Homo sapiens; identical to SEQ ID NO: 91186
  Payload ID: 18232
  Gene Name: transmembrane protein 14C
  Uniprot ID: Q9P0S9
  ENSP ID: ENSP00000444561

SEQ ID NO: 91188 - protein, 125 aa, Homo sapiens
  Payload ID: 18233
  Gene Name: transmembrane protein 14E, pseudogene
  Uniprot ID: Q6UXP3
  ENSP ID: ENSP00000386163
MQMDPGPQVPLYWLGFVYAALAALGGISGYAKVGSVQSPSAGFFFSELAGLDASQPSRNPKEHLSSPVYIWDLARYYANKILTLWNIYACGFSCRCLLIVSKLGSMYGEQILSVVAMSQLGLMKN

SEQ ID NO: 91189 - protein, 218 aa, Homo sapiens
  Payload ID: 18234
  Gene Name: transmembrane protein 150A
  Uniprot ID: Q86TG1
  ENSP ID: ENSP00000302715
MYALWRTGPTTSPALLTLLSKGVPRPAAPWTMSPSSVALICLLRYGQLLEQSRHSWVNTTALITGCTNAAGLLVVGNFQVDHARSLHYVGAGVAFPAGLLFVCLHCALSYQGATAPLDLAVAYLRSVLAVIAFITLVLSGVFFVHESSQLQHGAALCEWVCVIDILIFYGTFSYEFGAVSSDTLVAALQPTPGRACKSSGSSSTSTHLNCAPESIAMI

SEQ ID NO: 91190 - protein, 271 aa, Homo sapiens
  Payload ID: 18234
  Gene Name: transmembrane protein 150A
  Uniprot ID: Q86TG1
  ENSP ID: ENSP00000334708
MTAWILLPVSLSAFSITGIWTVYAMAVMNHHVCPVENWSYNESCPPDPAEQGGPKTCCTLDDVPLISKCGSYPPESCLFSLIGNMGAFMVALICLLRYGQLLEQSRHSWVNTTALITGCTNAAGLLVVGNFQVDHARSLHYVGAGVAFPAGLLFVCLHCALSYQGATAPLDLAVAYLRSVLAVIAFITLVLSGVFFVHESSQLQHGAALCEWVCVIDILIFYGTFSYEFGAVSSDTLVAALQPTPGRACKSSGSSSTSTHLNCAPESIAMI

SEQ ID NO: 91191 - protein, 271 aa, Homo sapiens; identical to SEQ ID NO: 91190
  Payload ID: 18234
  Gene Name: transmembrane protein 150A
  Uniprot ID: Q86TG1
  ENSP ID: ENSP00000387292

SEQ ID NO: 91192 - protein, 45 aa, Homo sapiens
  Payload ID: 18234
  Gene Name: transmembrane protein 150A
  ENSP ID: ENSP00000388247
MYALWRTGMKDSADNLALKLPSSLSPLGPEAATSQTATLSLTALL

SEQ ID NO: 91193 - protein, 67 aa, Homo sapiens
  Payload ID: 18234
  Gene Name: transmembrane protein 150A
  ENSP ID: ENSP00000394945
MYALWRTGPTTSPALLTLLSKGVPRPAAPWTMSPSSVALICLLRYGQLLEQSRHSWVNTTALITGCT

SEQ ID NO: 91194 - protein, 59 aa, Homo sapiens
  Payload ID: 18234
  Gene Name: transmembrane protein 150A
  ENSP ID: ENSP00000401631
MTAWILLPVSLSAFSITGIWTVYAMAVMNHHVCPVENWYEGLCRQPCSKASFISVPSWA

SEQ ID NO: 91195 - protein, 45 aa, Homo sapiens; identical to SEQ ID NO: 91192
  Payload ID: 18234
  Gene Name: transmembrane protein 150A
  ENSP ID: ENSP00000409224

SEQ ID NO: 91196 - protein, 233 aa, Homo sapiens
  Payload ID: 18235
  Gene Name: transmembrane protein 150B
  Uniprot ID: A6NC51
  ENSP ID: ENSP00000320757
MWGYLSLMPVFLAVWAISGVWIVFAIAVTNRTVDLSKGFPYISICGSFPPQSCIFSQVLNMGAALAAWICIVRYHQLRDWGVRRWPNQLILWTGLLCALGTSVVGNFQEKNQRPTHLAGAFLAFILGNVYFWLQLLLWRLKRLPQPGAAWIGPLRLGLCSVCTILIVAMIVLHACSLRSVSAACEWVVAMLLFALFGLLAVDFSALESCTLCVQPWPSLSPPPASPISLPVQL

SEQ ID NO: 91197 - protein, 152 aa, Homo sapiens
  Payload ID: 18235
  Gene Name: transmembrane protein 150B
  ENSP ID: ENSP00000465672
GSFPPQSCIFSQVLNMGAALAAWICIVRYHQLRDWGVRRWPNQLILWTGLLCALGTSVVGNFQEKNQRPTHLAGAFLAFILGNVYFWLQLLLWRLKRLPQPGAAWIGPLRLGLCSVCTILIVAMIVLHACSLRSVSAACEWVVAMLLFALFG

SEQ ID NO: 91198 - protein, 84 aa, Homo sapiens
  Payload ID: 18235
  Gene Name: transmembrane protein 150B
  ENSP ID: ENSP00000465815
MWGYLSLMPVFLAVWAISGVWIVFAIAVTNRTVDLSKGFPYISICGSFPPQSCIFSQVLNMGAALGKEPAAYALGRGLPCLHLG

SEQ ID NO: 91199 - protein, 134 aa, Homo sapiens
  Payload ID: 18235
  Gene Name: transmembrane protein 150B
  ENSP ID: ENSP00000466297
MWGYLSLMPVFLAVWAISGVWIVFAIAVTNRTVDLSKGFPYISICGSFPPQSCIFSQVLNMGAALAAWICIVRYHQLRDWGVRRWPNQLILWTGLLCALGTSVVGNFQEKNQRPTHLAGAFLAFILGNVYFWLQ

SEQ ID NO: 91200 - protein, 63 aa, Homo sapiens
  Payload ID: 18235
  Gene Name: transmembrane protein 150B
  ENSP ID: ENSP00000466957
MWGYLSLMPVFLAVWAISGVWIVFAIAVTNRTVDLSKGFPYISRVDLHCPLPPAPGLGRQKVA

SEQ ID NO: 91201 - protein, 63 aa, Homo sapiens; identical to SEQ ID NO: 91200
  Payload ID: 18235
  Gene Name: transmembrane protein 150B
  ENSP ID: ENSP00000468745

SEQ ID NO: 91202 - protein, 249 aa, Homo sapiens
  Payload ID: 18236
  Gene Name: transmembrane protein 150C
  Uniprot ID: B9EJG8
  ENSP ID: ENSP00000403438
MDGKKCSVWMFLPLVFTLFTSAGLWIVYFIAVEDDKILPLNSAERKPGVKHAPYISIAGDDPPASCVFSQVMNMAAFLALVVAVLRFIQLKPKVLNPWLNISGLVALCLASFGMTLLGNFQLTNDEEIHNVGTSLTFGFGTLTCWIQAALTLKVNIKNEGRRVGIPRVILSASITLCVVLYFILMAQSIHMYAARVQWGLVMCFLSYFGTFAVEFRHYRYEIVCSEYQENFLSFSESLSEASEYQTDQV

SEQ ID NO: 91203 - protein, 67 aa, Homo sapiens
  Payload ID: 18236
  Gene Name: transmembrane protein 150C
  ENSP ID: ENSP00000414988
MDGKKCSVWMFLPLVFTLFTSAGLWIVYFIAVEDDKILPLNSAERKPGVKHAPYISIAGDDPPASCV

SEQ ID NO: 91204 - protein, 249 aa, Homo sapiens; identical to SEQ ID NO: 91202
  Payload ID: 18236
  Gene Name: transmembrane protein 150C
  Uniprot ID: B9EJG8
  ENSP ID: ENSP00000420919

SEQ ID NO: 91205 - protein, 120 aa, Homo sapiens
  Payload ID: 18236
  Gene Name: transmembrane protein 150C
  ENSP ID: ENSP00000421812
MDGKKCSVWMFLPLVFTLFTSAGLWIVYFIAVEDDKILPLNSAERKPGVKHAPYISIAGDDPPASCVFSQVMNMAAFLALVVAVLRFIQLKPKVLNPWLNISGLVALCLASFGMTLLAHK

SEQ ID NO: 91206 - protein, 468 aa, Homo sapiens
  Payload ID: 18237
  Gene Name: transmembrane protein 151A
  Uniprot ID: Q8N4L1
  ENSP ID: ENSP00000326244
MPEDGAGDGGEVPALIPDGEPLREEQRPLKQSLGSSLCRESHWKCLLLTLLIHACGAVVAWCRLATVPRLVLGPEAALARGAGGPPPTYPASPCSDGYLYIPLAFVSLLYLLYLAECWHCHVRSCQAPRTDAHTVLALIRRLQQAPPCVWWKATSYHYVRRTRQITRYRNGDAYTTTQVYHERADSRTARGEFDYSAHGVRDVSKELVGLAEHAATRLRFTKCFSFGSAEAEASYLTQRARFFSANEGLDDYLEAREGMHLKDVDFRESLMVFADPRSPPWYARAWVFWLVSAATLSWPLRVVAAYGTAHVHYQVEKLFGASSPPPGAVPSGPPLSRVATVDFTELEWHICSNRQLVPSYSEAVVMGAGSGAYLRGCQRCRRSVSSNSLPPARPSGPRLPFSRSRLSLGAGGRATPGVFRSLSGGPLGRRGEDTEPLESPPCYEDALYFPVLIVHGDSGCQGDGQGAL

SEQ ID NO: 91207 - protein, 566 aa, Homo sapiens
  Payload ID: 18238
  Gene Name: transmembrane protein 151B
  Uniprot ID: Q8IW70
  ENSP ID: ENSP00000393161
MSPPGSAAGESAAGGGGGGGGPGVSEELTAAAAAAAADEGPAREEQRPIQPSFTKSLCRESHWKCLLLSLLMYGCLGAVAWCHVTTVTRLTFSSAYQGNSLMYHDSPCSNGYVYIPLAFLLMLYAVYLVECWHCQARHELQHRVDVSSVRERVGRMQQATPCIWWKAISYHYVRRTRQVTRYRNGDAYTTTQVYHERVNTHVAEAEFDYARCGVRDVSKTLVGLEGAPATRLRFTKCFSFASVEAENAYLCQRARFFAENEGLDDYMEAREGMHLKNVDFREFMVAFPDPARPPWYACSSAFWAAALLTLSWPLRVLAEYRTAYAHYHVEKLFGLEGPGSASSAGGGLSPSDELLPPLTHRLPRVNTVDSTELEWHIRSNQQLVPSYSEAVLMDLAGLGTRCGGAGGGYAPSCRYGGVGGPGAAGVAPYRRSCEHCQRAVSSSSIFSRSALSICASPRAGPGPGGGAGCGGSRFSLGRLYGSRRSCLWRSRSGSVNEASCPTEQTRLSSQASMGDDEDDDEEEAGPPPPYHDALYFPVLIVHRQEGCLGHSHRPLHRHGSCVETSL

SEQ ID NO: 91208 - protein, 222 aa, Homo sapiens
  Payload ID: 18238
  Gene Name: transmembrane protein 151B
  Uniprot ID: Q8IW70
  ENSP ID: ENSP00000409337
MSPPGSAAGESAAGGGGGGGGPGVSEELTAAAAAAAADEGPAREEQRPIQPSFTKSLCRESHWKCLLLSLLMYGCLGAVAWCHVTTVTRLTFSSAYQGNSLMYHDSPCSNGYVYIPLAFLLMLYAVYLVECWHCQARHELQHRVDVSSVRERVGRMQQATPCIWWKAISYHYVRRTRQVTRYRNGDAYTTTQVPGCLGSQVVPLRSPWRNAQLDAGSDEEPA

SEQ ID NO: 91209 - protein, 183 aa, Homo sapiens
  Payload ID: 18239
  Gene Name: transmembrane protein 154
  Uniprot ID: Q6P9G4
  ENSP ID: ENSP00000302144
MQAPRAALVFALVIALVPVGRGNYEELENSGDTTVESERPNKVTIPSTFAAVTIKETLNANINSTNFAPDENQLEFILMVLIPLILLVLLLLSVVFLATYYKRKRTKQEPSSQGSQSALQTYELGSENVKVPIFEEDTPSVMEIEMEELDKWMNSMNRNADFECLPTLKEEKESNHNPSDSES

SEQ ID NO: 91210 - protein, 125 aa, Homo sapiens
  Payload ID: 18239
  Gene Name: transmembrane protein 154
  ENSP ID: ENSP00000422156
MQAPRAALVFALVIALVPVGRGNYEELENSGDTTVESERPNKVTIPSTFAAVTIKETLNANINSTNFAPDENQLEFILMVLIPLILLVLLLLSVVFLATYYKRKRTKQEPSSQGSQSALQTYLLV

SEQ ID NO: 91211 - protein, 162 aa, Homo sapiens [sequence omitted]

SEQ ID NO: 91212 - protein, 130 aa, Homo sapiens
  Payload ID: 18240
  Gene Name: transmembrane protein 155
  Uniprot ID: Q4W5P6
  ENSP ID: ENSP00000336987
MASDLIRTILAVALISKLGTAVDAELMPSGAILQNKRENLPRVCHALAFLGMARCQDLFLVRLQGWKLGTRFQDGPRSTPQEEGGSPQRKRGMPVQIHFLLKSFLSSPITFAFISLARTVSLATAICKIV

SEQ ID NO: 91213 - protein, 130 aa, Homo sapiens; identical to SEQ ID NO: 91212
  Payload ID: 18240
  Gene Name: transmembrane protein 155
  Uniprot ID: Q4W5P6
  ENSP ID: ENSP00000377917

SEQ ID NO: 91214 - protein, 130 aa, Homo sapiens; identical to SEQ ID NO: 91212
  Payload ID: 18240
  Gene Name: transmembrane protein 155
  Uniprot ID: Q4W5P6
  ENSP ID: ENSP00000377919

SEQ ID NO: 91215 - protein, 70 aa, Homo sapiens
  Payload ID: 18240
  Gene Name: transmembrane protein 155
  ENSP ID: ENSP00000422869
MASDLIRTILAVALISKLGTAVDAELMPSGAILQNKRENLPRVCHALAFLGMARCQDLFLVRLQGWKLGT

SEQ ID NO: 91216 - protein, 179 aa, Homo sapiens
  Payload ID: 18241
  Gene Name: transmembrane protein 156
  ENSP ID: ENSP00000343758
MTKTALLKLFVAIVITFILILPEYFKTPKERTLELSCLEVCLQSNFTYSLSSLNFSFVTFLQPVRETQIIMRIFLNPSNFRNFTRTCQDITVLIRRGSMEVKANDFHSPCQHFNFSVAPLVDHLEEYNTTCHLKNHTGRSTIMEDEPSKEKSINYTCRIMEYPNDCIHISLHLEMDIKS

SEQ ID NO: 91217 - protein, 296 aa, Homo sapiens
  Payload ID: 18241
  Gene Name: transmembrane protein 156
  Uniprot ID: Q8N614
  ENSP ID: ENSP00000371364
MTKTALLKLFVAIVITFILILPEYFKTPKERTLELSCLEVCLQSNFTYSLSSLNFSFVTFLQPVRETQIIMRIFLNPSNFRNFTRTCQDITGEFKMCSSCLVCESKGNMDFISQEQTSKVLIRRGSMEVKANDFHSPCQHFNFSVAPLVDHLEEYNTTCHLKNHTGRSTIMEDEPSKEKSINYTCRIMEYPNDCIHISLHLEMDIKNITCSMKITWYILVLLVFIFLIILTIRKILEGQRRVQKWQSHRDKPTSVLLRGSDSEKLRALNVQVLSAETTQRLPLDQVQEVLPPIPEL

SEQ ID NO: 91218 - protein, 300 aa, Homo sapiens
  Payload ID: 18242
  Gene Name: transmembrane protein 158 (gene/pseudogene)
  Uniprot ID: Q8WZ71
  ENSP ID: ENSP00000422431
MLPLLAALLAAACPLPPVRGGAADAPGLLGVPSNASVNASSADEPIAPRLLASAAPGPPERPGPEEAAAAAAPCNISVQRQMLSSLLVRWGRPRGFQCDLLLFSTNAHGRAFFAAAFHRVGPPLLIEHLGLAAGGAQQDLRLCVGCGWVRGRRTGRLRPAAAPSAAAATAGAPTALPAYPAAEPPGPLWLQGEPLHFCCLDFSLEELQGEPGWRLNRKPIESTLVACFMTLVIVVWSVAALIWPVPIIAGFLPNGMEQRRTTASTTAATPAAVPAGTTAAAAAAAAAAAAAAVTSGVATK

SEQ ID NO: 91219 - protein, 161 aa, Homo sapiens
  Payload ID: 18243
  Gene Name: transmembrane protein 159
  Uniprot ID: Q96B96
  ENSP ID: ENSP00000233047
MAKEEPQSISRDLQELQKKLSLLIDSFQNNSKVVAFMKSPVGQYLDSHPFLAFTLLVFIVMSAVPVGFFLLIVVLTTLAALLGVIILEGLVISVGGFSLLCILCGLGFVSLAMSGMMIASYVVVSSLISCWFSPRPLTQQNTSCDFLPAMKSAEFEGLYQE

SEQ ID NO: 91220 - protein, 161 aa, Homo sapiens; identical to SEQ ID NO: 91219
  Payload ID: 18243
  Gene Name: transmembrane protein 159
  Uniprot ID: Q96B96
  ENSP ID: ENSP00000261388

SEQ ID NO: 91221 - protein, 185 aa, Homo sapiens
  Payload ID: 18243
  Gene Name: transmembrane protein 159
  Uniprot ID: Q96B96
  ENSP ID: ENSP00000409879
MAKEEPQSISRDLQELQKKLSLLIDSFQNNSKLPQHSRISLDSDDGVSRLGSAGSKVVAFMKSPVGQYLDSHPFLAFTLLVFIVMSAVPVGFFLLIVVLTTLAALLGVIILEGLVISVGGFSLLCILCGLGFVSLAMSGMMIASYVVVSSLISCWFSPRPLTQQNTSCDFLPAMKSAEFEGLYQE

SEQ ID NO: 91222 - protein, 90 aa, Homo sapiens
  Payload ID: 18243
  Gene Name: transmembrane protein 159
  ENSP ID: ENSP00000459481
MAKEEPQSISRDLQELQKKLSLLIDSFQNNSKVVAFMKSPVGQYLDSHPFLAFTLLVFIVMSAVPVGFFLLIVVLTTLAALLGVIILEGH

SEQ ID NO: 91223 - protein, 98 aa, Homo sapiens
  Payload ID: 18243
  Gene Name: transmembrane protein 159
  ENSP ID: ENSP00000460102
  MOD_RES (1)..(1): Any amino acid
XLDSHPFLAFTLLVFIVMSAVPVGFFLLIVVLTTLAALLGVIILEGLVISVGGFSLLCILCGLGFVSLAMSGMMIASYVVVSSLISCWFSPRSLSYLP

SEQ ID NO: 91224 - protein, 161 aa, Homo sapiens; identical to SEQ ID NO: 91219
  Payload ID: 18243
  Gene Name: transmembrane protein 159
  Uniprot ID: Q96B96
  ENSP ID: ENSP00000460687

SEQ ID NO: 91225 - protein, 46 aa, Homo sapiens
  Payload ID: 18243
  Gene Name: transmembrane protein 159
  ENSP ID: ENSP00000461826
MAKEEPQSISRDLQELQKKLSLLIDSFQNNSKLPQHSRISLDSDDG

SEQ ID NO: 91226 - protein, 163 aa, Homo sapiens
  Payload ID: 18243
  Gene Name: transmembrane protein 159
  ENSP ID: ENSP00000461828
MAKEEPQSISRDLQELQKKLSLLIDSFQNNSKLPQHSRISLDSDDGVSRLGSAGSKVVAFMKSPVGQYLDSHPFLAFTLLVFIVMSAVPVGFFLLIVVLTTLAALLGVIILEGLVISVGGFSLLCILCGLGFVSLAMSGMMIASYVVVSSLISCWFSPRSHEI

SEQ ID NO: 91227 - protein, 188 aa, Homo sapiens
  Payload ID: 18244
  Gene Name: transmembrane protein 160
  Uniprot ID: Q9NX00
  ENSP ID: ENSP00000253047
MGGGWWWARAARLARLRFRRSLLPPQRPRSGGARGSFAPGHGPRAGASPPPVSELDRADAWLLRKAHETAFLSWFRNGLLASGIGVISFMQSDMGREAAYGFFLLGGLCVVWGSASYAVGLAALRGPMQLTLGGAAVGAGAVLAASLLWACAVGLYMGQLELDVELVPEDDGTASAEGPDEAGRPPPE

SEQ ID NO: 91228 - protein, 479 aa, Homo sapiens
  Payload ID: 18245
  Gene Name: transmembrane protein 161A
  Uniprot ID: Q9NX61
  ENSP ID: ENSP00000162044
MAVLGVQLVVTLLTATLMHRLAPHCSFARWLLCNGSLFRYKHPSEEELRALAGKPRPRGRKERWANGLSEEKPLSVPRDAPFQLETCPLTTVDALVLRFFLEYQWFVDFAVYSGGVYLFTEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 91229 - protein, 376 aa, Homo sapiens
  Payload ID: 18245
  Gene Name: transmembrane protein 161A
  Uniprot ID: Q9NX61
  ENSP ID: ENSP00000404208
MAVLGVQLVVTLLTATLMHRLAPHCSFARWLLCNGSLFRYKHPSEEELRALAGKPRPRGRKERWANGLSEEKPLSVPRDAPFQLETCPLTTVDALGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 91230 - protein, 40 aa, Homo sapiens
  Payload ID: 18245
  Gene Name: transmembrane protein 161A
  ENSP ID: ENSP00000465215
MAVLGVQLVVTLLTATLMHRLAPHCSFARWLLCNGRLPSN

SEQ ID NO: 91231 - protein, 194 aa, Homo sapiens
  Payload ID: 18245
  Gene Name: transmembrane protein 161A
  ENSP ID: ENSP00000465840
ETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQLSDSAFDSGRLWLLVVLCLLRLAVTRPHLQAYLCLAKARVEQLRREAGRIEAREIQQR

SEQ ID NO: 91232 - protein, 454 aa, Homo sapiens
  Payload ID: 18245
  Gene Name: transmembrane protein 161A
  ENSP ID: ENSP00000467300
MAVLGVQLVVTLLTATLMHRLAPHCSFARWLLCNGSLFRYKHPSEEELRALAGKPRPRGRKERWANGLSEEKPLSVPRDAPFQLETCPLTTVDALEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 91233 - protein, 315 aa, Homo sapiens
  Payload ID: 18245
  Gene Name: transmembrane protein 161A
  ENSP ID: ENSP00000467649
MHRLAPHCSFARWLLCNGSLFRYKHPSEEELRALAGKPRPRGRKERWANGLSEEKPLSVPRDAPFQLETCPLTTVDALVLRFFLEYQWFVDFAVYSGGVYLFTEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRP

SEQ ID NO: 91234 - protein, 145 aa, Homo sapiens
  Payload ID: 18245
  Gene Name: transmembrane protein 161A
  ENSP ID: ENSP00000467793
MHRLAPHCSFARWLLCNGSLFRYKHPSEEELRALAGKPRPRGRKERWANGLSEEKPLSVPRDAPFQLETCPLTTVDALVLRFFLEYQWFVDFAVYSGGVYLFTEAYYYMLGPAKETNIAVFWCLLTVTFSIKMFLTVTRLYFSAE

SEQ ID NO: 91235 - protein, 325 aa, Homo sapiens
  Payload ID: 18245
  Gene Name: transmembrane protein 161A
  ENSP ID: ENSP00000476205
MAVLGVQLVVTLLTATLMHRLAPHCSFARWLLCNGSLFRYKHPSEEELRALAGKPRPRGRKERWANGLSEEKPLSVPRDAPFQLETCPLTTVDALVLRFFLEYQWFVDFAVYSGGVYLFTEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRCPILPSTLGASGCWWCCACCGWR

SEQ ID NO: 91236 - protein, 61 aa, Homo sapiens
  Payload ID: 18245
  Gene Name: transmembrane protein 161A
  ENSP ID: ENSP00000476977
MLGPAKETNIAVFWCLLTVTFSIKMFLTVTRLYFSAEEGGERSVCLTFAFLFLLLAMLVQV

SEQ ID NO: 91237 - protein, 487 aa, Homo sapiens
  Payload ID: 18246
  Gene Name: transmembrane protein 161B
  Uniprot ID: Q8NDZ6
  ENSP ID: ENSP00000296595
MGVIGIQLVVTMVMASVMQKIIPHYSLARWLLCNGSLRWYQHPTEEELRILAGKQQKGKTKKDRKYNGHIESKPLTIPKDIDLHLETKSVTEVDTLALHYFPEYQWLVDFTVAATVVYLVTEVYYNFMKPTQEMNISLVWCLLVLSFAIKVLFSLTTHYFKVEDGGERSVCVTFGFFFFVKAMAVLIVTENYLEFGLETGFTNFSDSAMQFLEKQGLESQSPVSKLTFKFFLAIFCSFIGAFLTFPGLRLAQMHLDALNLATEKITQTLLHINFLAPLFMVLLWVKPITKDYIMNPPLGKESIPLMTEATFDTLRLWLIILLCALRLAMMRSHLQAYLNLAQKCVDQMKKEAGRISTVELQKMVARVFYYLCVIALQYVAPLVMLLHTTLLLKTLGNHSWGIYPESISTLPVDNSLLSNSVYSELPSAEGKMKVTVTQITVALSSLKNIFTPLLFRGLLSFLTWWIAACLFSTSLFGLFYHQYLTVA

SEQ ID NO: 91238 - protein, 476 aa, Homo sapiens
  Payload ID: 18246
  Gene Name: transmembrane protein 161B
  ENSP ID: ENSP00000421498
MVMASVMQKIIPHYSLARWLLCNGSLRWYQHPTEEELRILAGKQQKGKTKKDRKYNGHIESKPLTIPKDIDLHLETKSVTEVDTLALHYFPEYQWLVDFTVAATVVYLVTEVYYNFMKPTQEMNISLVWCLLVLSFAIKVLFSLTTHYFKVEDGGERSVCVTFGFFFFVKAMAVLIVTENYLEFGLETGFTNFSDSAMQFLEKQGLESQSPVSKLTFKFFLAIFCSFIGAFLTFPGLRLAQMHLDALNLATEKITQTLLHINFLAPLFMVLLWVKPITKDYIMNPPLGKESIPLMTEATFDTLRLWLIILLCALRLAMMRSHLQAYLNLAQKCVDQMKKEAGRISTVELQKMVARVFYYLCVIALQYVAPLVMLLHTTLLLKTLGNHSWGIYPESISTLPVDNSLLSNSVYSELPSAEGKMKVTVTQITVALSSLKNIFTPLLFRGLLSFLTWWIAACLFSTSLFGLFYHQYLTVA

SEQ ID NO: 91239 - protein, 217 aa, Homo sapiens
  Payload ID: 18246
  Gene Name: transmembrane protein 161B
  ENSP ID: ENSP00000421733
MAVLIVTENYLEFGLETGFTNFSDSAMQFLEKQGLESQSPVSKLTFKFFLAIFCSFIGAFLTFPGLRLAQMHLDALNLATEKITQTLLHINFLAPLFMVLLWVKPITKDYIMNPPLGKESIPLMTEATFDTLRLWLIILLCALRLAMMRSHLQAYLNLAQKCVDQMKKEAGRISTVELQKMVIIPGVFIQNLSLPYQWIIVYCPILFTLNYHQLKGK

SEQ ID NO: 91240 - protein, 121 aa, Homo sapiens
  Payload ID: 18246
  Gene Name: transmembrane protein 161B
  ENSP ID: ENSP00000421805
MGVIGIQLVVTMVMASVMQKIIPHYSLARWLLCNGSLRWYQHPTEEELRILAGKQQKGKTKKDRKYNGHIESKPLTIPKDIDLHLETKSVTEVDTLGGLLKNDVDVLDYTLVEVNQNTYAT

SEQ ID NO: 91241 - protein, 140 aa, Homo sapiens
  Payload ID: 18246
  Gene Name: transmembrane protein 161B
  Uniprot ID: Q8NDZ6
  ENSP ID: ENSP00000423380
MKPTQEMNISLVWCLLVLSFAIKVLFSLTTHYFKVEDGGERSVCVTFGFFFFVKAMAVLIVTENYLEFGLETGFTNFSDSAMQFLEKQGLESQSPVSKLTFKFFLAIFCSFIGAFLTFPGLRLAQMHLDALNLATEKITQ

SEQ ID NO: 91242 - protein, 178 aa, Homo sapiens
  Payload ID: 18246
  Gene Name: transmembrane protein 161B
  ENSP ID: ENSP00000424200
MKPTQEMNISLVWCLLVLSFAIKVLFSLTTHYFKVEDGGERSVCVTFGFFFFVKAMAVLIVTENYLEFGLETGFTNFSDSAMQFLEKQGLESQSPVSKLTFKFFLAIFCSFIGAFLTFPGLRLAQMHLDALNLATEKITQTLLHINFLAPLFMVLLWVKPITKDYIMNPPLGKESIPL

SEQ ID NO: 91243 - protein, 278 aa, Homo sapiens
  Payload ID: 18246
  Gene Name: transmembrane protein 161B
  ENSP ID: ENSP00000425991
MAVLIVTENYLEFGLETGFTNFSDSAMQFLEKQGLESQSPVSKLTFKFFLAIFCSFIGAFLTFPGLRLAQMHLDALNLATEKITQTLLHINFLAPLFMVLLWVKPITKDYIMNPPLGKESIPFHLQAYLNLAQKCVDQMKKEAGRISTVELQKMVARVFYYLCVIALQYVAPLVMLLHTTLLLKTLGNHSWGIYPESISTLPVDNSLLSNSVYSELPSAEGKMKVTVTQITVALSSLKNIFTPLLFRGLLSFLTWWIAACLFSTSLFGLFYHQYLTVA

SEQ ID NO: 91244 - protein, 502 aa, Homo sapiens
  Payload ID: 18246
  Gene Name: transmembrane protein 161B
  ENSP ID: ENSP00000426354
MGVIGIQLVVTMVMASVMQKIIPHYSLARWLLCNGSLRWYQHPTEEELRILAGKQQKGKTKKDRKYNGHIESKPLTIPKDIDLHLETKSVTEVDTLALHYFPEYQWLVDFTVAATVVYLVTEVYYNFMKPTQEMNISLVWCLLVLSFAIKVLFSLTTHYFKVEDGGERSVCVTFGFFFFVKAMAVLIVTENYLEFGLETGFTNFSDSAMQFLEKQGLESQSPVSKLTFKFFLAIFCSFIGAFLTFPGLRLAQMHLDALNLATEKITQTLLHINFLAPLFMVLLWVKPITKDYIMNPPLGKESIPLMTEATFDTLRLWLIILLCALRLAMMRSHLQAYLNLAQKCVDQMKKEAGRISTVELQKMVARVFYYLCVIALQYVAPLVMLLHTTLLLKTLGNHSWGIYPESISTLPVDNSLLSNSVYSELPSAEGKMKHNARQGPAVPPGMQAYGAAPFEDLQLDFTEMPKCGGNKYLLVLVCTFSGWVEAYPTRTEKACEITHVLL

SEQ ID NO: 91245 - protein, 153 aa, Homo sapiens
  Payload ID: 18246
  Gene Name: transmembrane protein 161B
  ENSP ID: ENSP00000427312
MGVIGIQLVVTMVMASVMQKIIPHYSLARWLLCNGSLRWYQHPTEEELRILAGKQQKGKTKKDRKYNGHIESKPLTIPKDIDLHLETKSVTEVDTLALHYFPEYQWLVDFTVAATVVYLVTEVYYNFMKPTQEMNISLVWCLLVLSFAIRRWW

SEQ ID NO: 91246 - protein, 289 aa, Homo sapiens
  Payload ID: 18247
  Gene Name: transmembrane protein 163
  Uniprot ID: Q8TC26
  ENSP ID: ENSP00000281924
MEPAAGIQRRSSQGPTVPPPPRGHAPPAAAPGPAPLSSPVREPPQLEEERQVRISESGQFSDGLEDRGLLESSTRLKPHEAQNYRKKALWVSWFSIIVTLALAVAAFTVSVMRYSASAFGFAFDAILDVLSSAIVLWRYSNAAAVHSAHREYIACVILGVIFLLSSICIVVKAIHDLSTRLLPEVDDFLFSVSILSGILCSILAVLKFMLGKVLTSRALITDGFNSLVGGVMGFSILLSAEVFKHDSAVWYLDGSIGVLIGLTIFAYGVKLLIDMVPRVRQTRHYEMFE

SEQ ID NO: 91247 - protein, 258 aa, Homo sapiens
  Payload ID: 18248
  Gene Name: transmembrane protein 164
  ENSP ID: ENSP00000288381
MSRYSYQSLLDWLYGGVDPSFAGNGGPDCAAFLSWQQRLLESVVVLTLALLEILVALRHILRQTKEDGRGSPGSQPEQVTQRPEEGKESLSKNLLLVALCLTFGVEVGFKFATKTVIYLLNPCHLVTMMHLPFELEIYYIQHVMLYVVPIYLLWKGGAYTPEPLSSFRWALLSTGLMFFYHFSVLQILGLVTEVNLNNMLCPAISDPFYGPWYRIWASGHQTLMTMTHGKLVILFSYMAGPLCKYLLDLLRLPAKKID

SEQ ID NO: 91248 - protein, 297 aa, Homo sapiens [sequence omitted]

SEQ ID NO: 91249 - protein, 297 aa, Homo sapiens [sequence omitted]

SEQ ID NO: 91250 - protein, 148 aa, Homo sapiens
  Payload ID: 18248
  Gene Name: transmembrane protein 164
  Uniprot ID: Q5U3C3
  ENSP ID: ENSP00000384075
MHMLNGALLALLFPVVNTRLLPFELEIYYIQHVMLYVVPIYLLWKGGAYTPEPLSSFRWALLSTGLMFFYHFSVLQILGLVTEVNLNNMLCPAISDPFYGPWYRIWASGHQTLMTMTHGKLVILFSYMAGPLCKYLLDLLRLPAKKID

SEQ ID NO: 91251 - protein, 324 aa, Homo sapiens
  Payload ID: 18249
  Gene Name: transmembrane protein 165
  Uniprot ID: Q9HC07
  ENSP ID: ENSP00000370736
MAAAAPGNGRASAPRLLLLFLVPLLWAPAAVRAGPDEDLSHRNKEPPAPAQQLQPQPVAVQGPEPARVEKIFTPAAPVHTNKEDPATQTNLGFIHAFVAAISVIIVSELGDKTFFIAAIMAMRYNRLTVLAGAMLALGLMTCLSVLFGYATTVIPRVYTYYVSTVLFAIFGIRMLREGLKMSPDEGQEELEEVQAELKKKDEEFQRTKLLNGPGDVETGTSITVPQKKWLHFISPIFVQALTLTFLAEWGDRSQLTTIVLAAREDPYGVAVGGTVGHCLCTGLAVIGGRMIAQKISVRTVTIIGGIVFLAFAFSALFISPDSGF

SEQ ID NO: 91252 - protein, 76 aa, Homo sapiens
  Payload ID: 18249
  Gene Name: transmembrane protein 165
  ENSP ID: ENSP00000422639
MAAAAPGNGRASAPRLLLLFLVPLLWAPAAVRAGPDEDLSHRNKEPPAPAQQLQPQPVAVQGPEPARVEGHQFFSW

SEQ ID NO: 91253 - protein, 129 aa, Homo sapiens
  Payload ID: 18249
  Gene Name: transmembrane protein 165
  ENSP ID: ENSP00000425449
MAAAAPGNGRASAPRLLLLFLVPLLWAPAAVRAGPDEDLSHRNKEPPAPAQQLQPQPVAVQGPEPARVEDPYGVAVGGTVGHCLCTGLAVIGGRMIAQKISVRTVTIIGGIVFLAFAFSALFISPDSGF

SEQ ID NO: 91254 - protein, 158 aa, Homo sapiens
  Payload ID: 18249
  Gene Name: transmembrane protein 165
  ENSP ID: ENSP00000476531
  MOD_RES (1)..(1): Any amino acid
XVLFAIFGIRMLREGLKMSPDEGQEELEEVQAELKKKDEEFQRTKLLNGPGDVETGTSITVPQKKWLHFISPIFVQALTLTFLAEWGDRSQLTTIVLAAREDPYGVAVGGTVGHCLCTGLAVIGGRMIAQKISVRTGSFSPWLILHACSDGKGHLERN

SEQ ID NO: 91255 - protein, 27 aa, Homo sapiens
  Payload ID: 18249
  Gene Name: transmembrane protein 165
  ENSP ID: ENSP00000476621
  MOD_RES (1)..(1): Any amino acid
XLTFLAEWGDRSQLTTIVLAAREVSDI

SEQ ID NO: 91256 - protein, 72 aa, Homo sapiens
  Payload ID: 18250
  Gene Name: transmembrane protein 167A
  Uniprot ID: Q8TBQ9
  ENSP ID: ENSP00000424707
MSAIFNFQSLLTVILLLICTCAYIRSLAPSLLDRNKTGLLGIFWKCARIGERKSPYVAVCCIVMAFSILFIQ

SEQ ID NO: 91257 - protein, 74 aa, Homo sapiens
  Payload ID: 18251
  Gene Name: transmembrane protein 167B
  Uniprot ID: Q9NRX6
  ENSP ID: ENSP00000342148
MTNVYSLDGILVFGLLFVCTCAYFKKVPRLKTWLLSEKKGVWGVFYKAAVIGTRLHAAVAIACVVMAFYVLFIK

SEQ ID NO: 91258 - protein, 697 aa, Homo sapiens
  Payload ID: 18252
  Gene Name: transmembrane protein 168
  Uniprot ID: Q9H0V1
  ENSP ID: ENSP00000323068
MCKSLRYCFSHCLYLAMTRLEEVNREVNMHSSVRYLGYLARINLLVAICLGLYVRWEKTANSLILVIFILGLFVLGIASILYYYFSMEAASLSLSNLWFGFLLGLLCFLDNSSFKNDVKEESTKYLLLTSIVLRILCSLVERISGYVRHRPTLLTTVEFLELVGFAIASTTMLVEKSLSVILLVVALAMLIIDLRMKSFLAIPNLVIFAVLLFFSSLETPKNPIAFACFFICLITDPFLDIYFSGLSVTERWKPFLYRGRICRRLSVVFAGMIELTFFILSAFKLRDTHLWYFVIPGFSIFGIFWMICHIIFLLTLWGFHTKLNDCHKVYFTHRTDYNSLDRIMASKGMRHFCLISEQLVFFSLLATAILGAVSWQPTNGIFLSMFLIVLPLESMAHGLFHELGNCLGGTSVGYAIVIPTNFCSPDGQPTLLPPEHVQELNLRSTGMLNAIQRFFAYHMIETYGCDYSTSGLSFDTLHSKLKAFLELRTVDGPRHDTYILYYSGHTHGTGEWALAGGDTLRLDTLIEWWREKNGSFCSRLIIVLDSENSTPWVKEVRKINDQYIAVQGAELIKTVDIEEADPPQLGDFTKDWVEYNCNSSNNICWTEKGRTVKAVYGVSKRWSDYTLHLPTGSDVAKHWMLHFPRITYPLVHLANWLCGLNLFWICKTCFRCLKRLKMSWFLPTVLDTGQGFKLVKS

SEQ ID NO: 91259 - protein, 697 aa, Homo sapiens; identical to SEQ ID NO: 91258
  Payload ID: 18252
  Gene Name: transmembrane protein 168
  Uniprot ID: Q9H0V1
  ENSP ID: ENSP00000390696

SEQ ID NO: 91260 - protein, 258 aa, Homo sapiens
  Payload ID: 18252
  Gene Name: transmembrane protein 168
  ENSP ID: ENSP00000404253
FFSLLATAILGAVSWQPTNGIFLSMFLIVLPLESMAHGLFHELGNCLGGTSVGYAIVIPTNFCSGHTHGTGEWALAGGDTLRLDTLIEWWREKNGSFCSRLIIVLDSENSTPWVKEVRKINDQYIAVQGAELIKTVDIEEADPPQLGDFTKDWVEYNCNSSNNICWTEKGRTVKAVYGVSKRWSDYTLHLPTGSDVAKHWMLHFPRITYPLVHLANWLCGLNLFWICKTCFRCLKRLKMSWFLPTVLDTGQGFKLVKS

SEQ ID NO: 91261 - protein, 124 aa, Homo sapiens
  Payload ID: 18252
  Gene Name: transmembrane protein 168
  ENSP ID: ENSP00000407373
MFLIVLPLESMAHGLFHELGNCLGGTSVGYAIVIPTNFCSPDGQPTLLPPEHVQELNLRSTGMLNAIQRFFAYHMIETYGCDYSTSGLSFDTLHSKLKAFLELRTVDGPRHDTYILYYSGHTHG

SEQ ID NO: 91262 - protein, 313 aa, Homo sapiens
  Payload ID: 18252
  Gene Name: transmembrane protein 168
  Uniprot ID: Q9H0V1
  ENSP ID: ENSP00000410307
MFLIVLPLESMAHGLFHELGNCLGGTSVGYAIVIPTNFCSPDGQPTLLPPEHVQELNLRSTGMLNAIQRFFAYHMIETYGCDYSTSGLSFDTLHSKLKAFLELRTVDGPRHDTYILYYSGHTHGTGEWALAGGDTLRLDTLIEWWREKNGSFCSRLIIVLDSENSTPWVKEVRKINDQYIAVQGAELIKTVDIEEADPPQLGDFTKDWVEYNCNSSNNICWTEKGRTVKAVYGVSKRWSDYTLHLPTGSDVAKHWMLHFPRITYPLVHLANWLCGLNLFWICKTCFRCLKRLKMSWFLPTVLDTGQGFKLVKS

SEQ ID NO: 91263 - protein, 112 aa, Homo sapiens
  Payload ID: 18252
  Gene Name: transmembrane protein 168
  ENSP ID: ENSP00000412462
MRHFCLISEQLVFFSLLATAILGAVSWQPTNGIFLSMFLIVLPLESMAHGLFHELGNCLGGTSVGYAIVIPTNFCSPDGQPTLLPPEHVQELNLRSTGMLNAIQRFFAYHMI

SEQ ID NO: 91264 - protein, 297 aa, Homo sapiens
  Payload ID: 18253
  Gene Name: transmembrane protein 169
  Uniprot ID: Q96HH4
  ENSP ID: ENSP00000295658
MEEPTAVEGQVQLPSPHQGSLRKAVAAALALDGESTMGHRKKKRKESRPESIIIYRSDNEKTDEEPGESEGGDQPKEEEGDDFLDYPVDDDMWNLPLDSRYVTLTGTITRGKKKGQMVDIHVTLTEKELQELTKPKESSRETTPEGRMACQMGADRGPHVVLWTLICLPVVFILSFVVSFYYGTITWYNIFLVYNEERTFWHKISYCPCLVLFYPVLIMAMASSLGLYAAVVQLSWSWEAWWQAARDMEKGFCGWLCSKLGLEDCSPYSIVELLESDNISSTLSNKDPIQEVETSTV

SEQ ID NO: 91265 - protein, 297 aa, Homo sapiens; identical to SEQ ID NO: 91264
  Payload ID: 18253
  Gene Name: transmembrane protein 169
  Uniprot ID: Q96HH4
  ENSP ID: ENSP00000384100

SEQ ID NO: 91266 - protein, 116 aa, Homo sapiens
  Payload ID: 18253
  Gene Name: transmembrane protein 169
  ENSP ID: ENSP00000400798
MEEPTAVEGQVQLPSPHQGSLRKAVAAALALDGESTMGHRKKKRKESRPESIIIYRSDNEKTDEEPGESEGGDQPKEEEGDDFLDYPVDDDMWNLPLDSRYVTLTGTITRGKKKGQ

SEQ ID NO: 91267 - protein, 297 aa, Homo sapiens; identical to SEQ ID NO: 91264
  Payload ID: 18253
  Gene Name: transmembrane protein 169
  Uniprot ID: Q96HH4
  ENSP ID: ENSP00000401305

SEQ ID NO: 91268 - protein, 297 aa, Homo sapiens; identical to SEQ ID NO: 91264
  Payload ID: 18253
  Gene Name: transmembrane protein 169
  Uniprot ID: Q96HH4
  ENSP ID: ENSP00000412524

SEQ ID NO: 91269 - protein, 101 aa, Homo sapiens
  Payload ID: 18253
  Gene Name: transmembrane protein 169
  ENSP ID: ENSP00000413257
MEEPTAVEGQVQLPSPHQGSLRKAVAAALALDGESTMGHRKKKRKESRPESIIIYRSDNEKTDEEPGESEGGDQPKEEEGDDFLDYPVDDDMWNLPLDSRY

SEQ ID NO: 91270 - protein, 198 aa, Homo sapiens
  Payload ID: 18254
  Gene Name: transmembrane protein 17
  Uniprot ID: Q86X19
  ENSP ID: ENSP00000335094
MELPDPVRQRLGNFSRAVFSDSNRTGPESNEGPENEMVSSLALQMSLYFNTYYFPLWWVSSIMMLHMKYSILPDYYKFIVITVIILITLIEAIRLYLGYVGNLQEKVPELAGFWLLSLLLQLPLILFLLFNEGLTNLPLEKAIHIIFTLFLAFQVVAAFLTLRKMVNQLAVRFHLQDFDRLSANRGDMRRMRSCIEEI

SEQ ID NO: 91271 - protein, 121 aa, Homo sapiens
  Payload ID: 18255
  Gene Name: transmembrane protein 170A
  Uniprot ID: Q8WVE7
  ENSP ID: ENSP00000350230
MEREGSGGSGGSAGLLQQILSLKVVPRVGNGTLCPNSTSLCSFPEMWYGVFLWALVSSLFFHVPAGLLALFTLRHHKYGAAIAGVYRAAGKEMIPFEALTLGTGQTFCVLVVSFLRILATL

SEQ ID NO: 91272 - protein, 144 aa, Homo sapiens
  Payload ID: 18255
  Gene Name: transmembrane protein 170A
  Uniprot ID: Q8WVE7
  ENSP ID: ENSP00000454404
MEREGSGGSGGSAGLLQQILSLKVVPRVGNGTLCPNSTSLCSFPEMWYGVFLWALVSSLFFHVPAGLLALFTLRHHKYGRFMSVSILLMGIVGPITAGILTSAAIAGVYRAAGKEMIPFEALTLGTGQTFCVLVVSFLRILATL

SEQ ID NO: 91273 - protein, 121 aa, Homo sapiens; identical to SEQ ID NO: 91271
  Payload ID: 18255
  Gene Name: transmembrane protein 170A
  Uniprot ID: Q8WVE7
  ENSP ID: ENSP00000454552

SEQ ID NO: 91274 - protein, 106 aa, Homo sapiens
  Payload ID: 18255
  Gene Name: transmembrane protein 170A
  ENSP ID: ENSP00000455491
MQRAAAEMWYGVFLWALVSSLFFHVPAGLLALFTLRHHKYGRFMSVSILLMGIVGPITAGILTSAAIAGVYRAAGKEMIPFEALTLGTGQTFCVLVVSFLRILATL

SEQ ID NO: 91275 - protein, 113 aa, Homo sapiens
  Payload ID: 18255
  Gene Name: transmembrane protein 170A
  ENSP ID: ENSP00000455938
MEREGSGGSGGSAGLLQQILSLKVVPRVGNGTLCPNSTSLCSFPEMWYGVFLWALVSSLFFHVPAGLLALFTLRHHKYGRFMSVSILLMGIVGPITAGILTSMLDIKIPVKNV

SEQ ID NO: 91276 - protein, 76 aa, Homo sapiens
  Payload ID: 18255
  Gene Name: transmembrane protein 170A
  ENSP ID: ENSP00000456194
MWYGVFLWALVSSLFFHVPAGLLALFTLRHHKYGAAIAGVYRAAGKEMIPFEALTLGTGQTFCVLVVSFLRILATL

SEQ ID NO: 91277 - protein, 99 aa, Homo sapiens
  Payload ID: 18255
  Gene Name: transmembrane protein 170A
  ENSP ID: ENSP00000456509
MWYGVFLWALVSSLFFHVPAGLLALFTLRHHKYGRFMSVSILLMGIVGPITAGILTSAAIAGVYRAAGKEMIPFEALTLGTGQTFCVLVVSFLRILATL

SEQ ID NO: 91278 - protein, 132 aa, Homo sapiens
  Payload ID: 18256
  Gene Name: transmembrane protein 170B
  Uniprot ID: Q5T4T1
  ENSP ID: ENSP00000368737
MKAEGGDHSMINLSVQQVLSLWAHGTVLRNLTEMWYWIFLWALFSSLFVHGAAGVLMFVMLQRHRQGRVISVIAVSIGFLASVTGAMITSAAVAGIYRVAGKNMAPLEALVWGVGQTVLTLIISFSRILATL

SEQ ID NO: 91279 - protein, 323 aa, Homo sapiens
  Payload ID: 18257
  Gene Name: transmembrane protein 171
  Uniprot ID: Q8WVE6
  ENSP ID: ENSP00000287773
MSPAAAAEPDGDQQDRHVSKLIFCFFVFGAVLLCVGVLLSIFGFQACQYKPLPDCPMVLKVAGPACAVVGLGAVILARSRAQLQLRAGLQRGQQMDPDRAFICGESRQFAQCLIFGFLFLTSGMLISVLGIWVPGCGSNWAQEPLNETDTGDSEPRMCGFLSLQIMGPLIVLVGLCFFVVAHVKKRNTLNAGQDASEREEGQIQIMEPVQVTVGDSVIIFPPPPPPYFPESSASAVAESPGTNSLLPNENPPSYYSIFNYGTPTSEGAASERDCESIYTISGTNSSSEASHTPHLPSELPPRYEEKENAAATFLPLSSEPSPP

SEQ ID NO: 91280 - protein, 324 aa, Homo sapiens
  Payload ID: 18257
  Gene Name: transmembrane protein 171
  Uniprot ID: Q8WVE6
  ENSP ID: ENSP00000415030
MSPAAAAEPDGDQQDRHVSKLIFCFFVFGAVLLCVGVLLSIFGFQACQYKPLPDCPMVLKVAGPACAVVGLGAVILARSRAQLQLRAGLQRGQQMDPDRAFICGESRQFAQCLIFGFLFLTSGMLISVLGIWVPGCGSNWAQEPLNETDTGDSEPRMCGFLSLQIMGPLIVLVGLCFFVVAHVKKRNTLNAGQDASEREEGQIQIMEPVQVTVGDSVIIFPPPPPPYFPESSASAVAESPGTNSLLPNENPPSYYSIFNYGRTPTSEGAASERDCESIYTISGTNSSSEASHTPHLPSELPPRYEEKENAAATFLPLSSEPSPP

SEQ ID NO: 91281 - protein, 379 aa, Homo sapiens
  Payload ID: 18258
  Gene Name: transmembrane protein 173
  Uniprot ID: Q86WV6
  ENSP ID: ENSP00000331288
MPHSSLHPSIPCPRGHGAQKAALVLLSACLVTLWGLGEPPEHTLRYLVLHLASLQLGLLLNGVCSLAEELRHIHSRYRGSYWRTVRACLGCPLRRGALLLLSIYFYYSLPNAVGPPFTWMLALLGLSQALNILLGLKGLAPAEISAVCEKGNFNVAHGLAWSYYIGYLRLILPELQARIRTYNQHYNNLLRGAVSQRLYILLPLDCGVPDNLSMADPNIRFLDKLPQQTGDHAGIKDRVYSNSIYELLENGQRAGTCVLEYATPLQTLFAMSQYSQAGFSREDRLEQAKLFCRTLEDILADAPESQNNCRLIAYQEPADDSSFSLSQEVLRHLRQEEKEEVTVGSLKTSAVPSTSTMSQEPELLISGMEKPLPLRTDFS

SEQ ID NO: 91282 - protein, 253 aa, Homo sapiens
  Payload ID: 18258
  Gene Name: transmembrane protein 173
  ENSP ID: ENSP00000427455
MPHSSLHPSIPCPRGHGAQKAALVLLSACLVTLWGLGEPPEHTLRYLVLHLASLQLGLLLNGVCSLAEELRHIHSRYRGSYWRTVRACLGCPLRRGALLLLSIYFYYSLPNAVGPPFTWMLALLGLSQALNILLGLKGLAPAEISAVCEKGNFNVAHGLAWSYYIGYLRLILPELQARIRTYNQHYNNLLRGAVSQRLYILLPLDCGVPDNLSMADPNIRFLDKLPQQTGDHAGIKDRVYSNSIYELLENGQR

SEQ ID NO: 91283 - protein, 243 aa, Homo sapiens
  Payload ID: 18259
  Gene Name: transmembrane protein 174
  Uniprot ID: Q8WUU8
  ENSP ID: ENSP00000296776
MEQGSGRLEDFPVNVFSVTPYTPSTADIQVSDDDKAGATLLFSGIFLGLVGITFTVMGWIKYQGVSHFEWTQLLGPVLLSVGVTFILIAVCKFKMLSCQLCKESEERVPDSEQTPGGPSFVFTGINQPITFHGATVVQYIPPPYGSPEPMGINTSYLQSVVSPCGLITSGGAAAAMSSPPQYYTIYPQDNSAFVVDEGCLSFTDGGNHRPNPDVDQLEETQLEEEACACFSPPPYEEIYSLPR

SEQ ID NO: 91284 - protein, 504 aa, Homo sapiens
  Payload ID: 18260
  Gene Name: transmembrane protein 175
  Uniprot ID: Q9BSA9
  ENSP ID: ENSP00000264771
MSQPRTPEQALDTPGDCPPGRRDEDAGEGIQCSQRMLSFSDALLSIIATVMILPVTHTEISPEQQFDRSVQRLLATRIAVYLMTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 91285 - protein, 162 aa, Homo sapiens
  Payload ID: 18260
  Gene Name: transmembrane protein 175
  ENSP ID: ENSP00000421750
MTFLIVTVAWAAHTRLFQVVGKTDDTLALLNLFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPL

SEQ ID NO: 91286 - protein, 422 aa, Homo sapiens
  Payload ID: 18260
  Gene Name: transmembrane protein 175
  ENSP ID: ENSP00000423669
MTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 91287 - protein, 72 aa, Homo sapiens
  Payload ID: 18260
  Gene Name: transmembrane protein 175
  ENSP ID: ENSP00000423751
MSQPRTPEQALDTPGDCPPGRRDEDAGEGIQCSQRMLSFSDALLSIIATVMILPVTHTEISPEQWTKAAPWK

SEQ ID NO: 91288 - protein, 284 aa, Homo sapiens
  Payload ID: 18260
  Gene Name: transmembrane protein 175
  ENSP ID: ENSP00000424208
MTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFA

SEQ ID NO: 91289 - protein, 113 aa, Homo sapiens
  Payload ID: 18260
  Gene Name: transmembrane protein 175
  ENSP ID: ENSP00000424746
MSQPRTPEQALDTPGDCPPGRRDEDAGEGIQCSQRMLSFSDALLSIIATVMILPVTHTEISPEQFDRSVQRLLATRIAVYLMTFLIVTVAWAAHTRLFQVVGKTDDTLALLNL

SEQ ID NO: 91290 - protein, 179 aa, Homo sapiens
  Payload ID: 18260
  Gene Name: transmembrane protein 175
  ENSP ID: ENSP00000425181
MSQPRTPEQALDTPGDCPPGRRDEDAGEGIQCSQRMLSFSDALLSIIATVMQFDRSVQRLLATRIAVYLMTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQG

SEQ ID NO: 91291 - protein, 133 aa, Homo sapiens
  Payload ID: 18260
  Gene Name: transmembrane protein 175
  ENSP ID: ENSP00000425763
MSQPRTPEQALDTPGDCPPGRRDEDAGEGIQCSQRMLSFSDALLSIIATVMILPVTHTEISPEQQFDRSVQRLLATRIAVYLMTFLIVTVAWAAHTRLFQVVGKTDDTLALLNLACMMTITFLPYTFSLMVTF

SEQ ID NO: 91292 - protein, 212 aa, Homo sapiens
  Payload ID: 18260
  Gene Name: transmembrane protein 175
  ENSP ID: ENSP00000425867
MTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKER

SEQ ID NO: 91293 - protein, 388 aa, Homo sapiens
  Payload ID: 18260
  Gene Name: transmembrane protein 175
  Uniprot ID: Q9BSA9
  ENSP ID: ENSP00000427039
MMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 91294 - protein, 72 aa, Homo sapiens; identical to SEQ ID NO: 91287
  Payload ID: 18260
  Gene Name: transmembrane protein 175
  ENSP ID: ENSP00000427218

SEQ ID NO: 91295 - protein, 77 aa, Homo sapiens
  Payload ID: 18260
  Gene Name: transmembrane protein 175
  ENSP ID: ENSP00000427626
MSQPRTPEQALDTPGDCPPGRRDEDAGEGIQCSQRMLSFSDALLSIIATVMILPVTHTEISPEQLPQQAGPLRSCSE

SEQ ID NO: 91296 - protein, 388 aa, Homo sapiens; identical to SEQ ID NO: 91293
  Payload ID: 18260
  Gene Name: transmembrane protein 175
  Uniprot ID: Q9BSA9
  ENSP ID: ENSP00000485461

SEQ ID NO: 91297 - protein, 235 aa, Homo sapiens
  Payload ID: 18261
  Gene Name: transmembrane protein 176A
  Uniprot ID: Q96HP8
  ENSP ID: ENSP00000004103
MGTADSDEMAPEAPQHTHIDVHIHQESALAKLLLTCCSALRPRATQARGSSRLLVASWVMQIVLGILSAVLGGFFYIRDYTLLVTSGAAIWTGAVAVLAGAAAFIYEKRGGTYWALLRTLLTLAAFSTAIAALKLWNEDFRYGYSYYNSACRISSSSDWNTPAPTQSPEEVRRLHLCTSFMDMLKALFRTLQAMLLGVWILLLLASLTPLWLYCWRMFPTKGKRDQKEMLEVSGI

SEQ ID NO: 91298 - protein, 235 aa, Homo sapiens; identical to SEQ ID NO: 91297
  Payload ID: 18261
  Gene Name: transmembrane protein 176A
  Uniprot ID: Q96HP8
  ENSP ID: ENSP00000417626

SEQ ID NO: 91299 - protein, 177 aa, Homo sapiens
  Payload ID: 18261
  Gene Name: transmembrane protein 176A
  ENSP ID: ENSP00000417834
GSSRLLVASWVMQIVLGILSAVLGGFFYIRDYTLLVTSGAAIWTGAVAVLAGAAAFIYEKRGGTYWALLRTLLTLAAFSTAIAALKLWNEDFRYGYSYYNSACRISSSSDWNTPAPTQSPEEVRRLHLCTSFMDMLKALFRTLQAMLLGVWILLLLASLTPLWLYCWRMFPTKGVSP

SEQ ID NO: 91300 - protein, 118 aa, Homo sapiens
  Payload ID: 18261
  Gene Name: transmembrane protein 176A
  ENSP ID: ENSP00000420081
MQIVLGILSAVLGGFFYIRDYTLLVTSGAAIWTGAVAVLAGAAAFIYEKRGGTYWALLRTLLTLAAFSTAIAALKLWNEDFRYGYSYYNSACRISSSSDWNTPAPTQSPEEVRRLHLC

SEQ ID NO: 91301 - protein, 176 aa, Homo sapiens
  Payload ID: 18261
  Gene Name: transmembrane protein 176A
  ENSP ID: ENSP00000420818
MQIVLGILSAVLGGFFYIRDYTLLVTSGAAIWTGAVAVLAGAAAFIYEKRGGTYWALLRTLLTLAAFSTAIAALKLWNEDFRYGYSYYNSACRISSSSDWNTPAPTQSPEEVRRLHLCTSFMDMLKALFRTLQAMLLGVWILLLLASLTPLWLYCWRMFPTKGKRDQKEMLEVSGI

SEQ ID NO: 91302 - protein, 270 aa, Homo sapiens
  Payload ID: 18262
  Gene Name: transmembrane protein 176B
  Uniprot ID: Q3YBM2
  ENSP ID: ENSP00000318409
MTQNTVIVNGVAMASRPSQPTHVNVHIHQESALTQLLKAGGSLKKFLFHPGDTVPSTARIGYEQLALGVTQILLGVVSCVLGVCLSLGPWTVLSASGCAFWAGSVVIAAGAGAIVHEKHPGKLAGYISSLLTLAGFATAMAAVVLCVNSFIWQTEPFLYIDTVCDRSDPVFPTTGYRWMRRSQENQWQKEECRAYMQMLRKLFTAIRALFLAVCVLKVIVSLVSLGVGLRNLCGQSSQPLNEEGSEKRLLGENSVPPSPSREQTSTAIVL

SEQ ID NO: 91303 - protein, 270 aa, Homo sapiens; identical to SEQ ID NO: 91302
  Payload ID: 18262
  Gene Name: transmembrane protein 176B
  Uniprot ID: Q3YBM2
  ENSP ID: ENSP00000397810

SEQ ID NO: 91304 - protein, 233 aa, Homo sapiens
  Payload ID: 18262
  Gene Name: transmembrane protein 176B
  Uniprot ID: Q3YBM2
  ENSP ID: ENSP00000404831
MTQNTVIVNGVAMASRPSQPTHVNVHIHQESALTQLLKAGGSLKKFLFHPGDTVPSTARIGYEQLALGVIAAGAGAIVHEKHPGKLAGYISSLLTLAGFATAMAAVVLCVNSFIWQTEPFLYIDTVCDRSDPVFPTTGYRWMRRSQENQWQKEECRAYMQMLRKLFTAIRALFLAVCVLKVIVSLVSLGVGLRNLCGQSSQPLNEEGSEKRLLGENSVPPSPSREQTSTAIVL

SEQ ID NO: 91305 - protein, 270 aa, Homo sapiens; identical to SEQ ID NO: 91302
  Payload ID: 18262
  Gene Name: transmembrane protein 176B
  Uniprot ID: Q3YBM2
  ENSP ID: ENSP00000410269

SEQ ID NO: 91306 - protein, 270 aa, Homo sapiens; identical to SEQ ID NO: 91302
  Payload ID: 18262
  Gene Name: transmembrane protein 176B
  Uniprot ID: Q3YBM2
  ENSP ID: ENSP00000413531

SEQ ID NO: 91307 - protein, 270 aa, Homo sapiens; identical to SEQ ID NO: 91302
  Payload ID: 18262
  Gene Name: transmembrane protein 176B
  Uniprot ID: Q3YBM2
  ENSP ID: ENSP00000419258

SEQ ID NO: 91308 - protein, 311 aa, Homo sapiens
  Payload ID: 18263
  Gene Name: transmembrane protein 177
  Uniprot ID: Q53S58
  ENSP ID: ENSP00000272521
MAGPLWRTAAFVQRHRTGLLVGSCAGLFGVPISYHLFPDPVVQWLYQYWPQGQPAPLPPQLQSLFQEVLQDIGVPSGHCYKPFTTFTFQPVSAGFPRLPAGAVVGIPASFLGDLVINTNHPVVIHGHTVDWRSPAGARLRASLTLSREAQKFALAREVVYLESSTTAVHALLAPACLAGTWALGVGAKYTLGLHAGPMNLRAAFSLVAAVAGFVAYAFSQDSLTHAVESWLDRRTASLSAAYACGGVEFYEKLLSGNLALRSLLGKDGEKLYTPSGNIVPRHLFRIKHLPYTTRRDSVLQMWRGMLNPGRS

SEQ ID NO: 91309 - protein, 311 aa, Homo sapiens; identical to SEQ ID NO: 91308
  Payload ID: 18263
  Gene Name: transmembrane protein 177
  Uniprot ID: Q53S58
  ENSP ID: ENSP00000385966

SEQ ID NO: 91310 - protein, 108 aa, Homo sapiens
  Payload ID: 18263
  Gene Name: transmembrane protein 177
  ENSP ID: ENSP00000386430
MAGPLWRTAAFVQRHRTGLLVGSCAGLFGVPISYHLFPDPVVQWLYQYWPQGQPAPLPPQLQSLFQEVLQDIGVPSGHCYKPFTTFTFQPEREHHRKVKKFALNHKTL

SEQ ID NO: 91311 - protein, 311 aa, Homo sapiens; identical to SEQ ID NO: 91308
  Payload ID: 18263
  Gene Name: transmembrane protein 177
  Uniprot ID: Q53S58
  ENSP ID: ENSP00000402661

SEQ ID NO: 91312 - protein, 114 aa, Homo sapiens
  Payload ID: 18263
  Gene Name: transmembrane protein 177
  ENSP ID: ENSP00000405898
MAGPLWRTAAFVQRHRTGLLVGSCAGLFGVPISYHLFPDPVVQWLYQYWPQGQPAPLPPQLQSLFQEVLQDIGVPSGHCYKPFTTFTFQPVSAGFPRLPAGAVVGIPASFLGDL

SEQ ID NO: 91313 - protein, 297 aa, Homo sapiens
  Payload ID: 18264
  Gene Name: transmembrane protein 178A
  Uniprot ID: Q8NBL3
  ENSP ID: ENSP00000281961
MEPRALVTALSLGLSLCSLGLLVTAIFTDHWYETDPRRHKESCERSRAGADPPDQKNRLMPLSHLPLRDSPPLGRRLLPGGPGRADPESWRSLLGLGGLDAECGRPLFATYSGLWRKCYFLGIDRDIDTLILKGIAQRCTAIKYHFSQPIRLRNIPFNLTKTIQQDEWHLLHLRRITAGFLGMAVAVLLCGCIVATVSFFWEESLTQHVAGLLFLMTGIFCTISLCTYAASISYDLNRLPKLIYSLPADVEHGYSWSIFCAWCSLGFIVAAGGLCIAYPFISRTKIAQLKSGRDSTV

SEQ ID NO: 91314 - protein, 111 aa, Homo sapiens
  Payload ID: 18264
  Gene Name: transmembrane protein 178A
  Uniprot ID: Q8NBL3
  ENSP ID: ENSP00000477622
MEPRALVTALSLGLSLCSLGLLVTAIFTDHWYETDPRRHKESCERSRAGADPPDQKNRLMPLSHLLGPLEEVLLPGHRPGHRHPHPERYCAAMHGHQVPLFSAHPLAKHSF

SEQ ID NO: 91315 - protein, 294 aa, Homo sapiens
  Payload ID: 18265
  Gene Name: transmembrane protein 178B
  Uniprot ID: H3BS89
  ENSP ID: ENSP00000456594
MAAGRLLLYTGLSLALCALGMLAVAICSDHWYETDARKHRDRCKAFNTRRVDPGFIYNNNNNLPLRASRSRLDRWEGKLLRARNRRQLFAMSPADECSRQYNSTNMGLWRKCHRQGFDPEIAALIRKGEIERCTYIKYHYSSATIPRNLTFNITKTIRQDEWHALHLRRMTAGFMGMAVAIILFGWIIGVLGCCWDRGLMQYVAGLLFLMGGTFCIISLCTCVAGINFELSRYPRYLYGLPDDISHGYGWSMFCAWGGLGLTLISGFFCTLAPSVQPVPRTNYPKSRPENGTVC

SEQ ID NO: 91316 - protein, 292 aa, Homo sapiens
  Payload ID: 18265
  Gene Name: transmembrane protein 178B
  ENSP ID: ENSP00000484025
MAAGRLLLYTGLSLALCALGMLAVAICSDHWYETDARKHRDRCKAFNTRRVDPGFIYNNNNNLPLRASRSRLDRWEGKLLRARNRRQLFAMSPADECSRQYNSTNMGLWRKCHRQGFDPEIAALIRKGEIERCTYIKYHYSSATIPRNLTFNVTKTLRCMYCMYLRRMTAGFMGMAVAIILFGWIIGVLGCCWDRGLMQYVAGLLFLMGGTFCIISLCTCVAGINFELSRYPRYLYGLPDDISHGYGWSMFCAWGGLGLTLISGFFCTLAPSVQPVPRTNYPKSRPENGTVC

SEQ ID NO: 91317 - protein, 197 aa, Homo sapiens
  Payload ID: 18266
  Gene Name: transmembrane protein 179
  Uniprot ID: Q6ZVK1
  ENSP ID: ENSP00000340477
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQVGGSGQEGRLAMLGGGHLLLDIC

SEQ ID NO: 91318 - protein, 190 aa, Homo sapiens
  Payload ID: 18266
  Gene Name: transmembrane protein 179
  ENSP ID: ENSP00000397763
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQGSLIDSHGVETPPGQS

SEQ ID NO: 91319 - protein, 233 aa, Homo sapiens
  Payload ID: 18266
  Gene Name: transmembrane protein 179
  Uniprot ID: Q6ZVK1
  ENSP ID: ENSP00000450958
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQFGLWASWLAWLAITTLAFLKVYHNYRQEDLLDSLIHEKELLLARPSPRTSFQEEKSAVI

SEQ ID NO: 91320 - protein, 78 aa, Homo sapiens
  Payload ID: 18266
  Gene Name: transmembrane protein 179
  ENSP ID: ENSP00000452113
  MOD_RES (1)..(1): Any amino acid
XPDPREGAAAGPAVPTHLLPRGEERCHLGTVQAGGAGPDLPAALGGTGLPGEAAGGLCLGPGHMQPCVCPLDATCSEP

SEQ ID NO: 91321 - protein, 182 aa, Homo sapiens
  Payload ID: 18266
  Gene Name: transmembrane protein 179
  ENSP ID: ENSP00000477614
MCTPVRVSIVCVMGAVGAVWTAPLPLPWAPTPSIHLREEGAAFPFCRVCVLRPRRSKWRSWDVNLGPRRRGLLGCGPCPSGKPRVHLQRTRSGAGAEAGGLPTRGSMRGCPFLGSSAAKCSLLLRPPSRGEASPWLPEFMTHPVHHQQLACVSGWLGTSLLEATCLGPHGGSWWGHHPGSRE

SEQ ID NO: 91322 - protein, 182 aa, Homo sapiens; identical to SEQ ID NO: 91321
  Payload ID: 18266
  Gene Name: transmembrane protein 179
  ENSP ID: ENSP00000479740

SEQ ID NO: 91323 - protein, 189 aa, Homo sapiens
  Payload ID: 18266
  Gene Name: transmembrane protein 179
  ENSP ID: ENSP00000481424
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQGSLIDSHGVETPPGQ

SEQ ID NO: 91324 - protein, 211 aa, Homo sapiens
  Payload ID: 18266
  Gene Name: transmembrane protein 179
  ENSP ID: ENSP00000483627
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQVQFRTPGWPLKALAGRGWPEDASPGQEPSKGAGHGWA

SEQ ID NO: 91325 - protein, 211 aa, Homo sapiens; identical to SEQ ID NO: 91324
  Payload ID: 18266
  Gene Name: transmembrane protein 179
  ENSP ID: ENSP00000484829

SEQ ID NO: 91326 - protein, 233 aa, Homo sapiens; identical to SEQ ID NO: 91319
  Payload ID: 18266
  Gene Name: transmembrane protein 179
  Uniprot ID: Q6ZVK1
  ENSP ID: ENSP00000485891

SEQ ID NO: 91327 - protein, 78 aa, Homo sapiens; identical to SEQ ID NO: 91320
  Payload ID: 18266
  Gene Name: transmembrane protein 179
  ENSP ID: ENSP00000486955
  MOD_RES (1)..(1): Any amino acid

SEQ ID NO: 91328 - protein, 197 aa, Homo sapiens; identical to SEQ ID NO: 91317
  Payload ID: 18266
  Gene Name: transmembrane protein 179
  Uniprot ID: Q6ZVK1
  ENSP ID: ENSP00000487568

SEQ ID NO: 91329 - protein, 219 aa, Homo sapiens
  Payload ID: 18267
  Gene Name: transmembrane protein 179B
  Uniprot ID: Q7Z7N9
  ENSP ID: ENSP00000333697
MALSWLQRVELALFAAAFLCGAVAAAAMTRTQGSFSGRCPLYGVATLNGSSLALSRPSAPSLCYFVAGASGLLALYCLLLLLFWIYSSCIEDSHRGAIGLRIALAISAIAVFLVLVSACILRFGTRSLCNSIISLNTTISCSEAQKIPWTPPGTALQFYSNLHNAETSSWVNLVLWCVVLVLQVVQWKSEATPYRPLERGDPEWSSETDALVGSRLSHS

SEQ ID NO: 91330 - protein, 144 aa, Homo sapiens
  Payload ID: 18267
  Gene Name: transmembrane protein 179B
  ENSP ID: ENSP00000433055
MALSWLQRVELALFAAAFLCGAVAAAAMTRTQGSFSGRCPLYGVATLNGSSLALSRPSAPSLCYFVAGASGLLALYCLLLLLFWIYSSCIEDSHRGAIGLRIALAISAIAVFLVLVSACILRFGTRSLCNSIISLNTTIRPLLG

SEQ ID NO: 91331 - protein, 95 aa, Homo sapiens
  Payload ID: 18267
  Gene Name: transmembrane protein 179B
  ENSP ID: ENSP00000436606
  MOD_RES (1)..(1): Any amino acid
XLFWIYSSCIEDSHRGAIGLRIALAISAIAVFLVLVSACILRFGTRSLCNSIISLNTTISCSEAQKIPWTPPGTALQFYSNLHNAEVRPKDRRKN

SEQ ID NO: 91332 - protein, 140 aa, Homo sapiens
  Payload ID: 18268
  Gene Name: transmembrane protein 18
  Uniprot ID: Q96B42
  ENSP ID: ENSP00000281017
MPSAFSVSSFPVSIPAVLTQTDWTEPWLMGLATFHALCVLLTCLSSRSYRLQIGHFLCLVILVYCAEYINEAAAMNWRLFSKYQYFDSRGMFISIVFSAPLLVNAMIIVVMWVWKTLNVMTDLKNAQERRKEKKRRRKED

SEQ ID NO: 91333 - protein, 127 aa, Homo sapiens
  Payload ID: 18268
  Gene Name: transmembrane protein 18
  Uniprot ID: Q96B42
  ENSP ID: ENSP00000347874
MLSGYLQTDWTEPWLMGLATFHALCVLLTCLSSRSYRLQIGHFLCLVILVYCAEYINEAAAMNWRLFSKYQYFDSRGMFISIVFSAPLLVNAMIIVVMWVWKTLNVMTDLKNAQERRKEKKRRRKED

SEQ ID NO: 91334 - protein, 143 aa, Homo sapiens
  Payload ID: 18268
  Gene Name: transmembrane protein 18
  ENSP ID: ENSP00000384347
MGTRWGLGRKPCSPHLRASGLLQTDWTEPWLMGLATFHALCVLLTCLSSRSYRLQIGHFLCLVILVYCAEYINEAAAMNWRLFSKYQYFDSRGMFISIVFSAPLLVNAMIIVVMWVWKTLNVMTDLKNAQERRKEKKRRRKED

SEQ ID NO: 91335 - protein, 66 aa, Homo sapiens
  Payload ID: 18268
  Gene Name: transmembrane protein 18
  ENSP ID: ENSP00000390474
MPSAFSVSSFPVSIPAVLTVQQGPGESRRRRSAALSGEFSVLQRGWRKSSLARGDGSRFPEVFSAD

SEQ ID NO: 91336 - protein, 59 aa, Homo sapiens
  Payload ID: 18268
  Gene Name: transmembrane protein 18
  ENSP ID: ENSP00000408658
MGSGQKAVLPSPPCLWSSGTAGSRGVQEAAECGTVWRVQCIAERLEKIKSCTWRWLKIP

SEQ ID NO: 91337 - protein, 517 aa, Homo sapiens
  Payload ID: 18269
  Gene Name: transmembrane protein 180
  Uniprot ID: Q14CX5
  ENSP ID: ENSP00000238936
MGLGQPQAWLLGLPTAVVYGSLALFTTILHNVFLLYYVDTFVSVYKINKMAFWVGETVFLLWNSLNDPLFGWLSDRQFLSSQPRSGAGLSSRAVVLARVQALGWHGPLLALSFLAFWVPWAPAGLQFLLCLCLYDGFLTLVDLHHHALLADLALSAHDRTHLNFYCSLFSAAGSLSVFASYAFWNKEDFSSFRAFCVTLAVSSGLGFLGATQLLRRRVEAARKDPGCSGLVVDSGLCGEELLVGSEEADSITLGRYLRQLARHRNFLWFVSMDLVQVFHCHFNSNFFPLFLEHLLSDHISLSTGSILLGLSYVAPHLNNLYFLSLCRRWGVYAVVRGLFLLKLGLSLLMLLAGPDHLSLLCLFIASNRVFTEGTCKLLTLVVTDLVDEDLVLNHRKQAASALLFGMVALVTKPGQTFAPLLGTWLLCFYTGHDLFQQSLITPVGSAHPWPEPPAPAPAQAPTLRQGCFYLLVLVPITCALLQLFTWSQFTLHGRRLHMVKAQRQNLSQAQTLDVKMV

SEQ ID NO: 91338 - protein, 153 aa, Homo sapiens
  Payload ID: 18269
  Gene Name: transmembrane protein 180
  ENSP ID: ENSP00000358947
MGLGQPQAWLLGLPTAVVYGSLALFTTILHNVFLLYYVDTFVSVYKINKMAFWVGETVFLLWNSLNDPLFGWLSDRQFLSSQPRLCGEELLVGSEEADSITLGRYLRQLARHRNFLWFVSMDLVQVQWLTPVIPALRDAKVERPLEPRSSRLQ

SEQ ID NO: 91339 - protein, 612 aa, Homo sapiens
  Payload ID: 18270
  Gene Name: transmembrane protein 181
  Uniprot ID: Q9P2C4
  ENSP ID: ENSP00000356057
MGAAPSPTQASSRGGGPGPPAPTRAVSSSSRARGGALSALGPSPARPLTTSPAPAPPPRSRPARQQPDPQCWEKRGGAGGDTKGGAAGPGPGRLRGMDAEYPAFEPPLCSELKHLCRRLREAYRELKEDLTPFKDDRYYRLAPMRLYTLSKRHFVLVFVVFFICFGLTIFVGIRGPKVIQTSAANFSLNNSKKLKPIQILSNPLSTYNQQLWLTCVVELDQSKETSIKTSFPMTVKVDGVAQDGTTMYIHNKVHNRTRTLTCAGKCAEIIVAHLGYLNYTQYTVIVGFEHLKLPIKGMNFTWKTYNPAFSRLEIWFRFFFVVLTFIVTCLFAHSLRKFSMRDWGIEQKWMSVLLPLLLLYNDPFFPLSFLVNSWLPGMLDDLFQSMFLCALLLFWLCVYHGIRVQGERKCLTFYLPKFFIVGLLWLASVTLGIWQTVNELHDPMYQYRVDTGNFQGMKVFFMVVAAVYILYLLFLIVRACSELRHMPYVDLRLKFLTALTFVVLVISIAILYLRFGAQVLQDNFVAELSTHYQNSAEFLSFYGLLNFYLYTLAFVYSPSKNALYESQLKDNPAFSMLNDSDDDVIYGSDYEEMPLQNGQAIRAKYKEESDSD

SEQ ID NO: 91340 - protein, 186 aa, Homo sapiens
  Payload ID: 18271
  Gene Name: transmembrane protein 182
  ENSP ID: ENSP00000387184
MIENVTFHHEGFFWRCWFNGIVEENDSNIWKFWYTNQPPSKNCTHAYLSPYPFMRGEHNSTSYDSAVIYRGFWAVLMLLGVVAVVIASFLIICAAPFASHFLYKAGGGSYIAAGILFSLVVMLYVIWVQAVADMESYRNMKMKDCLDFTPSVLYGWSFFLAPAGIFFSLLAGLLFLVVGWHIQIHH

SEQ ID NO: 91341 - protein, 133 aa, Homo sapiens
  Payload ID: 18271
  Gene Name: transmembrane protein 182
  Uniprot ID: Q6ZP80
  ENSP ID: ENSP00000387258
MRGEHNSTSYDSAVIYRGFWAVLMLLGVVAVVIASFLIICAAPFASHFLYKAGGGSYIAAGILFSLVVMLYVIWVQAVADMESYRNMKMKDCLDFTPSVLYGWSFFLAPAGIFFSLLAGLLFLVVGWHIQIHH

SEQ ID NO: 91342 - protein, 80 aa, Homo sapiens
  Payload ID: 18271
  Gene Name: transmembrane protein 182
  ENSP ID: ENSP00000392106
MIENVTFHHEGFFWRCWFNGIVEENDSNIWKFWYTNQPPSKNCTHAYLSPYPFMRGEHNSTSYDSAVIYRGFWAVLMLLG

SEQ ID NO: 91343 - protein, 229 aa, Homo sapiens
  Payload ID: 18271
  Gene Name: transmembrane protein 182
  Uniprot ID: Q6ZP80
  ENSP ID: ENSP00000394178
MRLNIAIFFGALFGALGVLLFLVAFGSDYWLLATEVGRCSGEKNIENVTFHHEGFFWRCWFNGIVEENDSNIWKFWYTNQPPSKNCTHAYLSPYPFMRGEHNSTSYDSAVIYRGFWAVLMLLGVVAVVIASFLIICAAPFASHFLYKAGGGSYIAAGILFSLVVMLYVIWVQAVADMESYRNMKMKDCLDFTPSVLYGWSFFLAPAGIFFSLLAGLLFLVVGWHIQIHH

SEQ ID NO: 91344 - protein, 376 aa, Homo sapiens
  Payload ID: 18272
  Gene Name: transmembrane protein 183A
  Uniprot ID: Q8IXX5
  ENSP ID: ENSP00000356211
MARGPGPLGRPRPDTVAMPKRGKRLKFRAHDACSGRVTVADYANSDPAVVRSGRVKKAVANAVQQEVKSLCGLEASQVPAEEALSGAGEPCDIIDSSDEMDAQEESIHERTVSRKKKSKRHKEELDGAGGEEYPMDIWLLLASYIRPEDIVNFSLICKNAWTVTCTAAFWTRLYRRHYTLDASLPLRLRPESMEKLRCLRACVIRSLYHMYEPFAARISKNPAIPESTPSTLKNSKCLLFWCRKIVGNRQEPMWEFNFKFKKQSPRLKSKCTGGLQPPVQYEDVHTNPDQDCCLLQVTTLNFIFIPIVMGMIFTLFTINVSTDMRHHRVRLVFQDSPVHGGRKLRSEQGVQVILDPVHSVRLFDWWHPQYPFSLRA

SEQ ID NO: 91345 - protein, 413 aa, Homo sapiens
  Payload ID: 18273
  Gene Name: transmembrane protein 184A
  Uniprot ID: Q6ZMB5
  ENSP ID: ENSP00000297477
MSNVSGILETAGVPLVSANWPQPSPPPAVPAGPQMDHMGNSSQGAPWLFLTSALARGVSGIFVWTALVLTCHQIYLHLRSYTVPQEQRYIIRLLLIVPIYAFDSWLSLLLLGDHQYYVYFDSVRDCYEAFVIYSFLSLCFQYLGGEGAIMAEIRGKPIKSSCLYGTCCLRGMTYSIGFLRFCKQATLQFCLVKPVMAVTTIILQAFGKYHDGDFNVRSGYLYVTLIYNASVSLALYALFLFYFTTRELLRPFQPVLKFLTIKAVIFLSFWQGLLLAILERCGVIPEVETSGGNKLGAGTLAAGYQNFIICVEMLFASVALRYAFPCQVYAEKKENSPAPPAPMQSISSGIRETVSPQDIVQDAIHNFSPAYQHYTQQATHEAPRPGTHPSGGSGGSRKSRSLEKRMLIPSEDL

SEQ ID NO: 91346 - protein, 247 aa, Homo sapiens
  Payload ID: 18273
  Gene Name: transmembrane protein 184A
  ENSP ID: ENSP00000325945
MSNVSGILETAGVPLVSANWPQPSPPPAVPAGPQMDHMGNSSQGAPWLFLTSALARGVSGIFVWTALVLTCHQIYLHLRSYTVPQEQRYIIRLLLIVPIYAFDSWLSLLLLGDHQYYVYFDSVRDCYEAFVIYSFLSLCFQYLGGEGAIMAEIRGKPIKSSCLYGTCCLRGMTYSIGFLRFCKQATLQFCLVKPVMAVTTIILQAFGKYHDGDFKTSVPAKAGGLDLPSQDTAGCPQRLPLCDPHLQ

SEQ ID NO: 91347 - protein, 166 aa, Homo sapiens
  Payload ID: 18273
  Gene Name: transmembrane protein 184A
  ENSP ID: ENSP00000326348
MSNVSGILETAGVPLVSANWPQPSPPPAVPAGPQMDHMGNSSQGAPWLFLTSALARGVSGIFVWTALVLTCHQIYLHLRSYTVPQEQRYIIRLLLIVPIYAFDSWLSLLLLGDHQYYVYFDSVRDCYEAFVIYSFLSLCFQYLGGEGAIMAEIRGKPIKPLCSSAW

SEQ ID NO: 91348 - protein, 158 aa, Homo sapiens
  Payload ID: 18273
  Gene Name: transmembrane protein 184A
  ENSP ID: ENSP00000389092
MSNVSGILETAGVPLVSANWPQPSPPPAVPAGPQMDHMGNSSQGAPWLFLTSALARGVSGIFVWTALVLTCHQIYLHLRSYTVPQEQRYIIRLLLIVPIYAFDSWLSLLLLGDHQYYVYFDSVRDCYEAFVIYSFLSLCFQYLGGEGAIMAEIRGKPI

SEQ ID NO: 91349 - protein, 175 aa, Homo sapiens
  Payload ID: 18273
  Gene Name: transmembrane protein 184A
  ENSP ID: ENSP00000398382
MSNVSGILETAGVPLVSANWPQPSPPPAVPAGPQMDHMGNSSQGAPWLFLTSALARGVSGIFVWTALVLTCHQIYLHLRSYTVPQEQRYIIRLLLIVPIYAFDSWLSLLLLGDHQYYVYFDSVRDCYEAFVIYSFLSLCFQYLGGEGAIMAEIRGKPIKSSCLYGTCCLRGMTYS

SEQ ID NO: 91350 - protein, 139 aa, Homo sapiens
  Payload ID: 18273
  Gene Name: transmembrane protein 184A
  ENSP ID: ENSP00000403499
MSNVSGILETAGVPLVSANWPQPSPPPAVPAGPQMDHMGNSSQGAPWLFLTSALARGVSGIFVWTALVLTCHQIYLHLRSYTVPQEQRYIIRLLLIVPIYAFDSWLSLLLLGDHQYYVYFDSVRDCYEAFVIYSFLSLC

SEQ ID NO: 91351 - protein, 130 aa, Homo sapiens
  Payload ID: 18273
  Gene Name: transmembrane protein 184A
  ENSP ID: ENSP00000413955
MSNVSGILETAGVPLVSANWPQPSPPPAVPAGPQMDHMGNSSQGAPWLFLTSALARGVSGIFVWTALVLTCHQIYLHLRSYTVPQEQRYIIRLLLIVPIYAFDSWLSLLLLGDHQYYVYFDSVRDCYEAS

SEQ ID NO: 91352 - protein, 407 aa, Homo sapiens
  Payload ID: 18274
  Gene Name: transmembrane protein 184B
  Uniprot ID: Q9Y519
  ENSP ID: ENSP00000354441
MTVRGDVLAPDPASPTTAAASPSVSVIPEGSPTAMEQPVFLMTTAAQAISGFFVWTALLITCHQIYMHLRCYSCPNEQRYIVRILFIVPIYAFDSWLSLLFFTNDQYYVYFGTVRDCYEALVIYNFLSLCYEYLGGESSIMSEIRGKPIESSCMYGTCCLWGKTYSIGFLRFCKQATLQFCVVKPLMAVSTVVLQAFGKYRDGDFDVTSGYLYVTIIYNISVSLALYALFLFYFATRELLSPYSPVLKFFMVKSVIFLSFWQGMLLAILEKCGAIPKIHSARVSVGEGTVAAGYQDFIICVEMFFAALALRHAFTYKVYADKRLDAQGRCAPMKSISSSLKETMNPHDIVQDAIHNFSPAYQQYTQQSTLEPGPTWRGGAHGLSRSHSLSGARDNEKTLLLSSDDEF

SEQ ID NO: 91353 - protein, 407 aa, Homo sapiens; identical to SEQ ID NO: 91352
  Payload ID: 18274
  Gene Name: transmembrane protein 184B
  Uniprot ID: Q9Y519
  ENSP ID: ENSP00000355210

SEQ ID NO: 91354 - protein, 72 aa, Homo sapiens
  Payload ID: 18274
  Gene Name: transmembrane protein 184B
  ENSP ID: ENSP00000393918
MTVRGDVLAPDPASPTTAAASPSVSVIPEGSPTAMEQPVFLMTTAAQAISGFFVWTALLITCHQPRARLGQV

SEQ ID NO: 91355 - protein, 75 aa, Homo sapiens
  Payload ID: 18274
  Gene Name: transmembrane protein 184B
  ENSP ID: ENSP00000399073
MTVRGDVLAPDPASPTTAAASPSVSVIPEGSPTAMEQPVFLMTTAAQAISGFFVWTALLITCHQNPSICGPILLI

SEQ ID NO: 91356 - protein, 72 aa, Homo sapiens; identical to SEQ ID NO: 91354
  Payload ID: 18274
  Gene Name: transmembrane protein 184B
  ENSP ID: ENSP00000413085

SEQ ID NO: 91357 - protein, 348 aa, Homo sapiens
  Payload ID: 18274
  Gene Name: transmembrane protein 184B
  ENSP ID: ENSP00000488878
  MOD_RES (1)..(1): Any amino acid
XHLRCYSCPNEQRYIVRILFIVPIYAFDSWLSLLFFTNDQYYVYFGTVRDCYEALVIYNFLSLCYEYLGGESSIMSEIRGKPIESSCMYGTCCLWGKTYSIGFLRFCKQATLQFCVVKPLMAVSTVVLQAFGKYRDGDFDVTSGYLYVTIIYNISVSLALYALFLFYFATRELLSPYSPVLKFFMVKSVIFLSFWQGMLLAILEKCGAIPKIHSARVSVGEGTVAAGYQDFIICVEMFFAALALRHAFTYKVYADKRLDAQVPTYGPYGRCAPMKSISSSLKETMNPHDIVQDAIHNFSPAYQQYTQQSTLEPGPTWRGGAHGLSRSHSLSGARDNEKTLLLSSDDEF

SEQ ID NO: 91358 - protein, 438 aa, Homo sapiens
  Payload ID: 18275
  Gene Name: transmembrane protein 184C
  Uniprot ID: Q9NVA4
  ENSP ID: ENSP00000296582
MPCTCTWRNWRQWIRPLVAVIYLVSIVVAVPLCVWELQKLEVGIHTKAWFIAGIFLLLTIPISLWVILQHLVHYTQPELQKPIIRILWMVPIYSLDSWIALKYPGIAIYVDTCRECYEAYVIYNFMGFLTNYLTNRYPNLVLILEAKDQQKHFPPLCCCPPWAMGEVLLFRCKLGVLQYTVVRPFTTIVALICELLGIYDEGNFSFSNAWTYLVIINNMSQLFAMYCLLLFYKVLKEELSPIQPVGKFLCVKLVVFVSFWQAVVIALLVKVGVISEKHTWEWQTVEAVATGLQDFIICIEMFLAAIAHHYTFSYKPYVQEAEEGSCFDSFLAMWDVSDIRDDISEQVRHVGRTVRGHPRKKLFPEDQDQNEHTSLLSSSSQDAISIASSMPPSPMGHYQGFGHTVTPQTTPTTAKISDEILSDTIGEKKEPSDKSVDS

SEQ ID NO: 91359 - protein, 72 aa, Homo sapiens
  Payload ID: 18275
  Gene Name: transmembrane protein 184C
  ENSP ID: ENSP00000421159
LGIYDEGNFSFSNAWTYLVIINNMSQLFAMYCLLLFYKVLKEELSPIQPVGKFLCVKLVVFVSFCIRGNGKL

SEQ ID NO: 91360 - protein, 261 aa, Homo sapiens
  Payload ID: 18275
  Gene Name: transmembrane protein 184C
  ENSP ID: ENSP00000425940
MPCTCTWRNWRQWIRPLVAVIYLVSIVVAVPLCVWELQKLEVGIHTKAWFIAGIFLLLTIPISLWVILQHLVHYTQPELQKPIIRILWMVPIYSLDSWIALKYPGIAIYVDTCRECYEAYVIYNFMGFLTNYLTNRYPNLVLILEAKDQQKHFPPLCCCPPWAMGEVLLFRCKLGVLQYTVVRPFTTIVALICELLGIYDEGNFSFSNAWTYLVIINNMSQLFAMYCLLLFYKVLKEELSPIQPVGKFLCVKLVVFVSFWP

SEQ ID NO: 91361 - protein, 173 aa, Homo sapiens
  Payload ID: 18276
  Gene Name: transmembrane protein 185A
  ENSP ID: ENSP00000427766
MNLRGLFQDFNPSKFLIYACLLLFSVLLALRLDGIIQWSYWAVFAPIWLWKLMVIVGASVGTGVWARNPQYRAEGETCVEFKAMLIAVGIHLLLLMFEVLVCDRIERGSHFWLLVFMPLFFVSPVSVAACVWGFRHDRSLELEILCSVNILQFIFIALRLDKIIHWPWLVCNF

SEQ ID NO: 91362 - protein, 223 aa, Homo sapiens
  Payload ID: 18276
  Gene Name: transmembrane protein 185A
  ENSP ID: ENSP00000427814
  MOD_RES (1)..(1): Any amino acid
XVCDRIERGSHFWLLVFMPLFFVSPVSVAACVWGFRHDRSLEVVCVPLWILMSFLCLVVLYYIVWSVLFLRSMDVIAEQRRTHITMALSWMTIVVPLLTFEILLVHKLDGHNAFSCIPIFVPLWLSLITLMATTFGQKGGNHWWFGIRKDFCQFLLEIFPFLREYGNISYDLHHEDNEETEETPVPEPPKIAPMFRKKARVVITQSPGKYVLPPPKLNIEMPD

SEQ ID NO: 91363 - protein, 60 aa, Homo sapiens
  Payload ID: 18276
  Gene Name: transmembrane protein 185A
  ENSP ID: ENSP00000428659
MNLRGLFQDFNPRAEGETCVEFKAMLIAVGIHLLLLMFEVLVCDRIERGSHFWLLVFMPL

SEQ ID NO: 91364 - protein, 79 aa, Homo sapiens
  Payload ID: 18276
  Gene Name: transmembrane protein 185A
  ENSP ID: ENSP00000428852
MNLRGLFQDFNPSKFLIYACLLLFSVLLALRLDGIIQWSYWAVFAPIWLWKLMVIVGASVGTGVWARNPQYRRRNVCGV

SEQ ID NO: 91365 - protein, 60 aa, Homo sapiens
  Payload ID: 18276
  Gene Name: transmembrane protein 185A
  ENSP ID: ENSP00000429625
  MOD_RES (1)..(1): Any amino acid
XKFLIYACLLLFSVLLALRLDGIIQWSYWAVFAPIWLWKLMVIVGASVGTGVWARNPQYR

SEQ ID NO: 91366 - protein, 350 aa, Homo sapiens
  Payload ID: 18276
  Gene Name: transmembrane protein 185A
  Uniprot ID: Q8NFB2
  ENSP ID: ENSP00000471932
MNLRGLFQDFNPSKFLIYACLLLFSVLLALRLDGIIQWSYWAVFAPIWLWKLMVIVGASVGTGVWARNPQYRAEGETCVEFKAMLIAVGIHLLLLMFEVLVCDRIERGSHFWLLVFMPLFFVSPVSVAACVWGFRHDRSLELEILCSVNILQFIFIALRLDKIIHWPWLVVCVPLWILMSFLCLVVLYYIVWSVLFLRSMDVIAEQRRTHITMALSWMTIVVPLLTFEILLVHKLDGHNAFSCIPIFVPLWLSLITLMATTFGQKGGNHWWFGIRKDFCQFLLEIFPFLREYGNISYDLHHEDNEETEETPVPEPPKIAPMFRKKARVVITQSPGKYVLPPPKLNIEMPD

SEQ ID NO: 91367 - protein, 172 aa, Homo sapiens
  Payload ID: 18276
  Gene Name: transmembrane protein 185A
  ENSP ID: ENSP00000482375
MSFLCLVVLYYIVWSVLFLRSMDVIAEQRRTHITMALSWMTIVVPLLTFEILLVHKLDGHNAFSCIPIFVPLWLSLITLMATTFGQKGGNHWWFGIRKDFCQFLLEIFPFLREYGNISYDLHHEDNEETEETPVPEPPKIAPMFRKKARVVITQSPGKYVLPPPKLNIEMPD

SEQ ID NO: 91368 - protein, 45 aa, Homo sapiens
  Payload ID: 18276
  Gene Name: transmembrane protein 185A
  ENSP ID: ENSP00000483167
MNLRGLFQDFNPRLCVSRCGFSCPFCAWWSSTTLCGPSCSCALWM

SEQ ID NO: 91369 - protein, 291 aa, Homo sapiens
  Payload ID: 18276
  Gene Name: transmembrane protein 185A
  ENSP ID: ENSP00000483235
MNLRGLFQDFNPRAEGETCVEFKAMLIAVGIHLLLLMFEVLVCDRIERGSHFWLLVFMPLFFVSPVSVAACVWGFRHDRSLELEILCSVNILQFIFIALRLDKIIHWPWLVVCVPLWILMSFLCLVVLYYIVWSVLFLRSMDVIAEQRRTHITMALSWMTIVVPLLTFEILLVHKLDGHNAFSCIPIFVPLWLSLITLMATTFGQKGGNHWWFGIRKDFCQFLLEIFPFLREYGNISYDLHHEDNEETEETPVPEPPKIAPMFRKKARVVITQSPGKYVLPPPKLNIEMPD

SEQ ID NO: 91370 - protein, 350 aa, Homo sapiens
  Payload ID: 18277
  Gene Name: transmembrane protein 185B
  Uniprot ID: Q9H7F4
  ENSP ID: ENSP00000453399
MNPRGLFQDFNPSKFLIYTCLLLFSVLLPLRLDGIIQWSYWAVFAPIWLWKLLVVAGASVGAGVWARNPRYRTEGEACVEFKAMLIAVGIHLLLLMFEVLVCDRVERGTHFWLLVFMPLFFVSPVSVAACVWGFRHDRSLELEILCSVNILQFIFIALKLDRIIHWPWLVVFVPLWILMSFLCLVVLYYIVWSLLFLRSLDVVAEQRRTHVTMAISWITIVVPLLTFEVLLVHRLDGHNTFSYVSIFVPLWLSLLTLMATTFRRKGGNHWWFGIRRDFCQFLLEIFPFLREYGNISYDLHHEDSEDAEETSVPEAPKIAPIFGKKARVVITQSPGKYVPPPPKLNIDMPD

SEQ ID NO: 91371 - protein, 213 aa, Homo sapiens
  Payload ID: 18278
  Gene Name: transmembrane protein 186
  Uniprot ID: Q96B77
  ENSP ID: ENSP00000331640
MAALLRAVRRFRGKAVWERPLHGLWCCSGQEDPKRWVGSSSPISKEKLPNAETEKFWMFYRFDAIRTFGFLSRLKLAQTALTVVALPPGYYLYSQGLLTLNTVCLMSGISGFALTMLCWMSYFLRRLVGILYLNESGTMLRVAHLNFWGWRQDTYCPMADVIPLTETKDRPQEMFVRIQRYSGKQTFYVTLRYGRILDRERFTQVFGVHQMLK

SEQ ID NO: 91372 - protein, 261 aa, Homo sapiens
  Payload ID: 18279
  Gene Name: transmembrane protein 187
  Uniprot ID: Q14656
  ENSP ID: ENSP00000358999
MNPEWGQAFVHVAVAGGLCAVAVFTGIFDSVSVQVGYEHYAEAPVAGLPAFLAMPFNSLVNMAYTLLGLSWLHRGGAMGLGPRYLKDVFAAMALLYGPVQWLRLWTQWRRAAVLDQWLTLPIFAWPVAWCLYLDRGWRPWLFLSLECVSLASYGLALLHPQGFEVALGAHVVAAVGQALRTHRHYGSTTSATYLALGVLSCLGFVVLKLCDHQLARWRLFQCLTGHFWSKVCDVLQFHFAFLFLTHFNTHPRFHPSGGKTR

SEQ ID NO: 91373 - protein, 66 aa, Homo sapiens
  Payload ID: 18279
  Gene Name: transmembrane protein 187
  ENSP ID: ENSP00000390108
MNPEWGQAFVHVAVAGGLCAVAVFTGIFDSVSVQVGYEHYAEAPVAGLPAFLAMPFNSLVNMAYTL

SEQ ID NO: 91374 - protein, 33 aa, Homo sapiens
  Payload ID: 18279
  Gene Name: transmembrane protein 187
  ENSP ID: ENSP00000412872
MNPEWGQAFVHVAVAGGLCAVAVFTGIFDSVSV

SEQ ID NO: 91375 - protein, 267 aa, Homo sapiens
  Payload ID: 18280
  Gene Name: transmembrane protein 189
  Uniprot ID: A5PLL7
  ENSP ID: ENSP00000360713
MAGAENWPGQQLELDEDEASCCRWGAQHAGARELAALYSPGKRLQEWCSVILCFSLIAHNLVHLLLLARWEDTPLVILGVVAGALIADFLSGLVHWGADTWGSVELPIAFIRPFREHHIDPTAITRHDFIETNGDNCLVTLLPLLNMAYKFRTHSPEALEQLYPWECFVFCLIIFGTFTNQIHKWSHTYFGLPRWVTLLQDWHVILPRKHHRIHHVSPHETYFCITTGWLNYPLEKIGFWRRLEDLIQGLTGEKPRADDMKWAQKIK

SEQ ID NO: 91376 - protein, 270 aa, Homo sapiens
  Payload ID: 18280
  Gene Name: transmembrane protein 189
  Uniprot ID: A5PLL7
  ENSP ID: ENSP00000360715
MAGAENWPGQQLELDEDEASCCRWGAQHAGARELAALYSPGKRLQEWCSVILCFSLIAHNLVHLLLLARWEDTPLVILGVVAGALIADFLSGLVHWGADTWGSVELPIVGKAFIRPFREHHIDPTAITRHDFIETNGDNCLVTLLPLLNMAYKFRTHSPEALEQLYPWECFVFCLIIFGTFTNQIHKWSHTYFGLPRWVTLLQDWHVILPRKHHRIHHVSPHETYFCITTGWLNYPLEKIGFWRRLEDLIQGLTGEKPRADDMKWAQKIK

SEQ ID NO: 91377 - protein, 195 aa, Homo sapiens
  Payload ID: 18280
  Gene Name: transmembrane protein 189
  ENSP ID: ENSP00000360719
MNERAIAGALIADFLSGLVHWGADTWGSVELPIVGKAFIRPFREHHIDPTAITRHDFIETNGDNCLVTLLPLLNMAYKFRTHSPEALEQLYPWECFVFCLIIFGTFTNQIHKWSHTYFGLPRWVTLLQDWHVILPRKHHRIHHVSPHETYFCITTGWLNYPLEKIGFWRRLEDLIQGLTGEKPRADDMKWAQKIK

SEQ ID NO: 91378 - protein, 91 aa, Homo sapiens
  Payload ID: 18280
  Gene Name: transmembrane protein 189
  ENSP ID: ENSP00000360721
MAGAENWPGQQLELDEDEASCCRWGAQHAGARELAALYSPGKRLQEWCSVILCFSLIAHNLVHLLLLARWEDTPLVILGVGFHPTLPGAPH

SEQ ID NO: 91379 - protein, 45 aa, Homo sapiens
  Payload ID: 18280
  Gene Name: transmembrane protein 189
  ENSP ID: ENSP00000411045
MAGAENWPGQQLELDEDEASCCRWGAQHAGARELAALYSPVPFTL

SEQ ID NO: 91380 - protein, 336 aa, Homo sapiens
  Payload ID: 18281
  Gene Name: transmembrane protein 19
  Uniprot ID: Q96HH6
  ENSP ID: ENSP00000266673
MTDLNDNICKRYIKMITNIVILSLIICISLAFWIISMTASTYYGNLRPISPWRWLFSVVVPVLIVSNGLKKKSLDHSGALGGLVVGFILTIANFSFFTSLLMFFLSSSKLTKWKGEVKKRLDSEYKEGGQRNWVQVFCNGAVPTELALLYMIENGPGEIPVDFSKQYSASWMCLSLLAALACSAGDTWASEVGPVLSKSSPRLITTWEKVPVGTNGGVTVVGLVSSLLGGTFVGIAYFLTQLIFVNDLDISAPQWPIIAFGGLAGLLGSIVDSYLGATMQYTGLDESTGMVVNSPTNKARHIAGKPILDNNAVNLFSSVLIALLLPTAAWGFWPRG

SEQ ID NO: 91381 - protein, 152 aa, Homo sapiens
  Payload ID: 18281
  Gene Name: transmembrane protein 19
  ENSP ID: ENSP00000448069
  MOD_RES (1)..(1): Any amino acid
XDTWASEVGPVLSKSSPRLITTWEKVPVGTNGGVTVVGLVSSLLGGTFVGIAYFLTQLIFVNDLDISAPQWPIIAFGGLAGLLGSIVDSYLGATMQYTGLDESTGMVVNSPTNKARHIAGKPILDNNAVNLFSSVLIALLLPTAAWGFWPRG

SEQ ID NO: 91382 - protein, 143 aa, Homo sapiens
  Payload ID: 18281
  Gene Name: transmembrane protein 19
  ENSP ID: ENSP00000448528
MFFLSSSKLTKWKGEVKKRLDSEYKEGGQRNWVQVFCNGAVPTELALLYMIENGPGEIPVDFSKQYSASWMCLSLLAALACSAGDTWASEVGPVLSKSSPRLITTWEKVPVGTNGGVTVVGLVSSLLGGTFVGIAYFLTQLIF

SEQ ID NO: 91383 - protein, 170 aa, Homo sapiens
  Payload ID: 18281
  Gene Name: transmembrane protein 19
  ENSP ID: ENSP00000448587
MTDLNDNICKRYIKMITNIVILSLIICISLAFWIISMTASTYYGNLRPISPWRWLFSVVVPVLIVSNGLKKKSLDHSGALGGLVVGFILTIANFSFFTSLLMFFLSSSKLTKWKGEVKKRLDSEYKEGGQRNWVQVFCNGAVPTELALLYMIENGPGEIPVDFSKQYSAS

SEQ ID NO: 91384 - protein, 298 aa, Homo sapiens
  Payload ID: 18281
  Gene Name: transmembrane protein 19
  Uniprot ID: Q96HH6
  ENSP ID: ENSP00000449955
MTDLNDNICKRYIKMITNIVILSLIICISLAFWIISMTASTYYGNLRPISPWRWLFSVVVPVLIVSNGLKKKSLDHSGALGGLVVGFILTIANFSFFTSLLMFFLSSSKLTKWKGEVKKRLDSEYKEGGQRNWVQVFCNGAVPTELALLYMIENGPGEIPVDFSKQYSASWMCLSLLAALACSAGDTWASEVGPVLSKSSPRLITTWEKVPVGTNGGVTVVGLVSSLLGGTFVGIAYFLTQLIFVNDLDISAPQWPIIAFGGLAGLLGSIVDSYLGATMQYTGKNIPSFLQLIGMLKK

SEQ ID NO: 91385 - protein, 166 aa, Homo sapiens
  Payload ID: 18281
  Gene Name: transmembrane protein 19
  ENSP ID: ENSP00000450089
GEIPVDFSKQYSASWMCLSLLAALACSAGDTWASEVGPVLSKSSPRLITTWEKVPVGTNGGVTVVGLVSSLLGGTFVGIAYFLTQLIFVNDLDISAPQWPIIAFGGLAGLLGSIVDSYLGATMQYTGLDESTGMVVNSPTNKNGQFMLKSLFMERALCNSIIKLPT

SEQ ID NO: 91386 - protein, 177 aa, Homo sapiens
  Payload ID: 18282
  Gene Name: transmembrane protein 190
  Uniprot ID: Q8WZ59
  ENSP ID: ENSP00000291934
MLGCGIPALGLLLLLQGSADGNGIQGFFYPWSCEGDIWDRESCGGQAAIDSPNLCLRLRCCYRNGVCYHQRPDENVRRKHMWALVWTCSGLLLLSCSICLFWWAKRRDVLHMPGFLAGPCDMSKSVSLLSKHRGTKKTPSTGSVPVALSKESRDVEGGTEGEGTEEGEETEGEEEED

SEQ ID NO: 91387 - protein, 121 aa, Homo sapiens
  Payload ID: 18283
  Gene Name: transmembrane protein 191B
  ENSP ID: ENSP00000477586
MEAAEELDAWQSGRELCDGQLRGVQYSTESLMEEMARADRETRLFGGPRALAIRRCVLGALQVLLTLPLLFLGLSLLWTVLLDPGAVSAWLWSLTSETTLRRLRYTLSPLLELRANGLLPT

SEQ ID NO: 91388 - protein, 346 aa, Homo sapiens
  Payload ID: 18283
  Gene Name: transmembrane protein 191B
  Uniprot ID: P0C7N4
  ENSP ID: ENSP00000481358
MCRATLGLPLPPIVIQPARRSLPPIVTPASRRLGPRGGRHLGSVSTAMAATQELLLQLQKDNRDGRQRKQELEKLMRGLEAESESLNQRLQDLSERERSLLRRRSQAAQPLQGEAREAARERAERVRRRLEEAERHKEDLEQHSRQLQEQWEELSSQLFYGGEPQSQKSTEQQLAAQLVTLQNELELAETKCALQEEKLQQDALQTAEAWAIFQEQTVVLQVRPHSDAKVPPASPPPDLGRCDGQLRGVQYSTESLMEEMARADRETRLFGGPRALAIRRCVLGALQVLLTLPLLFLGLSLLWTVLLDPGAVSAWLWSLTSETTLRRLRYTLSPLLELRANGLLPT

SEQ ID NO: 91389 - protein, 118 aa, Homo sapiens
  Payload ID: 18283
  Gene Name: transmembrane protein 191B
  ENSP ID: ENSP00000483146
  MOD_RES (1)..(1): Any amino acid
XSQKSTEQQLAAQLVTLQNELELAETKCALQEEKLQQDALQTAEAWAIFQEQTVVLQVRPHSDAKEVQVKVMEAAEELDAWQSGRELCDGQLRGVQYSTESLMEEMARADRETRLFGG

SEQ ID NO: 91390 - protein, 271 aa, Homo sapiens
  Payload ID: 18284
  Gene Name: transmembrane protein 192
  Uniprot ID: Q8IY95
  ENSP ID: ENSP00000305069
MAAGGRMEDGSLDITQSIEDDPLLDAQLLPHHSLQAHFRPRFHPLPTVIIVNLLWFIHLVFVVLAFLTGVLCSYPNPNEDKCPGNYTNPLKVQTVIILGKVILWILHLLLECYIQYHHSKIRNRGYNLIYRSTRHLKRLALMIQSSGNTVLLLILCMQHSFPEPGRLYLDLILAILALELICSLICLLIYTVKIRRFNKAKPEPDILEEEKIYAYPSNITSETGFRTISSLEEIVEKQGDTIEYLKRHNALLSKRLLALTSSDLGCQPSRT

SEQ ID NO: 91391 - protein, 84 aa, Homo sapiens
  Payload ID: 18284
  Gene Name: transmembrane protein 192
  ENSP ID: ENSP00000424590
MIQSSGNTVLLLILCMQHSFPEPGRLYLDLILAILALELICSLICLLIYTVKIRRFNKAKPEPDILEEEKIYAYPSNITSETGF

SEQ ID NO: 91392 - protein, 267 aa, Homo sapiens
  Payload ID: 18284
  Gene Name: transmembrane protein 192
  Uniprot ID: Q8IY95
  ENSP ID: ENSP00000425335
MNKATGSLDITQSIEDDPLLDAQLLPHHSLQAHFRPRFHPLPTVIIVNLLWFIHLVFVVLAFLTGVLCSYPNPNEDKCPGNYTNPLKVQTVIILGKVILWILHLLLECYIQYHHSKIRNRGYNLIYRSTRHLKRLALMIQSSGNTVLLLILCMQHSFPEPGRLYLDLILAILALELICSLICLLIYTVKIRRFNKAKPEPDILEEEKIYAYPSNITSETGFRTISSLEEIVEKQGDTIEYLKRHNALLSKRLLALTSSDLGCQPSRT

SEQ ID NO: 91393 - protein, 172 aa, Homo sapiens
  Payload ID: 18285
  Gene Name: transmembrane protein 196
  Uniprot ID: Q5HYL7
  ENSP ID: ENSP00000384234
MCTSGQIIGSLLVLSVLEIGLGVSSVAVGAVSFSLALREHKPQLGDSSPFLLCGICGILCAKKKSGLVMILFSACCICGLIGGILNFQFLRAVTKKTSSLYPLHLASMSLACIGIGGCTLSSWLTCRLASYEQRRMFSEREHSLHHSHEMAEKEITDNMSNGGPQLIFNGRV

SEQ ID NO: 91394 - protein, 179 aa, Homo sapiens
  Payload ID: 18285
  Gene Name: transmembrane protein 196
  ENSP ID: ENSP00000385087
MCTSGQIIGSLLVLSVLEIGLGVSSVAVGAVSFSLALREHKPQLGDSSPFLLCGICGILCAKKKSGLVMILFSACCICGLIGGILNFQFLRAVTKKTSSLYPLHLASMSLACIGIGGCTLSSWLTCRLASYEQRRMFSEREHSLHHSHEMAEKRLRAIEITDLPSCPVVPPTPELPTRK

SEQ ID NO: 91395 - protein, 89 aa, Homo sapiens
  Payload ID: 18285
  Gene Name: transmembrane protein 196
  Uniprot ID: Q5HYL7
  ENSP ID: ENSP00000406460
MILFSACCICGLIGGILNFQFLRAVTKKTSSLYPLHLASMSLACIGIGGCTLSSWLTCRLASYEQRRMFSEREHSLHHSHEMAEKIEGY

SEQ ID NO: 91396 - protein, 111 aa, Homo sapiens
  Payload ID: 18285
  Gene Name: transmembrane protein 196
  ENSP ID: ENSP00000414247
MILFSACCICGLIGGILNFQFLRAVTKKTSSLYPLHLASMSLACIGIGGCTLSSWLTCRLASYEQRRMFSEREHSLHHSHEMAEKRLRAIEITDLPSCPVVPPTPELPTRK

SEQ ID NO: 91397 - protein, 104 aa, Homo sapiens
  Payload ID: 18285
  Gene Name: transmembrane protein 196
  Uniprot ID: Q5HYL7
  ENSP ID: ENSP00000438368
MILFSACCICGLIGGILNFQFLRAVTKKTSSLYPLHLASMSLACIGIGGCTLSSWLTCRLASYEQRRMFSEREHSLHHSHEMAEKEITDNMSNGGPQLIFNGRV

SEQ ID NO: 91398 - protein, 360 aa, Homo sapiens
  Payload ID: 18286
  Gene Name: transmembrane protein 198
  Uniprot ID: Q66K66
  ENSP ID: ENSP00000343507
MPGTVATLRFQLLPPEPDDAFWGAPCEQPLERRYQALPALVCIMCCLFGVVYCFFGYRCFKAVLFLTGLLFGSVVIFLLCYRERVLETQLSAGASAGIALGIGLLCGLVAMLVRSVGLFLVGLLLGLLLAAAALLGSAPYYQPGSVWGPLGLLLGGGLLCALLTLRWPRPLTTLATAVTGAALIATAADYFAELLLLGRYVVERLRAAPVPPLCWRSWALLALWPLLSLMGVLVQWRVTAEGDSHTEVVISRQRRRVQLMRIRQQEDRKEKRRKKRPPRAPLRGPRAPPRPGPPDPAYRRRPVPIKRFNGDVLSPSYIQSFRDRQTGSSLSSFMASPTDADYEYGSRGPLTACSGPPVRV

SEQ ID NO: 91399 - protein, 360 aa, Homo sapiens; identical to SEQ ID NO: 91398
  Payload ID: 18286
  Gene Name: transmembrane protein 198
  Uniprot ID: Q66K66
  ENSP ID: ENSP00000362990

SEQ ID NO: 91400 - protein, 227 aa, Homo sapiens
  Payload ID: 18286
  Gene Name: transmembrane protein 198
  ENSP ID: ENSP00000388087
MPGTVATLRFQLLPPEPDDAFWGAPCEQPLERRYQALPALVCIMCCLFGVVYCFFGYRCFKAVLFLTGLLFGSVVIFLLCYRERVLETQLSAGASAGIALGIGLLCGLVAMLVRSVGLFLVGLLLGLLLAAAALLGSAPYYQPGSVWGPLGLLLGGGLLCALLTLRWPRPLTTLATAVTGAALIATAADYFAELLLLGRYVVERLRAAPVPPLCWRSWALLALWPLL

SEQ ID NO: 91401 - protein, 156 aa, Homo sapiens
  Payload ID: 18286
  Gene Name: transmembrane protein 198
  ENSP ID: ENSP00000415186
MGPRFWGGPSPGSCAFPFLRPSPSSRTPRDWSASRCWTWSGAATAPTPFSPAQQPPSSHDGLSLDPSQLEPLAPRNPGPSGLCTASFTQKLRSPPAQLLPPEPDDAFWGAPCEQPLERRYQALPALVCIMCCLFGVVYCFFGYRCFKAVLFLTGLL

SEQ ID NO: 91402 - protein, 208 aa, Homo sapiens
  Payload ID: 18287
  Gene Name: transmembrane protein 199
  Uniprot ID: Q8N511
  ENSP ID: ENSP00000292114
MASSLLAGERLVRALGPGGELEPERLPRKLRAELEAALGKKHKGGDSSSGPQRLVSFRLIRDLHQHLRERDSKLYLHELLEGSEIYLPEVVKPPRNPELVARLEKIKIQLANEEYKRITRNVTCQDTRHGGTLSDLGKQVRSLKALVITIFNFIVTVVAAFVCTYLGSQYIFTEMASRVLAALIVASVVGLAELYVMVRAMEGELGEL

SEQ ID NO: 91403 - protein, 89 aa, Homo sapiens
  Payload ID: 18287
  Gene Name: transmembrane protein 199
  ENSP ID: ENSP00000462195
MASSLLAGERLVRALGPGGELEPERLPRKLRAELEAALGKKHKGGDSSSGPQRLVSFRLIRDLHQHLRERGEPQSPVREPRTSCPAGED

SEQ ID NO: 91404 - protein, 125 aa, Homo sapiens
  Payload ID: 18287
  Gene Name: transmembrane protein 199
  ENSP ID: ENSP00000462356
MASSLLAGERLVRALGPGGELEPERLPRKLRAELEAALGKKHKGGDSSSGPQRLVSFRLIRDLHQHLRERDSKLYLHELLEGSEIYLPEVVKPPRNPELVARLEKIKIQLANEEYKRITRNVTCQ

SEQ ID NO: 91405 - protein, 34 aa, Homo sapiens
  Payload ID: 18287
  Gene Name: transmembrane protein 199
  ENSP ID: ENSP00000465232
MASRVLAALIVASVVGLAELYVMVRAMEGELGEL

SEQ ID NO: 91406 - protein, 176 aa, Homo sapiens
  Payload ID: 18288
  Gene Name: transmembrane protein 2
  ENSP ID: ENSP00000366242
GFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKYVSVTVISNS

SEQ ID NO: 91407 - protein, 1383 aa, Homo sapiens
  Payload ID: 18288
  Gene Name: transmembrane protein 2
  Uniprot ID: Q9UHN6
  ENSP ID: ENSP00000366243
MYATDSRGHSPAFLQPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEGVSLSGFRVEVVDGVKLNLLDDVSSWKPGDQIVVASTDYSMYQAEEFTLLPCSECSHFQVKVKETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSRCITVHGTNGLLIKDTIGFDTLGHCFFLEDGIEQRNTLFHNLGLLTKPGTLLPTDRNNSMCTTMRDKVFGNYIPVPATDCMAVSTFWIAHPNNNLINNAAAGSQDAGIWYLFHKEPTGESSGLQLLAKPELTPLGIFYNNRVHSNFKAGLFIDKGVKTTNSSAADPREYLCLDNSARFRPHQDANPEKPRVAALIDRLIAFKNNDNGAWVRGGDIIVQNSAFADNGIGLTFASDGSFPSDEGSSQEVSESLFVGESRNYGFQGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 91408 - protein, 178 aa, Homo sapiens
  Payload ID: 18288
  Gene Name: transmembrane protein 2
  ENSP ID: ENSP00000366254
LIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGDGVSLCCPGWSAVHRHSCGTLQP

SEQ ID NO: 91409 - protein, 1320 aa, Homo sapiens
  Payload ID: 18288
  Gene Name: transmembrane protein 2
  Uniprot ID: Q9UHN6
  ENSP ID: ENSP00000366266
MYATDSRGHSPAFLQPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSRCITVHGTNGLLIKDTIGFDTLGHCFFLEDGIEQRNTLFHNLGLLTKPGTLLPTDRNNSMCTTMRDKVFGNYIPVPATDCMAVSTFWIAHPNNNLINNAAAGSQDAGIWYLFHKEPTGESSGLQLLAKPELTPLGIFYNNRVHSNFKAGLFIDKGVKTTNSSAADPREYLCLDNSARFRPHQDANPEKPRVAALIDRLIAFKNNDNGAWVRGGDIIVQNSAFADNGIGLTFASDGSFPSDEGSSQEVSESLFVGESRNYGFQGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 91410 - protein, 376 aa, Homo sapiens
  Payload ID: 18288
  Gene Name: transmembrane protein 2
  ENSP ID: ENSP00000379569
MTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 91411 - protein, 580 aa, Homo sapiens
  Payload ID: 18288
  Gene Name: transmembrane protein 2
  ENSP ID: ENSP00000437750
MYATDSRGHSPAFLQPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEGVSLSGFRVEVVDGVKLNLLDDVSSWKPGDQIVVASTDYSMYQAEEFTLLPCSECSHFQVKVKETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSR

SEQ ID NO: 91412 - protein, 18 aa, Homo sapiens
  Payload ID: 18288
  Gene Name: transmembrane protein 2
  ENSP ID: ENSP00000444571
MYATDSRGHSPAFLQPQN

SEQ ID NO: 91413 - protein, 491 aa, Homo sapiens
  Payload ID: 18289
  Gene Name: transmembrane protein 200A
  Uniprot ID: Q86VY9
  ENSP ID: ENSP00000296978
MIATGGVITGLAALKRQDSARSQQHVNLSPSPATQEKKPIRRRPRADVVVVRGKIRLYSPSGFFLILGVLISIIGIAMAVLGYWPQKEHFIDAETTLSTNETQVIRNEGGVVVRFFEQHLHSDKMKMLGPFTMGIGIFIFICANAILHENRDKETKIIHMRDIYSTVIDIHTLRIKEQRQMNGMYTGLMGETEVKQNGSSCASRLAANTIASFSGFRSSFRMDSSVEEDELMLNEGKSSGHLMPPLLSDSSVSVFGLYPPPSKTTDDKTSGSKKCETKSIVSSSISAFTLPVIKLNNCVIDEPSIDNITEDADNLKSRSRNLSMDSLVVPLPNTSESFQPVSTVLPRNNSIGESLSSQYKSSMALGPGAGQLLSPGAARRQFGSNTSLHLLSSHSKSLDLDRGPSTLTVQAEQRKHPSWPRLDRNNSKGYMKLENKEDPMDRLLVPQVAIKKDFTNKEKLLMISRSHNNLSFEHDEFLSNNLKRGTSETRF

SEQ ID NO: 91414 - protein, 491 aa, Homo sapiens; identical to SEQ ID NO: 91413
  Payload ID: 18289
  Gene Name: transmembrane protein 200A
  Uniprot ID: Q86VY9
  ENSP ID: ENSP00000376224

SEQ ID NO: 91415 - protein, 491 aa, Homo sapiens; identical to SEQ ID NO: 91413
  Payload ID: 18289
  Gene Name: transmembrane protein 200A
  Uniprot ID: Q86VY9
  ENSP ID: ENSP00000438928

SEQ ID NO: 91416 - protein, 491 aa, Homo sapiens; identical to SEQ ID NO: 91413
  Payload ID: 18289
  Gene Name: transmembrane protein 200A
  Uniprot ID: Q86VY9
  ENSP ID: ENSP00000480294

SEQ ID NO: 91417 - protein, 307 aa, Homo sapiens
  Payload ID: 18290
  Gene Name: transmembrane protein 200B
  Uniprot ID: Q69YZ2
  ENSP ID: ENSP00000428459
MTAGSPEECGEVRRSPEGRVSRLGRRLGRRRRPRSPPEPLRVRARLRLRSPSGAFAALGALVVLVGMGIAVAGYWPHRAGAPGSRAANASSPQMSELRREGRGGGRAHGPHERLRLLGPVIMGVGLFVFICANTLLYENRDLETRRLRQGVLRAQALRPPDGPGWDCALLPSPGPRSPRAVGCAEPEIWDPSPRRGTSPVPSVRSLRSEPANPRLGLPALLNSYPLKGPGLPPPWGPRTQTGHVIITVQPSGSCIEHSKSLDLGLGELLLGAPAARDCAHRSWPRLDRLSLGGYAKLGGGGDLGARV

SEQ ID NO: 91418 - protein, 307 aa, Homo sapiens; identical to SEQ ID NO: 91417
  Payload ID: 18290
  Gene Name: transmembrane protein 200B
  Uniprot ID: Q69YZ2
  ENSP ID: ENSP00000428544

SEQ ID NO: 91419 - protein, 621 aa, Homo sapiens
  Payload ID: 18291
  Gene Name: transmembrane protein 200C
  Uniprot ID: A6NKL6
  ENSP ID: ENSP00000372982
MIATGGLLRISARKQDPLRPPSQIPKRKRKAKKRRKNDVVVVKGKLKLCSISGLIALCGILVLLVGIAMAVVGYWPKATGTNREGGKQLPPAGSSHRVPTTANSSSSGSKNRSRSHPRAPGGVNSSSAGAPRSTPPARAASPSSSSTSVGFFFRIFSGYLHSDKLKVFGPLIMGIGIFLFICANAVLHENRDKKTKIINLRDLYSTVIDVHSLRAKDLAAAAAAAAAAAASSSSSAPAAAPPGAIPLNGFLSYVQSRGLELKPGGCGGSGDAFGAAAMLAKGSWPPHPAAPSGGRPRGAASPPDLASSPRCPREPPSLAEAVYSVYRERSGVAGSRRAAAATAAAAASSCSSPAPCSPPESWGRQSTASSFVDSSLSAFALLPLQGGRDRGGDAEGASCSWQRPPGERGSQEIPRGELDLSMTNLRGAEGSMRGARREPEEPEGAVAARAARGQGGRLPRTGRYAALRRRSTSGLPDYRAPPSPEPPPSPGSADPDSSPLAKAASPSPPLRLEGSPPTRRDSGSSQSDDPSSSNKGYTPLREAGTSTESVLDAVAGQTRDSAVAAPVLGAEQSSPEGASQEPPTAEQPQPVQRQFTNKEKLIMISRSHAIGVEEELESTGI

SEQ ID NO: 91420 - protein, 621 aa, Homo sapiens; identical to SEQ ID NO: 91419
  Payload ID: 18291
  Gene Name: transmembrane protein 200C
  Uniprot ID: A6NKL6
  ENSP ID: ENSP00000463375

SEQ ID NO: 91421 - protein, 666 aa, Homo sapiens
  Payload ID: 18292
  Gene Name: transmembrane protein 201
  Uniprot ID: Q5SNT2
  ENSP ID: ENSP00000344503
MEGVSALLARCPTAGLAGGLGVTACAAAGVLLYRIARRMKPTHTMVNCWFCNQDTLVPYGNRNCWDCPHCEQYNGFQENGDYNKPIPAQYLEHLNHVVSSAPSLRDPSQPQQWVSSQVLLCKRCNHHQTTKIKQLAAFAPREEGRYDEEVEVYRHHLEQMYKLCRPCQAAVEYYIKHQNRQLRALLLSHQFKRREADQTHAQNFSSAVKSPVQVILLRALAFLACAFLLTTALYGASGHFAPGTTVPLALPPGGNGSATPDNGTTPGAEGWRQLLGLLPEHMAEKLCEAWAFGQSHQTGVVALGLLTCLLAMLLAGRIRLRRIDAFCTCLWALLLGLHLAEQHLQAASPSWLDTLKFSTTSLCCLVGFTAAVATRKATGPRRFRPRRFFPGDSAGLFPTSPSLAIPHPSVGGSPASLFIPSPPSFLPLANQQLFRSPRRTSPSSLPGRLSRALSLGTIPSLTRADSGYLFSGSRPPSQVSRSGEFPVSDYFSLLSGSCPSSPLPSPAPSVAGSVASSSGSLRHRRPLISPARLNLKGQKLLLFPSPPGEAPTTPSSSDEHSPHNGSLFTMEPPHVPRKPPLQDVKHALDLRSKLERGSACSNRSIKKEDDSSQSSTCVVDTTTRGCSEEAATWRGRFGPSLVRGLLAVSLAANALFTSVFLYQSLR

SEQ ID NO: 91422 - protein, 392 aa, Homo sapiens
  Payload ID: 18292
  Gene Name: transmembrane protein 201
  Uniprot ID: Q5SNT2
  ENSP ID: ENSP00000344772
MEGVSALLARCPTAGLAGGLGVTACAAAGVLLYRIARRMKPTHTMVNCWFCNQDTLVPYGNRNCWDCPHCEQYNGFQENGDYNKPIPAQYLEHLNHVVSSAPSLRDPSQPQQWVSSQVLLCKRCNHHQTTKIKQLAAFAPREEGRYDEEVEVYRHHLEQMYKLCRPCQAAVEYYIKHQNRQLRALLLSHQFKRREADQTHAQNFSSAVKSPVQVILLRALAFLACAFLLTTALYGASGHFAPGTTVPLALPPGGNGSATPDNGTTPGAEGWRQLLGLLPEHMAEKLCEAWAFGQSHQTGVVALGLLTCLLAMLLAGRIRLRRIDAFCTCLWALLLGLHLAEQHLQAASPSWLDTLKFSTTSLCCLVGFTAAVATRKATGPRRFRPRRSEKQP

SEQ ID NO: 91423 - protein, 552 aa, Homo sapiens
  Payload ID: 18292
  Gene Name: transmembrane protein 201
  ENSP ID: ENSP00000393626
  MOD_RES (1)..(1): Any amino acid
XEHLNHVVSSAPSLRDPSQPQQWVSSQVLLCKRCNHHQTTKIKQLAAFAPREEGRYDEEVEVYRHHLEQMYKLCRPCQAAVEYYIKHQNRQLRALLLSHQFKRREADQTHAQNFSSAVKSPVQVILLRALAFLACAFLLTTALYGASGHFAPGTTVPLALPPGGNGSATPDNGTTPGAEGWRQLLGLLPEHMAEKLCEAWAFGQSHQTGVVALGLLTCLLAMLLAGRIRLRRIDAFCTCLWALLLGLHLAEQHLQAASPSWLDTLKFSTTSLCCLVGFTAAVATRKATGPRRFRPRRFFPGDSAGLFPTSPSLAIPHPSVGGSPASLFIPSPPSFLPLANQQLFRSPRRTSPSSLPGRLSRALSLGTIPSLTRADYFSLLSGSCPSSPLPSPAPSVAGSVASSSGSLRHRRPLISPARLNLKGQKLLLFPSPPGEAPTTPSSSDEHSPHNGSLFTMEPPHVPRKPPLQDVKHALDLRSKLERGSACSNRSIKKEDDSSQSSTCVVDTTTRGCSEEAATWRGRFGPSLVRGLLAVSLAANALFTSVFLYQSLR

SEQ ID NO: 91424 - protein, 166 aa, Homo sapiens
  Payload ID: 18292
  Gene Name: transmembrane protein 201
  ENSP ID: ENSP00000423430
  MOD_RES (1)..(1): Any amino acid
XLPGRLSRALSLGTIPSLTRADSGYLFSGSRPPSQVSRSGEFPVSDYFSLLSGSCPSSPLPSPAPSVAGSVASSSGSLRHRRPLISPARLNLKGQKLLLFPSPPGEAPTTPSSSDEHSPHNGSLFTMEPPHVPRKPPLQDVKHALVDLQGPLFLGTDRKHITHCQT

SEQ ID NO: 91425 - protein, 273 aa, Homo sapiens
  Payload ID: 18293
  Gene Name: transmembrane protein 202
  Uniprot ID: A6NGA9
  ENSP ID: ENSP00000340212
MERREHLTLTFHSPEVPKIKGNRKYQRPTVPAKKHPSASMSCQRQQQLMDQAHIYIRTLCGSLCSFSLLMLIAMSPLNWVQFLVIKNGLELYAGLWTLCNHELCWSHTPKPPYYLQYSRAFFLISVFTILTGLGWLFSSWILNRGSMTTNLDLKVSMLSFISATCLLLCLNLFVAQVHWHTRDAMESDLLWTYYLNWCSDIFYMFAGIISLLNYLTSRSPACDENVTVIPTERSRLGVGPVTTVSPAKDEGPRSEMESLSVREKNLPKSGLWW

SEQ ID NO: 91426 - protein, 61 aa, Homo sapiens
  Payload ID: 18293
  Gene Name: transmembrane protein 202
  ENSP ID: ENSP00000456083
MERREHLTLTFHSPEVPKIKGNRKYQRIISNIPGPSFSSLSLPYLLALAGSSALGSLIEEA

SEQ ID NO: 91427 - protein, 61 aa, Homo sapiens; identical to SEQ ID NO: 91426
  Payload ID: 18293
  Gene Name: transmembrane protein 202
  ENSP ID: ENSP00000457632

SEQ ID NO: 91428 - protein, 136 aa, Homo sapiens
  Payload ID: 18294
  Gene Name: transmembrane protein 203
  Uniprot ID: Q969S6
  ENSP ID: ENSP00000375053
MLFSLRELVQWLGFATFEIFVHLLALLVFSVLLALRVDGLVPGLSWWNVFVPFFAADGLSTYFTTIVSVRLFQDGEKRLAVLRLFWVLTVLSLKFVFEMLLCQKLAEQTRELWFGLITSPLFILLQLLMIRACRVN

SEQ ID NO: 91429 - protein, 226 aa, Homo sapiens
  Payload ID: 18295
  Gene Name: transmembrane protein 204
  Uniprot ID: Q9BSN7
  ENSP ID: ENSP00000253934
MTVQRLVAAAVLVALVSLILNNVAAFTSNWVCQTLEDGRRRSVGLWRSCWLVDRTRGGPSPGARAGQVDAHDCEALGWGSEAAGFQESRGTVKLQFDMMRACNLVATAALTAGQLTFLLGLVGLPLLSPDAPCWEEAMAAAFQLASFVLVIGLVTFYRIGPYTNLSWSCYLNIGACLLATLAAAMLIWNILHKREDCMAPRVIVISRSLTARFRRGLDNDYVESPC

SEQ ID NO: 91430 - protein, 226 aa, Homo sapiens; identical to SEQ ID NO: 91429
  Payload ID: 18295
  Gene Name: transmembrane protein 204
  Uniprot ID: Q9BSN7
  ENSP ID: ENSP00000454945

SEQ ID NO: 91431 - protein, 189 aa, Homo sapiens
  Payload ID: 18296
  Gene Name: transmembrane protein 205
  Uniprot ID: Q6UW68
  ENSP ID: ENSP00000346954
MEEGGNLGGLIKMVHLLVLSGAWGMQMWVTFVSGFLLFRSLPRHTFGLVQSKLFPFYFHISMGCAFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLGCVLSNGLCLAGLALEIRSL

SEQ ID NO: 91432 - protein, 189 aa, Homo sapiens; identical to SEQ ID NO: 91431
  Payload ID: 18296
  Gene Name: transmembrane protein 205
  Uniprot ID: Q6UW68
  ENSP ID: ENSP00000398258

SEQ ID NO: 91433 - protein, 189 aa, Homo sapiens; identical to SEQ ID NO: 91431
  Payload ID: 18296
  Gene Name: transmembrane protein 205
  Uniprot ID: Q6UW68
  ENSP ID: ENSP00000465149

SEQ ID NO: 91434 - protein, 107 aa, Homo sapiens
  Payload ID: 18296
  Gene Name: transmembrane protein 205
  ENSP ID: ENSP00000465283
MEEGGNLGGLIKMVHLLVLSGAWGMQMWVTFVSGFLLFRSLPRHTFGLVQSKLFPFYFHISMGCAFINLCILASQHAWAQLTFWEASQLYLLFLSLTLATVNARWLE

SEQ ID NO: 91435 - protein, 189 aa, Homo sapiens; identical to SEQ ID NO: 91431
  Payload ID: 18296
  Gene Name: transmembrane protein 205
  Uniprot ID: Q6UW68
  ENSP ID: ENSP00000465483

SEQ ID NO: 91436 - protein, 189 aa, Homo sapiens; identical to SEQ ID NO: 91431
  Payload ID: 18296
  Gene Name: transmembrane protein 205
  Uniprot ID: Q6UW68
  ENSP ID: ENSP00000465553

SEQ ID NO: 91437 - protein, 170 aa, Homo sapiens
  Payload ID: 18296
  Gene Name: transmembrane protein 205
  ENSP ID: ENSP00000466180
MEEGGNLGGLIKMVHLLVLSGAWGMQMWVTFVSGFLLFRSLPRHTFGLVQSKLFPFYFHISMGCAFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLG

SEQ ID NO: 91438 - protein, 120 aa, Homo sapiens
  Payload ID: 18296
  Gene Name: transmembrane protein 205
  ENSP ID: ENSP00000466310
MGCAFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLGCVLSNGLCLAG

SEQ ID NO: 91439 - protein, 189 aa, Homo sapiens; identical to SEQ ID NO: 91431
  Payload ID: 18296
  Gene Name: transmembrane protein 205
  Uniprot ID: Q6UW68
  ENSP ID: ENSP00000466495

SEQ ID NO: 91440 - protein, 123 aa, Homo sapiens
  Payload ID: 18296
  Gene Name: transmembrane protein 205
  ENSP ID: ENSP00000466672
MEEGGNLGGLIKMVHLLVLSGAWGMQMWVTFVSALPAVPEPYAGHCQRPLAGTPHHSCHVGPANRGEGARPGWGGTRQPPGSRSLPPAAREGPQVQCSPPEFLPLPWAVLSLQSGLRPEQWAL

SEQ ID NO: 91441 - protein, 189 aa, Homo sapiens; identical to SEQ ID NO: 91431
  Payload ID: 18296
  Gene Name: transmembrane protein 205
  Uniprot ID: Q6UW68
  ENSP ID: ENSP00000466986

SEQ ID NO: 91442 - protein, 128 aa, Homo sapiens
  Payload ID: 18296
  Gene Name: transmembrane protein 205
  ENSP ID: ENSP00000467493
MGCAFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLGCVLSNGLCLAGLALEIRSL

SEQ ID NO: 91443 - protein, 88 aa, Homo sapiens
  Payload ID: 18296
  Gene Name: transmembrane protein 205
  ENSP ID: ENSP00000468056
MEEGGNLGGLIKMVHLLVLSGAWGMQMWVTFVSGFLLFRSLPRHTFGLVQSKLFPFYFHISMGCAFINLCILASQHAWAQLTFWEASQ

SEQ ID NO: 91444 - protein, 189 aa, Homo sapiens; identical to SEQ ID NO: 91431
  Payload ID: 18296
  Gene Name: transmembrane protein 205
  Uniprot ID: Q6UW68
  ENSP ID: ENSP00000468733

SEQ ID NO: 91445 - protein, 350 aa, Homo sapiens
  Payload ID: 18297
  Gene Name: transmembrane protein 206
  Uniprot ID: Q9H813
  ENSP ID: ENSP00000261455
MIRQERSTSYQELSEELVQVVENSELADEQDKETVRVQGPGILPGLDSESASSSIRFSKACLKNVFSVLLIFIYLLLMAVAVFLVYRTITDFREKLKHPVMSVSYKEVDRYDAPGIALYPGQAQLLSCKHHYEVIPPLTSPGQPGDMNCTTQRINYTDPFSNQTVKSALIVQGPREVKKRELVFLQFRLNKSSEDFSAIDYLLFSSFQEFLQSPNRVGFMQACESAYSSWKFSGGFRTWVKMSLVKTKEEDGREAVEFRQETSVVNYIDQRPAAKKSAQLFFVVFEWKDPFIQKVQDIVTANPWNTIALLCGAFLALFKAAEFAKLSIKWMIKIRKRYLKRRGQATSHIS

SEQ ID NO: 91446 - protein, 411 aa, Homo sapiens
  Payload ID: 18297
  Gene Name: transmembrane protein 206
  Uniprot ID: Q9H813
  ENSP ID: ENSP00000438863
MIRQERSTSYQEAVRPALPSSKPCLLTSPAVLVKLLSSSASTSRPPNLGHLWQPSSSVPLHRAASLAKVRQFQLSEELVQVVENSELADEQDKETVRVQGPGILPGLDSESASSSIRFSKACLKNVFSVLLIFIYLLLMAVAVFLVYRTITDFREKLKHPVMSVSYKEVDRYDAPGIALYPGQAQLLSCKHHYEVIPPLTSPGQPGDMNCTTQRINYTDPFSNQTVKSALIVQGPREVKKRELVFLQFRLNKSSEDFSAIDYLLFSSFQEFLQSPNRVGFMQACESAYSSWKFSGGFRTWVKMSLVKTKEEDGREAVEFRQETSVVNYIDQRPAAKKSAQLFFVVFEWKDPFIQKVQDIVTANPWNTIALLCGAFLALFKAAEFAKLSIKWMIKIRKRYLKRRGQATSHIS

SEQ ID NO: 91447 - protein, 146 aa, Homo sapiens
  Payload ID: 18298
  Gene Name: transmembrane protein 207
  Uniprot ID: Q6UWW9
  ENSP ID: ENSP00000346981
MSRSRLFSVTSAISTIGILCLPLFQLVLSDLPCEEDEMCVNYNDQHPNGWYIWILLLLVLVAALLCGAVVLCLQCWLRRPRIDSHRRTMAVFAVGDLDSIYGTEAAVSPTVGIHLQTQTPDLYPVPAPCFGPLGSPPPYEEIVKTT

SEQ ID NO: 91448 - protein, 173 aa, Homo sapiens
  Payload ID: 18299
  Gene Name: transmembrane protein 208
  Uniprot ID: Q9BTX3
  ENSP ID: ENSP00000305892
MAPKGKVGTRGKKQIFEENRETLKFYLRIILGANAIYCLVTLVFFYSSASFWAWLALGFSLAVYGASYHSMSSMARAAFSEDGALMDGGMDLNMEQGMAEHLKDVILLTAIVQVLSCFSLYVWSFWLLAPGRALYLLWVNVLGPWFTADSGTPAPEHNEKRQRRQERRQMKRL

SEQ ID NO: 91449 - protein, 140 aa, Homo sapiens
  Payload ID: 18299
  Gene Name: transmembrane protein 208
  ENSP ID: ENSP00000454579
MAPKGKVGTRGKKQIFEENRETLKFYLRIILGANAIYCLVTLVFFYSSASFWAWLALGFSLAVYGASYHSMSSMARAAFSEDGALMDGGMDLNMEQGMAEHLKDVILLTAIVQVLSCFSLYVWSFWLLVCGLGALPRRGI

SEQ ID NO: 91450 - protein, 100 aa, Homo sapiens
  Payload ID: 18299
  Gene Name: transmembrane protein 208
  Uniprot ID: Q9BTX3
  ENSP ID: ENSP00000457502
MAPKGKVGTRGKKQIFEENRETLKFYLRIILGANAIYCLVTLVFFYSSASFWAWLALGFSLAVYGASYHSMSSMARAAFSEDGALMDGGMDLNMEQGMAE

SEQ ID NO: 91451 - protein, 103 aa, Homo sapiens
  Payload ID: 18299
  Gene Name: transmembrane protein 208
  ENSP ID: ENSP00000462217
MSSMARAAFSEDGALMDGGMDLNMEQGMAEHLKDVILLTAIVQVLSCFSLYVWSFWLLAPGRALYLLWVNVLGPWFTADSGTPAPEHNEKRQRRQERRQMKRL

SEQ ID NO: 91452 - protein, 36 aa, Homo sapiens
  Payload ID: 18299
  Gene Name: transmembrane protein 208
  ENSP ID: ENSP00000464439
MAGEQEAIDPSCGCWRDGVSPRQNGLEDGWTSQGFC

SEQ ID NO: 91453 - protein, 561 aa, Homo sapiens
  Payload ID: 18300
  Gene Name: transmembrane protein 209
  Uniprot ID: Q96SK2
  ENSP ID: ENSP00000380747
MMQGEAHPSASLIDRTIKMRKETEARKVVLAWGLLNVSMAGMIYTEMTGKLISSYYNVTYWPLWYIELALASLFSLNALFDFWRYFKYTVAPTSLVVSPGQQTLLGLKTAVVQTTPPHDLAATQIPPAPPSPSIQGQSVLSYSPSRSPSTSPKFTTSCMTGYSPQLQGLSSGGSGSYSPGVTYSPVSGYNKLASFSPSPPSPYPTTVGPVESSGLRSRYRSSPTVYNSPTDKEDYMTDLRTLDTFLRSEEEKQHRVKLGSPDSTSPSSSPTFWNYSRSMGDYAQTLKKFQYQLACRSQAPCANKDEADLSSKQAAEEVWARVAMNRQLLDHMDSWTAKFRNWINETILVPLVQEIESVSTQMRRMGCPELQIGEASITSLKQAALVKAPLIPTLNTIVQYLDLTPNQEYLFERIKELSQGGCMSSFRWNRGGDFKGRKWDTDLPTDSAIIMHVFCTYLDSRLPPHPKYPDGKTFTSQHFVQTPNKPDVTNENVFCIYQSAINPPHYELIYQRHVYNLPKGRNNMFHTLLMFLYIIKTKESGMLGRVNLGLSGVNILWIFGE

SEQ ID NO: 91454 - protein, 519 aa, Homo sapiens
  Payload ID: 18300
  Gene Name: transmembrane protein 209
  Uniprot ID: Q96SK2
  ENSP ID: ENSP00000417258
MMQGEAHPSASLIDRTIKMRKETEARKVVLAWGLLNVSMAGMIYTEMTGKLISSYYNVTYWPLWYIELALASLFSLNALFDFWRYFKYTVAPTSLVVSPGQQTLLGLKTAVVQTTPPHDLAATQIPPAPPSPSIQGQSVLSYSPSRSPSTSPKFTTSCMTGYSPQLQGLSSGGSGSYSPGVTYSPVSGYNKLASFSPSPPSPYPTTVGPVESSGLRSRYRSSPTVYNSPTDKEDYMTDLRTLDTFLRSEEEKQHRVKLGSPDSTSPSSSPTFWNYSRSMGDYAQTLKKFQYQLACRSQAPCANKDEADLSSKQAAEEVWARVAMNRQLLDHMDSWTAKFRNWINETILVPLVQEIESVSTQMRRMGCPELQIGELSQGGCMSSFRWNRGGDFKGRKWDTDLPTDSAIIMHVFCTYLDSRLPPHPKYPDGKTFTSQHFVQTPNKPDVTNENVFCIYQSAINPPHYELIYQRHVYNLPKGRNNMFHTLLMFLYIIKTKESGMLGRVNLGLSGVNILWIFGE

SEQ ID NO: 91455 - protein, 56 aa, Homo sapiens
  Payload ID: 18300
  Gene Name: transmembrane protein 209
  ENSP ID: ENSP00000418474
MQGEAHPSASLIDRTIKMRKETEARKVVLAWGLLNVSMAGMIYTEMTGKLISSYYN

SEQ ID NO: 91456 - protein, 560 aa, Homo sapiens
  Payload ID: 18300
  Gene Name: transmembrane protein 209
  Uniprot ID: Q96SK2
  ENSP ID: ENSP00000419697
MQGEAHPSASLIDRTIKMRKETEARKVVLAWGLLNVSMAGMIYTEMTGKLISSYYNVTYWPLWYIELALASLFSLNALFDFWRYFKYTVAPTSLVVSPGQQTLLGLKTAVVQTTPPHDLAATQIPPAPPSPSIQGQSVLSYSPSRSPSTSPKFTTSCMTGYSPQLQGLSSGGSGSYSPGVTYSPVSGYNKLASFSPSPPSPYPTTVGPVESSGLRSRYRSSPTVYNSPTDKEDYMTDLRTLDTFLRSEEEKQHRVKLGSPDSTSPSSSPTFWNYSRSMGDYAQTLKKFQYQLACRSQAPCANKDEADLSSKQAAEEVWARVAMNRQLLDHMDSWTAKFRNWINETILVPLVQEIESVSTQMRRMGCPELQIGEASITSLKQAALVKAPLIPTLNTIVQYLDLTPNQEYLFERIKELSQGGCMSSFRWNRGGDFKGRKWDTDLPTDSAIIMHVFCTYLDSRLPPHPKYPDGKTFTSQHFVQTPNKPDVTNENVFCIYQSAINPPHYELIYQRHVYNLPKGRNNMFHTLLMFLYIIKTKESGMLGRVNLGLSGVNILWIFGE

SEQ ID NO: 91457 - protein, 189 aa, Homo sapiens
  Payload ID: 18300
  Gene Name: transmembrane protein 209
  ENSP ID: ENSP00000419852
MLLGLLSLWKGLTLSPRLECSGTILAHRNLGFPGSSDSPASASRMQGEAHPSASLIDRTIKMRKETEARKVVLAWGLLNVSMAGMIYTEMTGKLISSYYNVTYWPLWYIELALASLFSLNALFDFWRYFKYTVAPTSLVVSPGQQTLLGLKTAVVQTTPPHDLAATQIPPAPPSPSIQGQSVLSYSPSR

SEQ ID NO: 91458 - protein, 53 aa, Homo sapiens
  Payload ID: 18301
  Gene Name: transmembrane protein 210
  ENSP ID: ENSP00000454984
MAPGPWPVSCLRGGPLGLTYLSLLLIPAAGASSCPRTPLPAMAPLPQASWNLL

SEQ ID NO: 91459 - protein, 147 aa, Homo sapiens
  Payload ID: 18301
  Gene Name: transmembrane protein 210
  Uniprot ID: A6NLX4
  ENSP ID: ENSP00000456333
MAPGPWPVSCLRGGPLGLTYLSLLLIPAAAGTYCECSLGLSREALIALLVVLAGISASCFCALVIVAIGVLRAKGETCPRQVDNRLVENFGVQEDLMDLHPVYVESQLMDADLEVSLVPPLEDQSLVAIPMEASSEEPPPPPPLPPE

SEQ ID NO: 91460 - protein, 129 aa, Homo sapiens
  Payload ID: 18302
  Gene Name: transmembrane protein 211
  ENSP ID: ENSP00000385494
MLLGGWLLLAFNAIFLLSWAVAPKGLCPRRSSVPMPGVQAVAATAMIVGLLIFPIGLASPFIKEVCEASSMYYGGKCRLGWGYMTAILNAVLASLLPIISWPHTTKVQGRTIIFSSATERIIFVPEMNK

SEQ ID NO: 91461 - protein, 200 aa, Homo sapiens
  Payload ID: 18302
  Gene Name: transmembrane protein 211
  Uniprot ID: Q6ICI0
  ENSP ID: ENSP00000387813
MLSSVWVALGLSLTCTSAFSLISPAWFQTPTFSFGILTYCSWPQGNSWNQSCVTFSSLEDIPDFAWKVSAVMLLGGWLLLAFNAIFLLSWAVAPKGLCPRRSSVPMPGVQAVAATAMIVGLLIFPIGLASPFIKEVCEASSMYYGGKCRLGWGYMTAILNAVLASLLPIISWPHTTKVQGRTIIFSSATERIIFVPEMNK

SEQ ID NO: 91462 - protein, 194 aa, Homo sapiens
  Payload ID: 18303
  Gene Name: transmembrane protein 212
  Uniprot ID: A6NML5
  ENSP ID: ENSP00000334072
MKGLYQAAGRILVTLGILSVCSGVIAFFPVFSYKPWFTGWSVRIACPIWNGALAITTGVLLLLAYREWTQRYLGEATFTFVILSIMGCPLHFAIALESALLGPYCFYSFSGIAGTNYLGYAVTFPYPYAKFPLACVDPPHYEEYHLTLQALDLCLSFTLLCTSLTVFIKLSARLIQNGHINMQLPAGNPNPFSP

SEQ ID NO: 91463 - protein, 150 aa, Homo sapiens
  Payload ID: 18303
  Gene Name: transmembrane protein 212
  ENSP ID: ENSP00000393684
ACPIWNGALAITTGVLLLLAYREWTQRYLGEATFTFVILSIMGCPLHFAIALESALLGPYCFYSFSGIAGTNYLGYAVTFPYPYAKFPLACVDPPHYEEYHLTLQALDLCLSFTLLCTSLTVFIKLSARLIQNGHINMQLPAGNPNPFSP

SEQ ID NO: 91464 - protein, 189 aa, Homo sapiens
  Payload ID: 18303
  Gene Name: transmembrane protein 212
  ENSP ID: ENSP00000410327
  MOD_RES (1)..(1): Any amino acid
XAAGRILVTLGILSVCSGVIAFFPVFSYKPWFTGWSVRIACPIWNGALAITTGVLLLLAYREWTQRYLGEATFTFVILSIMGCPLHFAIALESALLGPYCFYSFSGIAGTNYLGYAVTFPYPYAKFPLACVDPPHYEEYHLTLQALDLCLSFTLLCTSLTVFIKLSARLIQNGHINMQLPAGNPNPFSP

SEQ ID NO: 91465 - protein, 194 aa, Homo sapiens; identical to SEQ ID NO: 91462
  Payload ID: 18303
  Gene Name: transmembrane protein 212
  Uniprot ID: A6NML5
  ENSP ID: ENSP00000484106

SEQ ID NO: 91466 - protein, 106 aa, Homo sapiens
  Payload ID: 18304
  Gene Name: transmembrane protein 213
  Uniprot ID: A2RRL7
  ENSP ID: ENSP00000380727
MQRLPAATRATLILSLAFASLHSACSAASSSNSSSLTAHHPDPGTLEQCLNVDFCPQAARCCRTGVDEYGWIAAAVGWSLWFLTLILLCVDKLMKLTPDEPKDLQA

SEQ ID NO: 91467 - protein, 107 aa, Homo sapiens
  Payload ID: 18304
  Gene Name: transmembrane protein 213
  Uniprot ID: A2RRL7
  ENSP ID: ENSP00000390407
MQRLPAATRATLILSLAFASLHSACSAEASSSNSSSLTAHHPDPGTLEQCLNVDFCPQAARCCRTGVDEYGWIAAAVGWSLWFLTLILLCVDKLMKLTPDEPKDLQA

SEQ ID NO: 91468 - protein, 83 aa, Homo sapiens
  Payload ID: 18304
  Gene Name: transmembrane protein 213
  Uniprot ID: A2RRL7
  ENSP ID: ENSP00000393891
MQRLPAATRATLILSLAFASLHSACSADVDFCPQAARCCRTGVDEYGWIAAAVGWSLWFLTLILLCVDKLMKLTPDEPKDLQA

SEQ ID NO: 91469 - protein, 105 aa, Homo sapiens
  Payload ID: 18304
  Gene Name: transmembrane protein 213
  Uniprot ID: A2RRL7
  ENSP ID: ENSP00000401570
MQRLPAATRATLILSLAFASLHSACSAEASSSNSSSLTAHHPDPGTLEQCLRSGYLANLRGEADQLWKFCTVLCFWESRRSSSRIALMREAEEWPGWRSSVELVG

SEQ ID NO: 91470 - protein, 689 aa, Homo sapiens
  Payload ID: 18305
  Gene Name: transmembrane protein 214
  Uniprot ID: Q6NUQ4
  ENSP ID: ENSP00000238788
MATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHDYPYSLVSRELRGIIRGLLAKAAGSLELFFDHCLFTMLQELDKTPGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKELLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEACRGEVTWDCMKTQLSEAVHWTWLCLQDITVAFLDWALALISQQ

SEQ ID NO: 91471 - protein, 689 aa, Homo sapiens; identical to SEQ ID NO: 91470
  Payload ID: 18305
  Gene Name: transmembrane protein 214
  Uniprot ID: Q6NUQ4
  ENSP ID: ENSP00000319469

SEQ ID NO: 91472 - protein, 644 aa, Homo sapiens
  Payload ID: 18305
  Gene Name: transmembrane protein 214
  Uniprot ID: Q6NUQ4
  ENSP ID: ENSP00000384417
MATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKELLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEACRGEVTWDCMKTQLSEAVHWTWLCLQDITVAFLDWALALISQQ

SEQ ID NO: 91473 - protein, 140 aa, Homo sapiens
  Payload ID: 18305
  Gene Name: transmembrane protein 214
  ENSP ID: ENSP00000389729
  MOD_RES (1)..(1): Any amino acid
XSLQETIQSLKLTNQELLRKGSSNNQDVVTCDMACKGLLQQVQGPRLPWTRLLLLLLVFAVGFLCHDLRSHSSFQAGWGRHCRSGAPTCSPWCGPACSWPGLTPMPQSASFLPTVPLTLRGLVTVSPVSLRGYRSSSPIP

SEQ ID NO: 91474 - protein, 306 aa, Homo sapiens
  Payload ID: 18305
  Gene Name: transmembrane protein 214
  ENSP ID: ENSP00000392442
KRQHIQGGCAAWMALLTGRGSPLSTPRLCQPHAPSSLSLCRAVQLLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEA

SEQ ID NO: 91475 - protein, 247 aa, Homo sapiens
  Payload ID: 18305
  Gene Name: transmembrane protein 214
  ENSP ID: ENSP00000393490
  MOD_RES (1)..(1): Any amino acid
XELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKELPVDSCLPRSLELHPQKMDPKRQHIQLLSSLTECLTVDPLSASVWRQLYPKHLSQSSLLLEHLLSSWEQIPKKVQKSLQETIQSLKLTNQELLRKGSSNNQDVV

SEQ ID NO: 91476 - protein, 225 aa, Homo sapiens
  Payload ID: 18305
  Gene Name: transmembrane protein 214
  ENSP ID: ENSP00000395061
SQHTHDYPYSLVSRELRGIIRGLLAKAAGSLELFFDHCLFTMLQELDKTPGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKESPF

SEQ ID NO: 91477 - protein, 235 aa, Homo sapiens
  Payload ID: 18306
  Gene Name: transmembrane protein 215
  Uniprot ID: Q68D42
  ENSP ID: ENSP00000345468
MRPDDINPRTGLVVALVSVFLVFGFMFTVSGMKGETLGNIPLLAIGPAICLPGIAAIALARKTEGCTKWPENELLWVRKLPCFRKPKDKEVVELLRTPSDLESGKGSSDELAKKAGLRGKPPPQSQGEVSVASSINSPTPTEEGECQSLVQNGHQEETSRYLDGYCPSGSSLTYSALDVKCSARDRSECPEPEDSIFFVPQDSIIVCSYKQNSPYDRYCCYINQIQGRWDHETIV

SEQ ID NO: 91478 - protein, 148 aa, Homo sapiens
  Payload ID: 18307
  Gene Name: transmembrane protein 216
  Uniprot ID: Q9P0N5
  ENSP ID: ENSP00000334844
MLPRGLKMAPRGKRLSSTPLEILFFLNGWYNATYFLLELFIFLYKGVLLPYPTANLVLDVVMLLLYLGIEVIRLFFGTKGNLCQRKMPLSISVALTFPSAMMASYYLLLQTYVLRLEAIMNGILLFFCGSELLLEVLTLAAFSSMDRI

SEQ ID NO: 91479 - protein, 84 aa, Homo sapiens
  Payload ID: 18307
  Gene Name: transmembrane protein 216
  ENSP ID: ENSP00000381950
MLLLYLGIEVIRLFFGTKGNLCQRKMPLSISVALTFPSAMMASYYLLLQTYVLRLEAIMNGILLFFCGSELLLEVLTLAAFSRI

SEQ ID NO: 91480 - protein, 145 aa, Homo sapiens
  Payload ID: 18307
  Gene Name: transmembrane protein 216
  Uniprot ID: Q9P0N5
  ENSP ID: ENSP00000440638
MLPRGLKMAPRGKRLSSTPLEILFFLNGWYNATYFLLELFIFLYKGVLLPYPTANLVLDVVMLLLYLGIEVIRLFFGTKGNLCQRKMPLSISVALTFPSAMMASYYLLLQTYVLRLEAIMNGILLFFCGSELLLEVLTLAAFSRI

SEQ ID NO: 91481 - protein, 229 aa, Homo sapiens
  Payload ID: 18308
  Gene Name: transmembrane protein 217
  Uniprot ID: Q8N7C4
  ENSP ID: ENSP00000338164
MKQQQWCGMTAKMGTVLSGVFTIMAVDMYLIFEQKHLGNGSCTEITPKYRGASNIINNFIICWSFKIVLFLSFITILISCFLLYSVYAQIFRGLVIYIVWIFFYETANVVIQILTNNDFDIKEVRIMRWFGLVSRTVMHCFWMFFVINYAHITYKNRSQGNIISYKRRISTAEILHSRNKRLSISSGFSGSHLESQYFERQSFHTSIFTCLSPVPSSAPSTCRYTIDVC

SEQ ID NO: 91482 - protein, 211 aa, Homo sapiens
  Payload ID: 18308
  Gene Name: transmembrane protein 217
  Uniprot ID: Q8N7C4
  ENSP ID: ENSP00000349198
MKQQQWCGMTAKMGTVLSGVFTIMAVDMYLIFEQKHLGNGSCTEITPKYRGASNIINNFIICWSFKIVLFLSFITILISCFLLYSVYAQIFRGLVIYIVWIFFYETANVVIQILTNNDFDIKEVRIMRWFGLVSRTVMHCFWMFFVINYAHITYKNRSQGNIISYKRRISTAEILHSRNKRLSISSGFSGSHLESQYFERQRRCSGKTSIK

SEQ ID NO: 91483 - protein, 115 aa, Homo sapiens
  Payload ID: 18309
  Gene Name: transmembrane protein 218
  Uniprot ID: A2RU14
  ENSP ID: ENSP00000279968
MAGTVLGVGAGVFILALLWVAVLLLCVLLSRASGAARFSVIFLFFGAVIITSVLLLFPRAGEFPAPEVEVKIVDDFFIGRYVLLAFLSAIFLGGLFLVLIHYVLEPIYAKPLHSY

SEQ ID NO: 91484 - protein, 70 aa, Homo sapiens
  Payload ID: 18309
  Gene Name: transmembrane protein 218
  ENSP ID: ENSP00000431411
MAGTVLGVGAGVFILALLWVAVLLLCVLLSRASGAARFSVIFLFFGAVIITSVLLLFPRAGEFPAPEVEV

SEQ ID NO: 91485 - protein, 45 aa, Homo sapiens
  Payload ID: 18309
  Gene Name: transmembrane protein 218
  ENSP ID: ENSP00000432624
MAGTVLGVGAGVFILALLWVAVLLLCVLLSRASGAASSVAFPASW

SEQ ID NO: 91486 - protein, 45 aa, Homo sapiens; identical to SEQ ID NO: 91485
  Payload ID: 18309
  Gene Name: transmembrane protein 218
  ENSP ID: ENSP00000433023

SEQ ID NO: 91487 - protein, 115 aa, Homo sapiens; identical to SEQ ID NO: 91483
  Payload ID: 18309
  Gene Name: transmembrane protein 218
  Uniprot ID: A2RU14
  ENSP ID: ENSP00000433374

SEQ ID NO: 91488 - protein, 70 aa, Homo sapiens; identical to SEQ ID NO: 91484
  Payload ID: 18309
  Gene Name: transmembrane protein 218
  ENSP ID: ENSP00000433996

SEQ ID NO: 91489 - protein, 115 aa, Homo sapiens; identical to SEQ ID NO: 91483
  Payload ID: 18309
  Gene Name: transmembrane protein 218
  Uniprot ID: A2RU14
  ENSP ID: ENSP00000434597

SEQ ID NO: 91490 - protein, 115 aa, Homo sapiens; identical to SEQ ID NO: 91483
  Payload ID: 18309
  Gene Name: transmembrane protein 218
  Uniprot ID: A2RU14
  ENSP ID: ENSP00000435526

SEQ ID NO: 91491 - protein, 52 aa, Homo sapiens
  Payload ID: 18309
  Gene Name: transmembrane protein 218
  ENSP ID: ENSP00000436151
MAGTVLGVGAGVFILALLWVAVLLLCVLLSRASGAARFSVIFLFFGAVIITS

SEQ ID NO: 91492 - protein, 115 aa, Homo sapiens; identical to SEQ ID NO: 91483
  Payload ID: 18309
  Gene Name: transmembrane protein 218
  Uniprot ID: A2RU14
  ENSP ID: ENSP00000436162

SEQ ID NO: 91493 - protein, 115 aa, Homo sapiens; identical to SEQ ID NO: 91483
  Payload ID: 18309
  Gene Name: transmembrane protein 218
  Uniprot ID: A2RU14
  ENSP ID: ENSP00000436177

SEQ ID NO: 91494 - protein, 141 aa, Homo sapiens
  Payload ID: 18309
  Gene Name: transmembrane protein 218
  ENSP ID: ENSP00000436578
MAGTVLGVGAGVFILALLWVAVLLLCVLLSRASGAARNWELPRINGNAPSWYLSRKKDFGMKRFSVIFLFFGAVIITSVLLLFPRAGEFPAPEVEVKIVDDFFIGRYVLLAFLSAIFLGGLFLVLIHYVLEPIYAKPLHSY

SEQ ID NO: 91495 - protein, 115 aa, Homo sapiens; identical to SEQ ID NO: 91483
  Payload ID: 18309
  Gene Name: transmembrane protein 218
  Uniprot ID: A2RU14
  ENSP ID: ENSP00000436596

SEQ ID NO: 91496 - protein, 240 aa, Homo sapiens
  Payload ID: 18310
  Gene Name: transmembrane protein 219
  Uniprot ID: Q86XT9
  ENSP ID: ENSP00000279396
MGNCQAGHNLHLCLAHHPPLVCATLILLLLGLSGLGLGSFLLTHRTGLRSPDIPQDWVSFLRSFGQLTLCPRNGTVTGKWRGSHVVGLLTTLNFGDGPDRNKTRTFQATVLGSQMGLKGSSAGQLVLITARVTTERTAGTCLYFSAVPGILPSSQPPISCSEEGAGNATLSPRMGEECVSVWSHEGLVLTKLLTSEELALCGSRLLVLGSFLLLFCGLLCCVTAMCFHPRRESHWSRTRL

SEQ ID NO: 91497 - protein, 240 aa, Homo sapiens; identical to SEQ ID NO: 91496
  Payload ID: 18310
  Gene Name: transmembrane protein 219
  Uniprot ID: Q86XT9
  ENSP ID: ENSP00000388485

SEQ ID NO: 91498 - protein, 99 aa, Homo sapiens
  Payload ID: 18310
  Gene Name: transmembrane protein 219
  ENSP ID: ENSP00000454443
  MOD_RES (1)..(1): Any amino acid
XRSFGQLTLCPRNGTVTGKWRGSHVVGLLTTLNFGDGPDRNKTRTFQATVLGSQMGLKGGAGSVWLQAAGLGLLPASLLWPSLLCHCYVLPPAPGVPLV

SEQ ID NO: 91499 - protein, 240 aa, Homo sapiens; identical to SEQ ID NO: 91496
  Payload ID: 18310
  Gene Name: transmembrane protein 219
  Uniprot ID: Q86XT9
  ENSP ID: ENSP00000456960

SEQ ID NO: 91500 - protein, 240 aa, Homo sapiens; identical to SEQ ID NO: 91496
  Payload ID: 18310
  Gene Name: transmembrane protein 219
  Uniprot ID: Q86XT9
  ENSP ID: ENSP00000457492

SEQ ID NO: 91501 - protein, 213 aa, Homo sapiens
  Payload ID: 18310
  Gene Name: transmembrane protein 219
  ENSP ID: ENSP00000459732
MGNCQAGHNLHLCLAHHPPLVCATLILLLLGLSGLGLGSFLLTHRTGLRSPDIPQDWVSFLRSFGQLTLCPRNGTVTGKWRGSHVVGLLTTLNFGDGPDRNKTRTFQATVLGSQMGLKGSSAGQLVLITARVTTERTAGTCLYFSAVPGILPSSQPPISCSEEGAGNATLSPRMGEECVSVWSHEGLVLTKLLTSELALCGSRLLVLGSFLLL

SEQ ID NO: 91502 - protein, 231 aa, Homo sapiens
  Payload ID: 18310
  Gene Name: transmembrane protein 219
  ENSP ID: ENSP00000459813
  MOD_RES (1)..(1): Any amino acid
XHLCLAHHPPLVCATLILLLLGLSGLGLGSFLLTHRTGLRSPDIPQDWVSFLRSFGQLTLCPRNGTVTGKWRGSHVVGLLTTLNFGDGPDRNKTRTFQATVLGSQMGLKGSSAGQLVLITARVTTERTAGTCLYFSAVPGILPSSQPPISCSEEGAGNATLSPRMGEECVSVWSHEGLVLTKLLTSEELALCGSRLLVLGSFLLLFCGLLCCVTAMCFHPRRESHWSRTRL

SEQ ID NO: 91503 - protein, 169 aa, Homo sapiens
  Payload ID: 18310
  Gene Name: transmembrane protein 219
  ENSP ID: ENSP00000461124
DWVSFLRSFGQLTLCPRNGTVTGKWRGSHVVGLLTTLNFGDGPDRNKTRTFQATVLGSQMGLKGSSAGQLVLITARVTTERTAGTCLYFSAVPGILPSSQPPISCSEEGAGNATLSPRMGEECVSVWSHEGLVLTKLLTSVRASDGSPGFCRLPADYCILKVPGNNSTL

SEQ ID NO: 91504 - protein, 149 aa, Homo sapiens
  Payload ID: 18310
  Gene Name: transmembrane protein 219
  ENSP ID: ENSP00000473678
MGNCQAGHNLHLCLAHHPPLVCATLILLLLGLSGLGLGSFLLTHRTGLRSPDIPQDWVSFLRSFGQLTLCPRNGTVTGKWRGSHVVGLLTTLNFGDGPDRNKTRTFQATVLGSQMGLKGSSAGQLVLITARVTTERTAGTCLYFSAVPG

SEQ ID NO: 91505 - protein, 160 aa, Homo sapiens
  Payload ID: 18311
  Gene Name: transmembrane protein 220
  Uniprot ID: Q6QAJ8
  ENSP ID: ENSP00000339830
MAPALWRACNGLMAAFFALAALVQVNDPDAEVWVVVYTIPAVLTLLVGLNPEVTGNVIWKSISAIHILFCTVWAVGLASYLLHRTQQNILHEEEGRELSGLVIITAWIILCHSSSKNPVGGRIQLAIAIVITLFPFISWVYIYINKEMRSSWPTHCKTVI

SEQ ID NO: 91506 - protein, 150 aa, Homo sapiens
  Payload ID: 18311
  Gene Name: transmembrane protein 220
  Uniprot ID: Q6QAJ8
  ENSP ID: ENSP00000396973
MAPALWRACNGLMAAFFALAALVQVVYTIPAVLTLLVGLNPEVTGNVIWKSISAIHILFCTVWAVGLASYLLHRTQQNILHEEEGRELSGLVIITAWIILCHSSSKNPVGGRIQLAIAIVITLFPFISWVYIYINKEMRSSWPTHCKTVI

SEQ ID NO: 91507 - protein, 86 aa, Homo sapiens
  Payload ID: 18311
  Gene Name: transmembrane protein 220
  ENSP ID: ENSP00000462490
  MOD_RES (1)..(1): Any amino acid
XNVIWKSISAIHILFCTVWAVGLASYLLHRTQQNILHEEEGRELSGLVIITAWIILCHSSSKGRVLLCCPDWKAVARSQLTAASNS

SEQ ID NO: 91508 - protein, 130 aa, Homo sapiens
  Payload ID: 18311
  Gene Name: transmembrane protein 220
  ENSP ID: ENSP00000462723
MAPALWRACNGLMAAFFALAALVQVVYTIPAVLTLLVGLNPEVTGNVIWKSISAIHILFCTVWAVGLASYLLHRTQQNILHEEEGRNPVGGRIQLAIAIVITLFPFISWVYIYINKEMRSSWPTHCKTVI

SEQ ID NO: 91509 - protein, 117 aa, Homo sapiens
  Payload ID: 18311
  Gene Name: transmembrane protein 220
  ENSP ID: ENSP00000464189
  MOD_RES (1)..(1): Any amino acid
XSISAIHILFCTVWAVGLASYLLHRTQQNILHEEEGRFKLFFCLSLLSSWDYRELSGLVIITAWIILCHSSSKNPVGGRIQLAIAIVITLFPFISWVYIYINKEMRSSWPTHCKTVI

SEQ ID NO: 91510 - protein, 291 aa, Homo sapiens
  Payload ID: 18312
  Gene Name: transmembrane protein 221
  Uniprot ID: A6NGB7
  ENSP ID: ENSP00000342162
MARSYGGRVLAAMTLLGIAAAVLAALGAQLLFQLQAGRAELRGLRAEGLGQELGAGPGLPEDAAGTLLPLAAALAALVLVLGFTCLLLAALCGHLGAELARGPGPRRSDWFLYDCRLLRHVALGLFCCGISVYLAALSIYALLLFEIETGAAAASILGSGTLVLVAVLTHTLLRAARAARRGLHELSPPSFEDDLARPAEVSKASPRAQPQQGIHRRTPYSTCPEPGDPFGSMATATAPAALEGGWESSLPASRMHRTLSAGLGHWDGVTHEMRRMLGHRPGSMGKDSTLV

SEQ ID NO: 91511 - protein, 208 aa, Homo sapiens
  Payload ID: 18313
  Gene Name: transmembrane protein 222
  Uniprot ID: Q9H0R3
  ENSP ID: ENSP00000363189
MAEAEGSSLLLLPPPPPPPRMAEVEAPTAAETDMKQYQGSGGVAMDVERSRFPYCVVWTPIPVLTWFFPIIGHMGICTSTGVIRDFAGPYFVSEDNMAFGKPAKYWKLDPAQVYASGPNAWDTAVHDASEEYKHRMHNLCCDNCHSHVALALNLMRYNNSTNWNMVTLCFFCLLYGKYVSVGAFVKTWLPFILLLGIILTVSLVFNLR

SEQ ID NO: 91512 - protein, 154 aa, Homo sapiens
  Payload ID: 18313
  Gene Name: transmembrane protein 222
  ENSP ID: ENSP00000417603
MKQYQGSGGVAMDVERSRFPYCVVWTPIPVLTWFFPIIGHMGICTSTGVIRDFAGPYFVSEDNMAFGKPAKYWKLDPAQVYASGPNAWDTAVHDASEEYKHRMHNLCCDNCHSHVALALNLMRYNNSTNWNMVTLCFFCLLYGKYVRSLPRQRD

SEQ ID NO: 91513 - protein, 72 aa, Homo sapiens
  Payload ID: 18313
  Gene Name: transmembrane protein 222
  ENSP ID: ENSP00000417720
MKQYQGSGGVAMDVERSRFPYCVVWTPIPVLTWFFPIIGHMGICTSTGVIRDFAGPYFVSDRPGGQCGQKDS

SEQ ID NO: 91514 - protein, 147 aa, Homo sapiens
  Payload ID: 18313
  Gene Name: transmembrane protein 222
  ENSP ID: ENSP00000417853
MKQYQGSGGVAMDVERSRFPYCVVWTPIPVLTWFFPIIGHMGICTSTGVIRDFAGPYFVSEDNMAFGKPAKYWKLDPAQVYASGPNAWDTAVHDASEEYKHRMHNLCCDNCHSHVALALNLMRYNNSTNWNMVTLCFFCLLYGKYVR

SEQ ID NO: 91515 - protein, 199 aa, Homo sapiens
  Payload ID: 18313
  Gene Name: transmembrane protein 222
  ENSP ID: ENSP00000419292
KQYQGSGGVAMDVERSRFPYCVVWTPIPVLTWFFPIIGHMGICTSTGVIRDFAGPYFVSEDNMAFGKPAKCHLQEAFSHPILVRSGCHNKISSIGYWKLDPAQVYASGPNAWDTAVHDASEEYKHRMHNLCCDNCHSHVALALNLMRYNNSTNWNMVTLCFFCLLYGKYVSVGAFVKTWLPFILLLGIILTVSLVFNLR

SEQ ID NO: 91516 - protein, 72 aa, Homo sapiens; identical to SEQ ID NO: 91513
  Payload ID: 18313
  Gene Name: transmembrane protein 222
  ENSP ID: ENSP00000419528

SEQ ID NO: 91517 - protein, 80 aa, Homo sapiens
  Payload ID: 18313
  Gene Name: transmembrane protein 222
  ENSP ID: ENSP00000419878
MKQYQGSGGVAMDVERSRFPYCVVWTPIPVLTWFFPIIGHMGICTSTGVIRDFAGPYFVSEDNMAFGKPAKLTLLPFGNK

SEQ ID NO: 91518 - protein, 175 aa, Homo sapiens
  Payload ID: 18313
  Gene Name: transmembrane protein 222
  ENSP ID: ENSP00000476439
MKQYQGSGGVAMDVERSRFPYCVVWTPIPVLTWFFPIIGHMGICTSTGVIRDFAGPYFVSEDNMAFGKPAKYWKLDPAQVYASGPNAWDTAVHDASEEYKHRMHNLCCDNCHSHVALALNLMRYNNSTNWNMVTLCFFCLLYGKYVSVGAFVKTWLPFILLLGIILTVSLVFNLR

SEQ ID NO: 91519 - protein, 208 aa, Homo sapiens; identical to SEQ ID NO: 91511
  Payload ID: 18313
  Gene Name: transmembrane protein 222
  Uniprot ID: Q9H0R3
  ENSP ID: ENSP00000483276

SEQ ID NO: 91520 - protein, 202 aa, Homo sapiens
  Payload ID: 18314
  Gene Name: transmembrane protein 223
  Uniprot ID: A0PJW6
  ENSP ID: ENSP00000303987
MAAPWRRWPTGLLAVLRPLLTCRPLQGTTLQRDVLLFEHDRGRFFTILGLFCAGQGVFWASMAVAAVSRPPVPVQPLDAEVPNRGPFDLRSALWRYGLAVGCGAIGALVLGAGLLFSLRSVRSVVLRAGGQQVTLTTHAPFGLGAHFTVPLKQVSCMAHRGEVPAMLPLKVKGRRFYFLLDKTGHFPNTKLFDNTVGAYRSL

SEQ ID NO: 91521 - protein, 137 aa, Homo sapiens
  Payload ID: 18314
  Gene Name: transmembrane protein 223
  ENSP ID: ENSP00000431804
  MOD_RES (1)..(1): Any amino acid
XAAPWRRWPTGLLAVLRPLLTCRPLQGTTLQRDVLLFEHDRGRFFTILGLFCAGQGVFWASMAVAAVSRPPVPVQPLDAEVPNRGPFDLRSALWRYGLAVGCGAIGYSTIRNRQKQQLMTHSNNAQHQKARKSNLRG

SEQ ID NO: 91522 - protein, 106 aa, Homo sapiens
  Payload ID: 18314
  Gene Name: transmembrane protein 223
  ENSP ID: ENSP00000436670
MAAPWRRWPTGLLAVLRPLLTCRPLQGTTLQRDVLLFEHDRGRFFTILGLFCAGQGVFWASMAVAAVSRPPVPVQPLDAEVPNRGPFDLRSALWRYGLAVGCGAIA

SEQ ID NO: 91523 - protein, 225 aa, Homo sapiens
  Payload ID: 18315
  Gene Name: transmembrane protein 225
  Uniprot ID: Q6GV28
  ENSP ID: ENSP00000364166
MVHVSNRSIQGMNILFSSWAVVLMVMGITLDKWVELISEDERAKMNHSPWMMCCPALWPEDDLKVVRIMMTSSLGLSFLLNLILGMKFTYLIPQNKYIQLFTTILSFFSGISLLWALILYHNKLKQGQSMHFSSYRITWIMYTAYLNVFFLSVCGVLSLLECKLSTSSCTCLNIHKSDNECKESENSIEDISLPECTAMPRSIVRAHTVNSLNKKVQTRHVTWAL

SEQ ID NO: 91524 - protein, 150 aa, Homo sapiens
  Payload ID: 18315
  Gene Name: transmembrane protein 225
  ENSP ID: ENSP00000431282
MVHVSNRSIQDDLKVVRIMMTSSLGLSFLLNLILGMKFTYLIPQNKYIQLFTTILSFFSGISLLWALILYHNKLKQGQSMHFSSYRITWIMYTAYLNVFFLSVCGVLSLLECKLSTSSCTCLNIHKSDNECKESENSIEDISLPECTAMP

SEQ ID NO: 91525 - protein, 380 aa, Homo sapiens
  Payload ID: 18316
  Gene Name: transmembrane protein 229A
  Uniprot ID: B2RXF0
  ENSP ID: ENSP00000395244
MAGSDVDSEGPARRGGAARRPGAPGGPGSEAAAGCPEPLSTAEAPAESATLPAWMRLYFYGMHGITLDVLVSSARRFARSPDLRMLGFSSPYRCLLHSLTHFALEKVYLQQRRCPNAFVFNFLLYPSAHVGLQTLAGQALLLSLGGGAGVAVAPGALDLALQYVLALYHCQVFLKRFLRLRYGRQRRRQQQQQQQQQQQQRRGALPVPPGARVPTAAGARRRRPRGPRGAGGAPSQGLPDLPRFLFFGMHGFLDEIFFTFFFNVLGQGDGTTSGHTSLWSFFMYGSCSFVVEKLYFHLHYSRGWGTWKRVPIYVIFIYVWELSWGLGLRTCGACSWDYSHYPLNFMGLITLMYLPGWIFLSVYQDLISNVLWRVQYVPAN

SEQ ID NO: 91526 - protein, 167 aa, Homo sapiens
  Payload ID: 18317
  Gene Name: transmembrane protein 229B
  Uniprot ID: Q8NBD8
  ENSP ID: ENSP00000350050
MASAEPLTALSRWYLYAIHGYFCEVMFTAAWEFVVNLNWKFPGVTSVWALFIYGTSILIVERMYLRLRGRCPLLLRCLIYTLWTYLWEFTTGFILRQFNACPWDYSQFDFDFMGLITLEYAVPWFCGALIMEQFIIRNTLRLRFDKDAEPGEPSGALALANGHVKTD

SEQ ID NO: 91527 - protein, 79 aa, Homo sapiens
  Payload ID: 18317
  Gene Name: transmembrane protein 229B
  ENSP ID: ENSP00000450859
MASAEPLTALSRWYLYAIHGYFCEVMFTAAWEFVVNLNWKFPGVTSVWALFIYGTSILIVERMYLRLRGRCPLLLRCLI

SEQ ID NO: 91528 - protein, 167 aa, Homo sapiens; identical to SEQ ID NO: 91526
  Payload ID: 18317
  Gene Name: transmembrane protein 229B
  Uniprot ID: Q8NBD8
  ENSP ID: ENSP00000451774

SEQ ID NO: 91529 - protein, 55 aa, Homo sapiens
  Payload ID: 18317
  Gene Name: transmembrane protein 229B
  ENSP ID: ENSP00000452025
MASAEPLTALSRWYLYAIHGYFCEVMFTAAWEFVVNLNWKFPGVTSVWALFIYGT

SEQ ID NO: 91530 - protein, 56 aa, Homo sapiens
  Payload ID: 18317
  Gene Name: transmembrane protein 229B
  ENSP ID: ENSP00000452144
MASAEPLTALSRWYLYAIHGYFCEVMFTAAWEFVVNLNWKFPGVTSVWALFIYGTS

SEQ ID NO: 91531 - protein, 167 aa, Homo sapiens; identical to SEQ ID NO: 91526
  Payload ID: 18317
  Gene Name: transmembrane protein 229B
  Uniprot ID: Q8NBD8
  ENSP ID: ENSP00000452201

SEQ ID NO: 91532 - protein, 134 aa, Homo sapiens
  Payload ID: 18317
  Gene Name: transmembrane protein 229B
  ENSP ID: ENSP00000452402
MASAEPLTALSRWYLYAIHGYFCEVMFTAAWEFVVNLNWKFPGVTSVWALFIYGTSILIVERMYLRLRGRCPLLLRCLIYTLWTYLWEFTTGFILRQFNACPWDYSQFDFDFMGLITLEYAVPWFCGALIMEQF

SEQ ID NO: 91533 - protein, 120 aa, Homo sapiens
  Payload ID: 18318
  Gene Name: transmembrane protein 230
  Uniprot ID: Q96A57
  ENSP ID: ENSP00000202834
MMPSRTNLATGIPSSKVKYSRLSSTDDGYIDLQFKKTPPKIPYKAIALATVLFLIGAFLIIIGSLLLSGYISKGGADRAVPVLIIGILVFLPGFYHLRIAYYASKGYRGYSYDDIPDFDD

SEQ ID NO: 91534 - protein, 183 aa, Homo sapiens
  Payload ID: 18318
  Gene Name: transmembrane protein 230
  Uniprot ID: Q96A57
  ENSP ID: ENSP00000341364
MQPWALPTVGELWVCGRPGAALRWSLVLSPRLEPSGVISAHCNLHLLASSDSSASASRLCQRVMMPSRTNLATGIPSSKVKYSRLSSTDDGYIDLQFKKTPPKIPYKAIALATVLFLIGAFLIIIGSLLLSGYISKGGADRAVPVLIIGILVFLPGFYHLRIAYYASKGYRGYSYDDIPDFDD

SEQ ID NO: 91535 - protein, 74 aa, Homo sapiens
  Payload ID: 18318
  Gene Name: transmembrane protein 230
  ENSP ID: ENSP00000368578
MMPSRTNLATGIPSSKVKYSRLSSTDDGYIDLQFKKTPPKIPYKAIALATVLFLIGAFLIIIGSLLLSGYISKG

SEQ ID NO: 91536 - protein, 120 aa, Homo sapiens; identical to SEQ ID NO: 91533
  Payload ID: 18318
  Gene Name: transmembrane protein 230
  Uniprot ID: Q96A57
  ENSP ID: ENSP00000368579

SEQ ID NO: 91537 - protein, 120 aa, Homo sapiens; identical to SEQ ID NO: 91533
  Payload ID: 18318
  Gene Name: transmembrane protein 230
  Uniprot ID: Q96A57
  ENSP ID: ENSP00000368581

SEQ ID NO: 91538 - protein, 120 aa, Homo sapiens; identical to SEQ ID NO: 91533
  Payload ID: 18318
  Gene Name: transmembrane protein 230
  Uniprot ID: Q96A57
  ENSP ID: ENSP00000368585

SEQ ID NO: 91539 - protein, 120 aa, Homo sapiens; identical to SEQ ID NO: 91533
  Payload ID: 18318
  Gene Name: transmembrane protein 230
  Uniprot ID: Q96A57
  ENSP ID: ENSP00000368588

SEQ ID NO: 91540 - protein, 120 aa, Homo sapiens; identical to SEQ ID NO: 91533
  Payload ID: 18318
  Gene Name: transmembrane protein 230
  Uniprot ID: Q96A57
  ENSP ID: ENSP00000368601

SEQ ID NO: 91541 - protein, 127 aa, Homo sapiens
  Payload ID: 18318
  Gene Name: transmembrane protein 230
  ENSP ID: ENSP00000478112
MMPSRTNLATGIPSSKVKYSRLSSTDDGYIDLQFKKTPPKIPYKAIALATVLFLIGAFLIIIGSLLLSGYISKGSLESTSREQKKADHKHLPASRGYMMGGISGRSPEGGLSSRLPEGRGTQVSSPD

SEQ ID NO: 91542 - protein, 127 aa, Homo sapiens; identical to SEQ ID NO: 91541
  Payload ID: 18318
  Gene Name: transmembrane protein 230
  ENSP ID: ENSP00000478641

SEQ ID NO: 91543 - protein, 316 aa, Homo sapiens
  Payload ID: 18319
  Gene Name: transmembrane protein 231
  Uniprot ID: Q9H6L2
  ENSP ID: ENSP00000258173
MALYELFSHPVERSYRAGLCSKAALFLLLAAALTYIPPLLVAFRSHGFWLKRSSYEEQPTVRFQHQVLLVALLGPESDGFLAWSTFPAFNRLQGDRLRVPLVSTREEDRNQDGKTDMLHFKLELPLQSTEHVLGVQLILTFSYRLHRMATLVMQSMAFLQSSFPVPGSQLYVNGDLRLQQKQPLSCGGLDARYNISVINGTSPFAYDYDLTHIVAAYQERNVTTVLNDPNPIWLVGRAADAPFVINAIIRYPVEVISYQPGFWEMVKFAWVQYVSILLIFLWVFERIKIFVFQNQVVTTIPVTVTPRGDLCKEHLS

SEQ ID NO: 91544 - protein, 106 aa, Homo sapiens
  Payload ID: 18319
  Gene Name: transmembrane protein 231
  ENSP ID: ENSP00000454582
MALYELFSHPVERSYRAGLCSKAALFLLLAAALTYIPPLLVAFRSHGFWLKRSSYEEQPTVRFQHQVLLVALLGPESDGFLAWSTFPAFNRLQGDRLRVPLVSWRR

SEQ ID NO: 91545 - protein, 193 aa, Homo sapiens
  Payload ID: 18319
  Gene Name: transmembrane protein 231
  ENSP ID: ENSP00000455520
MALYELFSHPVERSYRAGLCSKAALFLLLAAALTYIPPLLVAFRSHGFWLKRSSYEEQPTVRFQHQVLLVALLGPESDGFLAWSTFPAFNRLQGDRLRVPLVSTREEDRNQDGKTDMLHFKLELPLQSTEHVLEDGDPRDAEHGVSPVLLSCPGIPVIRERRPEAAAEAAAELWWPRCPIQHIRDQRDQPLCL

SEQ ID NO: 91546 - protein, 268 aa, Homo sapiens
  Payload ID: 18319
  Gene Name: transmembrane protein 231
  ENSP ID: ENSP00000457254
MALYELFSHPVERSYRAGLCSKAALFLLLAAALTYIPPLLVAFRSHGFWLKRSSYEEQPTVRFQHQVLLVALLGPESDGFLAWSTFPAFNRLQGDRLRVPLVSTREEDRNQDGKTDMLHFKLELPLQSTEHVLGVQLILTFSYRLHISVINGTSPFAYDYDLTHIVAAYQERNVTTVLNDPNPIWLVGRAADAPFVINAIIRYPVEVISYQPGFWEMVKFAWVQYVSILLIFLWVFERIKIFVFQNQVVTTIPVTVTPRGDLCKEHLS

SEQ ID NO: 91547 - protein, 345 aa, Homo sapiens
  Payload ID: 18319
  Gene Name: transmembrane protein 231
  Uniprot ID: Q9H6L2
  ENSP ID: ENSP00000476267
MSSSLTRSSAVTARGSAPKPRCSCCWPLRSRTSRRCWWPSGATVSLPRPLCHEAPRARSARAGLPNRLPTALFNSGFWLKRSSYEEQPTVRFQHQVLLVALLGPESDGFLAWSTFPAFNRLQGDRLRVPLVSTREEDRNQDGKTDMLHFKLELPLQSTEHVLGVQLILTFSYRLHRMATLVMQSMAFLQSSFPVPGSQLYVNGDLRLQQKQPLSCGGLDARYNISVINGTSPFAYDYDLTHIVAAYQERNVTTVLNDPNPIWLVGRAADAPFVINAIIRYPVEVISYQPGFWEMVKFAWVQYVSILLIFLWVFERIKIFVFQNQVVTTIPVTVTPRGDLCKEHLS

SEQ ID NO: 91548 - protein, 54 aa, Homo sapiens
  Payload ID: 18319
  Gene Name: transmembrane protein 231
  ENSP ID: ENSP00000479977
  MOD_RES (1)..(1): Any amino acid
XQHQVLLVALLGPESDGFLAWSTFPAFNRLQGDRLRVPLVSVRGSRLGLGQSRG

SEQ ID NO: 91549 - protein, 657 aa, Homo sapiens
  Payload ID: 18320
  Gene Name: transmembrane protein 232
  Uniprot ID: C9JQI7
  ENSP ID: ENSP00000401477
MNMPVNKSPMINTCGGISSPYHEELWKLNFQHLSGERGHKSRPTFSITKEFILRFNQTQNSKEKEELLELARKIILRCKRKLGLKTLGSGRHVHLPAAWTEVIYLAQCKGEIQDESLNMLYASLDHASFDYDHLPALFFVAESVLYRLCCDASLKTYLYSVEIKLAKIGYLVFLRLFIFFLHGHLESFKQHLLRLQPYLYALSFSGASYHKYPNIFSNVQFILKASEIIGKRELRSESIFRPVEDKKRYENTDSDMGGYEINHLLWHCVAAWSCVQNNSPQLNNVLEHLVFHKTQLQKKCWLDSVLALLVLGEAAKLNMACLKALMDVVRDFVSSIMSVQNQEESCKVDDFSWAWNVVYIYTVILAEICLYAATSDLRKTALIGFCHCKSSQKNILYLDKSVPPELKETSILSLLEYFSSKMSENCDQVVWTGYYGLVYNLVKISWELQGDEEQDGLRNMIWQTLQKTKDYEEDVRIQNAINIAQAELNDPTDPFTRYSTNISSNVGEEVFSKYIGWRIANTLSKLFFPPIEAHFLPLKKPSIKKDQTKYPNKKLESVKKQVLHFTVREHPSVSEIPMFPYPDFFTKADKELAKIIDHHWQEELKIREKEDAICKAQELKDKKLAEKNHFQEVMKKREEKLHKQTKPYELPYRKEVI

SEQ ID NO: 91550 - protein, 164 aa, Homo sapiens
  Payload ID: 18320
  Gene Name: transmembrane protein 232
  ENSP ID: ENSP00000421614
MNMPVNKSPMINTCGGISSPYHEELWKLNFQHLSGERGHKSRPTFSITKEFILRFNQTQNSKEKEELLELARKIILRCKRKLGLKTLGSGRHVHLPAAWTEVIYLAQCKGEIQDESLNMLYASLDHASFDYDHLPALFFVAESVLYRLCCDASLKTYLYSVEIK

SEQ ID NO: 91551 - protein, 247 aa, Homo sapiens
  Payload ID: 18320
  Gene Name: transmembrane protein 232
  ENSP ID: ENSP00000423904
MNMPVNKSPMINTCGGISSPYHEELWKLNFQHLSGERGHKSRPTFSITKEFILRFNQTQNSKEKEELLELARKIILRCKRKLGLKTLGSGRHVHLPAAWTEVIYLAQCKGEIQDESLNMLYASLDHASFDYDHLPALFFVAESVLYRLCCDASLKTYLYSVEIKLAKIGYLVFLRLFIFFLHGHLESFKQHLLRLQPYLYALSFSGASYHKYPNIFSNVQFILKASEIIGKRELRSESIFRPVEDKK

SEQ ID NO: 91552 - protein, 119 aa, Homo sapiens
  Payload ID: 18320
  Gene Name: transmembrane protein 232
  ENSP ID: ENSP00000424807
MNMPVNKSPMINTCGGISSPYHEELWKLNFQHLSGERGHKSRPTFSITKEFILRFNQTQNSKEKEELLELARKIILRCKRKLGLKTLGSGRHVHLPAAWTEVIYLAQCKGEIQDGTYFK

SEQ ID NO: 91553 - protein, 59 aa, Homo sapiens
  Payload ID: 18320
  Gene Name: transmembrane protein 232
  ENSP ID: ENSP00000427785
MNMPVNKSPMINTCGGISSPYHEELWKLNFQHLSGERGHKSRLAIWSSYDFLYFSCMVI

SEQ ID NO: 91554 - protein, 109 aa, Homo sapiens
  Payload ID: 18321
  Gene Name: transmembrane protein 233
  Uniprot ID: B4DJY2
  ENSP ID: ENSP00000403130
MSQYAPSPDFKRALDSSPEANTEDDKTEEDVPMPKNYLWLTIVSCFCPAYPINIVALVFSIMSLNSYNDGDYEGARRLGRNAKWVAIASIIIGLLIIGISCAVHFTRNA

SEQ ID NO: 91555 - protein, 140 aa, Homo sapiens
  Payload ID: 18322
  Gene Name: transmembrane protein 234
  Uniprot ID: Q8WY98
  ENSP ID: ENSP00000309792
MAASLGQVLALVLVAALWGGTQPLLKRASAGLQRVHEPTWAQQLLQEMKTLFLNTEYLMPFLLNQCGSLLYYLTLASTDLTLAVPICNSLAIIFTLIVGKALGEDIGGKRAVAGMVLTVIGISLCITSSVSKTQGQQSTL

SEQ ID NO: 91556 - protein, 164 aa, Homo sapiens
  Payload ID: 18322
  Gene Name: transmembrane protein 234
  Uniprot ID: Q8WY98
  ENSP ID: ENSP00000344021
MAASLGQVLALVLVAALWGGTQPLLKRASAGLQRVHEPTWAQQLLQEMKTLFLNTEYLMPFLLNQCGSLLYYLTLASTDLTLAVPICNSLAIIFTLIVGKALGEDIGGKRAVAGMVLTVIGISLCITSSVPWTAELQLHGKGQLQTLSQKCKREASGTQSERFG

SEQ ID NO: 91557 - protein, 180 aa, Homo sapiens
  Payload ID: 18322
  Gene Name: transmembrane protein 234
  Uniprot ID: Q8WY98
  ENSP ID: ENSP00000362695
MAASLGQVLALVLVAALWGGTQPLLKRASAGLQRVHEPTWAQQLLQEMKTLFLNTEYLMPFLLNQCGSLLYYLTLASTDLTLAVPICNSLAIIFTLIVGKALGEDIGGKRKLDYCECGTQLCGSRHTCVSSFPEPISPEWVRTRPFPILPFPLQLFCFLVAIRVPFPWTVWRKTEAGVWD

SEQ ID NO: 91558 - protein, 67 aa, Homo sapiens
  Payload ID: 18322
  Gene Name: transmembrane protein 234
  ENSP ID: ENSP00000432747
MAASLDLTLAVPICNSLAIIFTLIVGKALGEDIGGKRAVAGMVLTVIGISLCITSSVSKTQGQQSTL

SEQ ID NO: 91559 - protein, 164 aa, Homo sapiens; identical to SEQ ID NO: 91556
  Payload ID: 18322
  Gene Name: transmembrane protein 234
  Uniprot ID: Q8WY98
  ENSP ID: ENSP00000433020

SEQ ID NO: 91560 - protein, 164 aa, Homo sapiens; identical to SEQ ID NO: 91556
  Payload ID: 18322
  Gene Name: transmembrane protein 234
  Uniprot ID: Q8WY98
  ENSP ID: ENSP00000434295

SEQ ID NO: 91561 - protein, 96 aa, Homo sapiens
  Payload ID: 18322
  Gene Name: transmembrane protein 234
  Uniprot ID: Q8WY98
  ENSP ID: ENSP00000435588
MAASLGQVLALVLVAALWGGTQPLLKRASAGLQRVHEPTWAQQLLQEMKTLFLNTEYLMPFLLNQCGSLLYYLTLASTGWSQTSEFRSSCWNPGKH

SEQ ID NO: 91562 - protein, 164 aa, Homo sapiens; identical to SEQ ID NO: 91556
  Payload ID: 18322
  Gene Name: transmembrane protein 234
  Uniprot ID: Q8WY98
  ENSP ID: ENSP00000436631

SEQ ID NO: 91563 - protein, 196 aa, Homo sapiens
  Payload ID: 18323
  Gene Name: transmembrane protein 235
  Uniprot ID: A6NFC5
  ENSP ID: ENSP00000364084
MARLGALLLAAALGALLSFALLAAAVASDYWYILEVADAGNGSAWPGRAELLSSHSGLWRICEVLHRAVIVVLPLSLVLLVCGWICGLLSSLAQSVSLLLFTGCYFLLGSVLTLAGVSIYISYSHLAFAETVQQYGPQHMQGVRVSFGWSMALAWGSCALEAFSGTLLLSAAWTLSLSPPICGHLSPQQVGGRGGD

SEQ ID NO: 91564 - protein, 223 aa, Homo sapiens
  Payload ID: 18323
  Gene Name: transmembrane protein 235
  Uniprot ID: A6NFC5
  ENSP ID: ENSP00000402790
MARLGALLLAAALGALLSFALLAAAVASDYWYILEVADAGNGSAWPGRAELLSSHSGLWRICEGQNGCIPLVDPFASESLDVSTSVQHLILLHRAVIVVLPLSLVLLVCGWICGLLSSLAQSVSLLLFTGCYFLLGSVLTLAGVSIYISYSHLAFAETVQQYGPQHMQGVRVSFGWSMALAWGSCALEAFSGTLLLSAAWTLSLSPPICGHLSPQQVGGRGGD

SEQ ID NO: 91565 - protein, 223 aa, Homo sapiens; identical to SEQ ID NO: 91564
  Payload ID: 18323
  Gene Name: transmembrane protein 235
  Uniprot ID: A6NFC5
  ENSP ID: ENSP00000446514

SEQ ID NO: 91566 - protein, 196 aa, Homo sapiens; identical to SEQ ID NO: 91563
  Payload ID: 18323
  Gene Name: transmembrane protein 235
  Uniprot ID: A6NFC5
  ENSP ID: ENSP00000447766

SEQ ID NO: 91567 - protein, 255 aa, Homo sapiens
  Payload ID: 18323
  Gene Name: transmembrane protein 235
  ENSP ID: ENSP00000466430
  MOD_RES (1)..(1): Any amino acid
XLLLAAALGALLSFALLAAAVASDYWYILEVADAGNGSAWPGRAELLSSHSGLWRICEGQNGCIPLVDPFASESLDVSTSVQHLICSSQLGWILRALQTPGSPFRTRFFQMACCLPGWHLPPVLHRAVIVVLPLSLVLLVCGWICGLLSSLAQSVSLLLFTGCYFLLGSVLTLAGVSIYISYSHLAFAETVQQYGPQHMQGVRVSFGWSMALAWGSCALEAFSGTLLLSAAWTLSLSPPICGHLSPQQVGGRGGD

SEQ ID NO: 91568 - protein, 150 aa, Homo sapiens
  Payload ID: 18323
  Gene Name: transmembrane protein 235
  Uniprot ID: A6NFC5
  ENSP ID: ENSP00000466793
MARLGALLLAAALGALLSFALLAAAVASDYWYILEVADAGNGSAWPGRAELLSSHSGLWRICEGVLTLAGVSIYISYSHLAFAETVQQYGPQHMQGVRVSFGWSMALAWGSCALEAFSGTLLLSAAWTLSLSPPICGHLSPQQVGGRGGD

SEQ ID NO: 91569 - protein, 351 aa, Homo sapiens
  Payload ID: 18324
  Gene Name: transmembrane protein 236
  Uniprot ID: Q5W0B7
  ENSP ID: ENSP00000366715
MASGRLIKFVVFELLEFAAFSIPTLVITEQFATAYQGTRARSDNTHYWLIISCSIAYVALVTLLIWVPVKVILHKKRYIYRKIKGWRPVLMMCVVLTTLPCLTFSIAVTEVQKSINGSADVLPDMLPDLPVSLVLLSLIMVDIIEKLRIYPLRGSQKSSENGHIHSTSLQHIKTVTEQVRQSPENAASPQATNSTQVSQPSGAMTRSQESVFMGPQEPSCDSGILRMMSRRDVRAELFLWSFLLWSDTIEMVRVAGHPNVYKSSWLYPVYIFSFISLLRITFTPQNPLLNSLSVLLQDLPFVFVRLGLIIALGTITPVLGLCKNILVTLSYIYFNYLTRIRIFSAFEMSPF

SEQ ID NO: 91570 - protein, 118 aa, Homo sapiens
  Payload ID: 18325
  Gene Name: transmembrane protein 237
  ENSP ID: ENSP00000286196
MIFHLVVLRKRSPEQKTHQQVLLWKALLRLLVEGPLRAMSHQLKNSKSTQRLLFKEDRKRQGYLLNWRLPPPKRSHLVHLYYEMKMVLMRSQLRRQLFKNLGGRQRKPSQQNYSMPMS

SEQ ID NO: 91571 - protein, 408 aa, Homo sapiens
  Payload ID: 18325
  Gene Name: transmembrane protein 237
  Uniprot ID: Q96Q45
  ENSP ID: ENSP00000386264
MRTDSGARLEEGHLRPPRALPPVPSQDDIPLSRPKKKKPRTKNTPASASLEGLAQTAGRRPSEGNEPSTKELKEHPEAPVQRRQKKTRLPLELETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 91572 - protein, 400 aa, Homo sapiens
  Payload ID: 18325
  Gene Name: transmembrane protein 237
  Uniprot ID: Q96Q45
  ENSP ID: ENSP00000387203
MGKNPVRPPRALPPVPSQDDIPLSRPKKKKPRTKNTPASASLEGLAQTAGRRPSEGNEPSTKELKEHPEAPVQRRQKKTRLPLELETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 91573 - protein, 96 aa, Homo sapiens
  Payload ID: 18325
  Gene Name: transmembrane protein 237
  ENSP ID: ENSP00000402681
MRTDSGARLEEGHLRPPRALPPVPSQDDIPLSRPKKKKPRTKNTPASASLEGLAQTAGRRPSEGNEPSTKELKEHPEAPVQRRQKKTRLPLENGVS

SEQ ID NO: 91574 - protein, 96 aa, Homo sapiens; identical to SEQ ID NO: 91573
  Payload ID: 18325
  Gene Name: transmembrane protein 237
  ENSP ID: ENSP00000413230

SEQ ID NO: 91575 - protein, 400 aa, Homo sapiens [sequence omitted]

SEQ ID NO: 91576 - protein, 176 aa, Homo sapiens
  Payload ID: 18326
  Gene Name: transmembrane protein 238
  Uniprot ID: C9JI98
  ENSP ID: ENSP00000416154
MAAAPAVCASQGSPPGAPSAPAAAPAPAAGLGRCRMALLLAVALDVAGMAALLTGVFAQLQVRGRDFGDLLIYSGALLVFLSLLGWILWYTGNIEISRQELERDYGLRPSALARLARKLSRRWSAPAAAGQRPAPGSRRARRAARAPPPPAAGSRRVRLQLATLEAGPGAAGAGSE

SEQ ID NO: 91577 - protein, 195 aa, Homo sapiens
  Payload ID: 18327
  Gene Name: transmembrane protein 239
  Uniprot ID: Q8WW34
  ENSP ID: ENSP00000354312
MRVGTWICLPGRPGRCRKQHDLGNCPEVPGIFKTLALSPGAPDMMQQPRVETDTIGAGEGPQQAVPWSAWVTRHGWVRWWVSHMPPSWIQWWSTSNWRQPLQRLLWGLEGILYLLLALMLCHALFTTGSHLLSSLWPVVAAVWRHLLPALLLLVLSALPALLFTASFLLLFSTLLSLVGLLTSMTHPGDTQDLDQ

SEQ ID NO: 91578 - protein, 152 aa, Homo sapiens
  Payload ID: 18327
  Gene Name: transmembrane protein 239
  Uniprot ID: Q8WW34
  ENSP ID: ENSP00000369959
MMQQPRVETDTIGAGEGPQQAVPWSAWVTRHGWVRWWVSHMPPSWIQWWSTSNWRQPLQRLLWGLEGILYLLLALMLCHALFTTGSHLLSSLWPVVAAVWRHLLPALLLLVLSALPALLFTASFLLLFSTLLSLVGLLTSMTHPGDTQDLDQ

SEQ ID NO: 91579 - protein, 173 aa, Homo sapiens
  Payload ID: 18328
  Gene Name: transmembrane protein 240
  Uniprot ID: Q5SV17
  ENSP ID: ENSP00000368007
MSMSANTMIFMILGASVVMAIACLMDMNALLDRFHNYILPHLRGEDRVCHCNCGRHHIHYVIPYDGDQSVVDASENYFVTDSVTKQEIDLMLGLLLGFCISWFLVWMDGVLHCAVRAWRAGRRYDGSWTWLPKLCSLRELGRRPHRPFEEAAGNMVHVKQKLYHNGHPSPRHL

SEQ ID NO: 91580 - protein, 173 aa, Homo sapiens; identical to SEQ ID NO: 91579
  Payload ID: 18328
  Gene Name: transmembrane protein 240
  Uniprot ID: Q5SV17
  ENSP ID: ENSP00000400311

SEQ ID NO: 91581 - protein, 55 aa, Homo sapiens
  Payload ID: 18328
  Gene Name: transmembrane protein 240
  ENSP ID: ENSP00000485135
MSMSANTMIFMILGASVVMAIACLMDMNALLDRFHNYILPHLRGEDRVCHCNCGR

SEQ ID NO: 91582 - protein, 296 aa, Homo sapiens
  Payload ID: 18329
  Gene Name: transmembrane protein 241
  Uniprot ID: Q24JQ0
  ENSP ID: ENSP00000372720
MCVRRSLVGLTFCTCYLASYLTNKYVLSVLKFTYPTLFQGWQTLIGGLLLHVSWKLGWVEINSSSRSHVLVWLPASVLFVGIIYAGSRALSRLAIPVFLTLHNVAEVIICGYQKCFQKEKTSPAKICSALLLLAAAGCLPFNDSQFNPDGYFWAIIHLLCVGAYKILQKSQKPSALSDIDQQYLNYIFSVVLLAFASHPTGDLFSVLDFPFLYFYRFHGSCCASGFLGFFLMFSTVKLKNLLAPGQCAAWIFFAKIITAGLSILLFDAILTSATTGCLLLGALGEALLVFSERKSS

SEQ ID NO: 91583 - protein, 159 aa, Homo sapiens
  Payload ID: 18329
  Gene Name: transmembrane protein 241
  Uniprot ID: Q24JQ0
  ENSP ID: ENSP00000431584
MCVRRSLVGLTFCTCYLASYLTNKYVLSVLKFTYPTLFQGWQTLIGGLLLHVSWKLGWVEINSSSRSHVLVWLPASVLFVGIIYAGSRALSRLAIPVFLTLHNVAEVIICGYQKCFQKEKTSPAKICSALLLLAAAGCLPFNDSQGLIKFYRSPRNPVH

SEQ ID NO: 91584 - protein, 76 aa, Homo sapiens
  Payload ID: 18329
  Gene Name: transmembrane protein 241
  ENSP ID: ENSP00000433605
MCVRRSLVGLTFCTCYLASYLTNKYVLSVLKFTYPTLFQGWQTLIGGLLLHVSWKLGWVEINSSSRPFLCFSLCIM

SEQ ID NO: 91585 - protein, 50 aa, Homo sapiens
  Payload ID: 18329
  Gene Name: transmembrane protein 241
  ENSP ID: ENSP00000433795
MCVRRSLVGLTFCTCYLASYLTNKYVLSVLKFTYPTLFQGPFLCFSLCIM

SEQ ID NO: 91586 - protein, 86 aa, Homo sapiens
  Payload ID: 18329
  Gene Name: transmembrane protein 241
  ENSP ID: ENSP00000435139
MCVRRSLVGLTFCTCYLASYLTNKVADAHWWTFASCVLETGLGRDQQQFKISCSCVASCFSAVCGYNLCWVQSIVQTGHSCVSHFA

SEQ ID NO: 91587 - protein, 123 aa, Homo sapiens
  Payload ID: 18329
  Gene Name: transmembrane protein 241
  Uniprot ID: Q24JQ0
  ENSP ID: ENSP00000437280
MCVRRSLVGLTFCTCYLASYLTNKYVLSVLKFTYPTLFQGSHVLVWLPASVLFVGIIYAGSRALSRLAIPVFLTLHNVAEVIICGYQKCFQKEKTSPAKICRLHLERTRQNQTSRLSSCLKGD

SEQ ID NO: 91588 - protein, 149 aa, Homo sapiens
  Payload ID: 18329
  Gene Name: transmembrane protein 241
  ENSP ID: ENSP00000440152
MCVRRSLVGLTFCTCYLASYLTNKYVLSVLKFTYPTLFQGWQTLIGGLLLHVSWKLGWVEINSSSRSHVLVWLPASVLFVGIIYAGSRALSRLAIPVFLTLHNVAEVIICGYQKCFQKEKTSPAKICRLHLERTRQNQTSRLSSCLKGD

SEQ ID NO: 91589 - protein, 76 aa, Homo sapiens; identical to SEQ ID NO: 91584
  Payload ID: 18329
  Gene Name: transmembrane protein 241
  ENSP ID: ENSP00000462199

SEQ ID NO: 91590 - protein, 76 aa, Homo sapiens; identical to SEQ ID NO: 91584
  Payload ID: 18329
  Gene Name: transmembrane protein 241
  ENSP ID: ENSP00000462979

SEQ ID NO: 91591 - protein, 188 aa, Homo sapiens
  Payload ID: 18329
  Gene Name: transmembrane protein 241
  ENSP ID: ENSP00000463348
MCVRRSLVGLTFCTCYLASYLTNKYVLSVLKFTYPTLFQGWQTLIGGLLLHVSWKLGWVEINSSSRSHVLVWLPASVLFVGIIYAGSRALSRLAIPVFLTLHNVAEVIICGYQKCFQKEKTSPAKICSALLLLAAAGCLPFNDSQFNPDGYFWAIIHLLCVGAYKILQKSQKPSALSVVLLAFASHPT

SEQ ID NO: 91592 - protein, 102 aa, Homo sapiens
  Payload ID: 18329
  Gene Name: transmembrane protein 241
  ENSP ID: ENSP00000464008
DVREEVSGRPHLLYLLPGFLPHEQVCAVCLEIYLPYIIPRVADAHWWTFASCVLETGLGRDQQQFKISCSCVASCFSAVCGYNLCWVQSIVQTGHSCVSHFA

SEQ ID NO: 91593 - protein, 196 aa, Homo sapiens
  Payload ID: 18329
  Gene Name: transmembrane protein 241
  ENSP ID: ENSP00000464174
MCVRRSLVGLTFCTCYLASYLTNKYVLSVLKFTYPTLFQGWQTLIGGLLLHVSWKLGWVEINSSSRSHVLVWLPASVLFVGIIYAGSRALSRLAIPVFLTLHNVAEVIICGYQKCFQKEKTSPAKICSALLLLAAAGCLPFNDSQFNPDGYFWAIIHLLCVGDLFSVLDFPFLYFYRFHGSCCASGFLGFFLMFST

SEQ ID NO: 91594 - protein, 128 aa, Homo sapiens
  Payload ID: 18330
  Gene Name: transmembrane protein 242
  ENSP ID: ENSP00000356112
METAGAATGQPASGLEAPGSTNDRLFLVKGGIFLGTVAAAGMLAGFITTLSLAKKKSPEWFNKGSMATAALPESGSSLALRALGWGSLYAWCGVGVISFAVWKALGVHSVSNYCLVPGIYMFILLTVF

SEQ ID NO: 91595 - protein, 141 aa, Homo sapiens
  Payload ID: 18330
  Gene Name: transmembrane protein 242
  Uniprot ID: Q9NWH2
  ENSP ID: ENSP00000383594
METAGAATGQPASGLEAPGSTNDRLFLVKGGIFLGTVAAAGMLAGFITTLSLAKKKSPEWFNKGSMATAALPESGSSLALRALGWGSLYAWCGVGVISFAVWKALGVHSMNDFRSKMQSIFPTIPKNSESAVEWEETLKSK

SEQ ID NO: 91596 - protein, 118 aa, Homo sapiens
  Payload ID: 18331
  Gene Name: transmembrane protein 243, mitochondrial
  Uniprot ID: Q9BU79
  ENSP ID: ENSP00000257637
MEDFATRTYGTSGLDNRPLFGETSAKDRIINLVVGSLTSLLILVTLISAFVFPQLPPKPLNIFFAVCISLSSITACILIYWYRQGDLEPKFRKLIYYIIFSIIMLCICANLYFHDVGR

SEQ ID NO: 91597 - protein, 118 aa, Homo sapiens; identical to SEQ ID NO: 91596
  Payload ID: 18331
  Gene Name: transmembrane protein 243, mitochondrial
  Uniprot ID: Q9BU79
  ENSP ID: ENSP00000398083

SEQ ID NO: 91598 - protein, 5 aa, Homo sapiens
  Payload ID: 18331
  Gene Name: transmembrane protein 243, mitochondrial
  ENSP ID: ENSP00000401897
MEDFA

SEQ ID NO: 91599 - protein, 119 aa, Homo sapiens
  Payload ID: 18331
  Gene Name: transmembrane protein 243, mitochondrial
  ENSP ID: ENSP00000407976
MEDFATRTYGTSGLDNRPLFGETSAKDRIINLVVGSLTSLLILVTLISAFVFPQLPPKPLNIFFAVCISLSSITACILVSTVENLNSVLEGLSCNAQDKNFQPWVYTKGYLLIISSSSP

SEQ ID NO: 91600 - protein, 128 aa, Homo sapiens
  Payload ID: 18332
  Gene Name: transmembrane protein 244
  Uniprot ID: Q5VVB8
  ENSP ID: ENSP00000357125
MALQVRVAPSKVVLQKFLLCVILFYTVYYVSLSMGCVMFEVHELNVLAPFDFKTNPSWLNINYKVLLVSTEVTYFVCGLFFVPVVEEWVWDYAISVTILHVAITSTVMLEFPLTSHWWAALGISKLLV

SEQ ID NO: 91601 - protein, 128 aa, Homo sapiens; identical to SEQ ID NO: 91600
  Payload ID: 18332
  Gene Name: transmembrane protein 244
  Uniprot ID: Q5VVB8
  ENSP ID: ENSP00000403755

SEQ ID NO: 91602 - protein, 879 aa, Homo sapiens [sequence omitted]

SEQ ID NO: 91603 - protein, 472 aa, Homo sapiens
  Payload ID: 18333
  Gene Name: transmembrane protein 245
  ENSP ID: ENSP00000394798
  MOD_RES (1)..(1): Any amino acid
XEKRYHVWWGIIESFLKERQGALAPWPIVGLGKFLLKVDSKMIIWLEKMLDKIISIFIIFLLVIGTLLLALLLTAKVHQESVHMIEVTSNLINETLANHPEWANWLPEAQVVQRALNSAANNVYQYGREWITHKLHKILGDKVNNTAVIEKQVLELWDRLYHSWFVKNVTHSGRHKGQKLHVSRQNSWLGDILDWQDIVSFVHENIETFLSILESLWIVMSRNVSLLFTTVTTLLTILFYSGTALLNFVLSLIIFLTTLFYLLSSSDEYYKPVKWVISLTPLSQPGPSSNIIGQSVEEAIRGVFDASLKMAGFYGLYTWLTHTMFGINIVFIPSALAAILGAVPFLGTYWAAVPAVLDLWLTQGLGCKAILLLIFHLLPTYFVDTAIYSDISGGGHPYLTGLAVAGGAYYLGLEGAIIGPILLCILVVASNIYSAMLVSPTNSVPTPNQTPWPAQPQRTFRDISEDLKSSVG

SEQ ID NO: 91604 - protein, 253 aa, Homo sapiens
  Payload ID: 18333
  Gene Name: transmembrane protein 245
  ENSP ID: ENSP00000417842
MSVGTLYEKQNGKESSGAELPGQVISMAASTLANLAISITGYESSSEDQPSTQPAEAVDRGESAPTLSTSPSPSSPSPTSPSPTLGRRRPEIGTFLRKKKTSDIYFVSLVWAIVVMQIWLNLWIVQLLPVPIAVWILKKLVIHFGVVDFLEKRYHVWWGIIESFLKERQGALAPWPIVGLGKFLLKVDSKMIIWLEKMLDKIISIFIIFLLVIGTLLLALLLTAKVHQESVHMIEVTSNLINETLANHPEWAK

SEQ ID NO: 91605 - protein, 403 aa, Homo sapiens
  Payload ID: 18334
  Gene Name: transmembrane protein 246
  Uniprot ID: Q9BRR3
  ENSP ID: ENSP00000363980
MSTSTSPAAMLLRRLRRLSWGSTAVQLFILTVVTFGLLAPLACHRLLHSYFYLRHWHLNQMSQEFLQQSLKEGEAALHYFEELPSANGSVPIVWQATPRPWLVITIITVDRQPGFHYVLQVVSQFHRLLQQCGPQCEGHQLFLCNVERSVSHFDAKLLSKYVPVANRYEGTEDDYGDDPSTNSFEKEKQDYVYCLESSLQTYNPDYVLMVEDDAVPEEQIFPVLEHLLRARFSEPHLRDALYLKLYHPERLQHYINPEPMRILEWVGVGMLLGPLLTWIYMRFASRPGFSWPVMLFFSLYSMGLVELVGRHYFLELRRLSPSLYSVVPASQCCTPAMLFPAPAARRTLTYLSQVYCHKGFGKDMALYSLLRAKGERAYVVEPNLVKHIGLFSSLRYNFHPSLL

SEQ ID NO: 91606 - protein, 403 aa, Homo sapiens; identical to SEQ ID NO: 91605
  Payload ID: 18334
  Gene Name: transmembrane protein 246
  Uniprot ID: Q9BRR3
  ENSP ID: ENSP00000363981

SEQ ID NO: 91607 - protein, 403 aa, Homo sapiens; identical to SEQ ID NO: 91605
  Payload ID: 18334
  Gene Name: transmembrane protein 246
  Uniprot ID: Q9BRR3
  ENSP ID: ENSP00000363984

SEQ ID NO: 91608 - protein, 219 aa, Homo sapiens
  Payload ID: 18335
  Gene Name: transmembrane protein 247
  Uniprot ID: A6NEH6
  ENSP ID: ENSP00000388684
MAAEDREMMEARGAGESCPTFPKMVPGDSKSEGKPRAYLEAESQKPDSSYDYLEEMEACEDGGCQGPLKSLSPKSCRATKGQAGDGPKPAELPPTPGTERNPEMELEKVRMEFELTRLKYLHEKNQRQRQHEVVMEQLQRERQHEVVMEQLQQEAAPRLFSGGLQNFLLPQNQFAMFLYCFIFIHIIYVTKEMVFFLFAKHYLFCIAAILLCLIKTFWS

SEQ ID NO: 91609 - protein, 314 aa, Homo sapiens
  Payload ID: 18336
  Gene Name: transmembrane protein 248
  Uniprot ID: Q9NWD8
  ENSP ID: ENSP00000340668
MFSINPLENLKVYISSRPPLVVFMISVSAMAIAFLTLGYFFKIKEIKSPEMAEDWNTFLLRFNDLDLCVSENETLKHLTNDTTTPESTMTSGQARASTQSPQALEDSGPVNISVSITLTLDPLKPFGGYSRNVTHLYSTILGHQIGLSGREAHEEINITFTLPTAWSSDDCALHGHCEQVVFTACMTLTASPGVFPVTVQPPHCVPDTYSNATLWYKIFTTARDANTKYAQDYNPFWCYKGAIGKVYHALNPKLTVIVPDDDRSLINLHLMHTSYFLFVMVITMFCYAVIKGRPSKLRQSNPEFCPEKVALAEA

SEQ ID NO: 91610 - protein, 139 aa, Homo sapiens
  Payload ID: 18336
  Gene Name: transmembrane protein 248
  ENSP ID: ENSP00000394507
MFSINPLENLKVYISSRPPLVVFMISVSAMAIAFLTLGYFFKIKEIKSPEMAEDWNTFLLRFNDLDLCVSENETLKHLTNDTTTPESTMTSGQARASTQSPQALEDSGPVNISVSITLTLDPLKPFGGYSRNVTHLYST

SEQ ID NO: 91611 - protein, 203 aa, Homo sapiens
  Payload ID: 18336
  Gene Name: transmembrane protein 248
  Uniprot ID: Q9NWD8
  ENSP ID: ENSP00000405558
MFSINPLENLKVYISSRPPLVVFMISVSAMAIAFLTLGYFFKIKEIKSPEMAEDWNTFLLRFNDLDLCVSENETLKHLTNDTTTPESTMTSGQARASTQSPQALEDSGPVNISVSITLTLDPLKPFGGYSRNVTHLYSTILGHQIGLSGREAHEEINITFTLPTAWSSDDCALHGHCEQVVFTACMTLTASPGVFPVTVMTVH

SEQ ID NO: 91612 - protein, 72 aa, Homo sapiens
  Payload ID: 18336
  Gene Name: transmembrane protein 248
  ENSP ID: ENSP00000410505
MFSINPLENLKVYISSRPPLVVFMISVSAMAIAFLTLGYFFKIKEIKSPEMAEDWNTFLLRFNDLDLCVSEN

SEQ ID NO: 91613 - protein, 94 aa, Homo sapiens
  Payload ID: 18336
  Gene Name: transmembrane protein 248
  ENSP ID: ENSP00000413824
MFSINPLENLKVYISSRPPLVVFMISVSAMAIAFLTLGYFFKIKEIKSPEMAEDWNTFLLRFNDLDLCVSENETLKHLTNDTTTPESTMTSGQA

SEQ ID NO: 91614 - protein, 114 aa, Homo sapiens
  Payload ID: 18336
  Gene Name: transmembrane protein 248
  ENSP ID: ENSP00000475466
MFSINPLENLKVYISSRPPLVVFMISVSAMAIAFLTLGYFFKIKEIKSPEMAEDWNTFLLRFNDLDLCVSENETLKHLTNDTTTPESTMTSGQARASTQSPQALEDSGPVNISV

SEQ ID NO: 91615 - protein, 235 aa, Homo sapiens
  Payload ID: 18337
  Gene Name: transmembrane protein 249
  Uniprot ID: Q2WGJ8
  ENSP ID: ENSP00000454468
MPKGRAGSLPTTSIGWRFQLWFLGLTCPERHLARRLKNNSFYPFVQQEPNVFVLEYYLDTLWKGMLLFIISVVLVSFSSLREVQKQETWVFLVYGVGVGLWLVISSLPRRRLVLNHTRGVYHFSIQGRTVCQGPLHLVYVRLALSSDAHGRCFFHLVLGGHRLEPLVLVQLSEHYEQMEYLGRYIARKLNINYFDYLATSYRHVVRHWPPPGAGTVMGKSPMGHKPSSSQSSLEV

SEQ ID NO: 91616 - protein, 215 aa, Homo sapiens
  Payload ID: 18337
  Gene Name: transmembrane protein 249
  ENSP ID: ENSP00000457580
MPKGRAGSLPTTSIGWRFQLWFLGLTCPERHLARRLKNNSFYPFVQQEPNGAEARDLGLPRVRRGRGPVARDLVAAAAPPGAEPHARRVPLLHPGPHRVPGPLASGLRAPGAQLRCPRKVLLPPGPRRPQVGAPGAGAAVGALRANGILGPLHRPETQHQLLRLPGHLLPARGSPLATPWRWHCDGQEPHGSQAQLLSVQPGGVTLRASPTSGLC

SEQ ID NO: 91617 - protein, 218 aa, Homo sapiens
  Payload ID: 18338
  Gene Name: transmembrane protein 25
  Uniprot ID: Q86YD3
  ENSP ID: ENSP00000278959
MALPPGPAALRHTLLLLPALLSSVKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 91618 - protein, 366 aa, Homo sapiens
  Payload ID: 18338
  Gene Name: transmembrane protein 25
  Uniprot ID: Q86YD3
  ENSP ID: ENSP00000315635
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 91619 - protein, 351 aa, Homo sapiens
  Payload ID: 18338
  Gene Name: transmembrane protein 25
  Uniprot ID: Q86YD3
  ENSP ID: ENSP00000346237
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGPSRHPSLISSDSNNLKLNNVRLPRENMSLPSNLQLNDLTPDSRAVKPADRQMAQNNSRPELLDPEPGGLLTSQGRRNQDKDA

SEQ ID NO: 91620 - protein, 322 aa, Homo sapiens
  Payload ID: 18338
  Gene Name: transmembrane protein 25
  Uniprot ID: Q86YD3
  ENSP ID: ENSP00000352924
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 91621 - protein, 322 aa, Homo sapiens; identical to SEQ ID NO: 91620
  Payload ID: 18338
  Gene Name: transmembrane protein 25
  Uniprot ID: Q86YD3
  ENSP ID: ENSP00000411882

SEQ ID NO: 91622 - protein, 306 aa, Homo sapiens
  Payload ID: 18338
  Gene Name: transmembrane protein 25
  Uniprot ID: Q86YD3
  ENSP ID: ENSP00000416071
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRVKPADRQMAQNNSRPELLDPEPGGLLTSQGRRNQDKDA

SEQ ID NO: 91623 - protein, 200 aa, Homo sapiens
  Payload ID: 18338
  Gene Name: transmembrane protein 25
  ENSP ID: ENSP00000431145
  MOD_RES (1)..(1): Any amino acid
XDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGPSRHPSLISSDSNNLKLNNVRLPRENMSLPSNLQLNDLTPDSRVKPADRQMAQNNSRPELLDPEPGGLLTSQGFIRLPVLGYIYRVSSVSSDEIWL

SEQ ID NO: 91624 - protein, 322 aa, Homo sapiens; identical to SEQ ID NO: 91620
  Payload ID: 18338
  Gene Name: transmembrane protein 25
  Uniprot ID: Q86YD3
  ENSP ID: ENSP00000431205

SEQ ID NO: 91625 - protein, 381 aa, Homo sapiens
  Payload ID: 18338
  Gene Name: transmembrane protein 25
  ENSP ID: ENSP00000431548
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGPSRHPSLISSDSNNLKLNNVRLPRENMSLPSNLQLNDLTPDSRVKPADRQMAQNNSRPELLDPEPGGLLTSQACLLHHGTPALTNPWLPHQQEGALPGGWSPQAHNSTVWKL

SEQ ID NO: 91626 - protein, 49 aa, Homo sapiens
  Payload ID: 18338
  Gene Name: transmembrane protein 25
  ENSP ID: ENSP00000431663
MALPPGPAALRHTLLLLPALLSSAQYQPCLSPSQRPPAVFQVGGSWSHK

SEQ ID NO: 91627 - protein, 167 aa, Homo sapiens
  Payload ID: 18338
  Gene Name: transmembrane protein 25
  ENSP ID: ENSP00000432040
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQWLLATRVEVPLLGIVVAAGLALGTLVGFSTLVACLVCRKE

SEQ ID NO: 91628 - protein, 37 aa, Homo sapiens
  Payload ID: 18338
  Gene Name: transmembrane protein 25
  ENSP ID: ENSP00000432062
MALPPGPAALRHTLLLLPALLSSGPQKWPISQRLCHP

SEQ ID NO: 91629 - protein, 194 aa, Homo sapiens
  Payload ID: 18338
  Gene Name: transmembrane protein 25
  ENSP ID: ENSP00000433059
  MOD_RES (1)..(1): Any amino acid
XLLRRRSGREPVKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRAVKPADRQMAQNNSRPELLDPEPGGLLTSQGFIRLPVLGYIY

SEQ ID NO: 91630 - protein, 168 aa, Homo sapiens
  Payload ID: 18338
  Gene Name: transmembrane protein 25
  ENSP ID: ENSP00000433906
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQCPSRHPSLISSDSNNLKLNNVRLPRENMSLPSNLQLNDLTP

SEQ ID NO: 91631 - protein, 170 aa, Homo sapiens
  Payload ID: 18338
  Gene Name: transmembrane protein 25
  ENSP ID: ENSP00000433938
MALPPGPAALRHTLLLLPALLSSGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSL

SEQ ID NO: 91632 - protein, 40 aa, Homo sapiens
  Payload ID: 18338
  Gene Name: transmembrane protein 25
  ENSP ID: ENSP00000435446
MALPPGPAALRHTLLLLPALLSSGGPGTPRLAWYLDGQLQ

SEQ ID NO: 91633 - protein, 138 aa, Homo sapiens
  Payload ID: 18338
  Gene Name: transmembrane protein 25
  ENSP ID: ENSP00000436746
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAK

SEQ ID NO: 91634 - protein, 131 aa, Homo sapiens
  Payload ID: 18339
  Gene Name: transmembrane protein 251
  Uniprot ID: Q8N6I4
  ENSP ID: ENSP00000283534
MMNFRQRMGWIGVGLYLLASAAAFYYVFEISETYNRLALEHIQQHPEEPLEGTTWTHSLKAQLLSLPFWVWTVIFLVPYLQMFLFLYSCTRADPKTVGYCIIPICLAVICNRHQAFVKASNQISRLQLIDT

SEQ ID NO: 91635 - protein, 169 aa, Homo sapiens
  Payload ID: 18339
  Gene Name: transmembrane protein 251
  Uniprot ID: Q8N6I4
  ENSP ID: ENSP00000388431
MLAFSEMPKPPDYSELSDSLTLAVGTGRFSGPLHRAWRMMNFRQRMGWIGVGLYLLASAAAFYYVFEISETYNRLALEHIQQHPEEPLEGTTWTHSLKAQLLSLPFWVWTVIFLVPYLQMFLFLYSCTRADPKTVGYCIIPICLAVICNRHQAFVKASNQISRLQLIDT

SEQ ID NO: 91636 - protein, 169 aa, Homo sapiens; identical to SEQ ID NO: 91635
  Payload ID: 18339
  Gene Name: transmembrane protein 251
  Uniprot ID: Q8N6I4
  ENSP ID: ENSP00000478917

SEQ ID NO: 91637 - protein, 131 aa, Homo sapiens; identical to SEQ ID NO: 91634
  Payload ID: 18339
  Gene Name: transmembrane protein 251
  Uniprot ID: Q8N6I4
  ENSP ID: ENSP00000486678

SEQ ID NO: 91638 - protein, 170 aa, Homo sapiens
  Payload ID: 18340
  Gene Name: transmembrane protein 252
  Uniprot ID: Q8N6L7
  ENSP ID: ENSP00000366528
MQNRTGLILCALALLMGFLMVCLGAFFISWGSIFDCQGSLIAAYLLLPLGFVILLSGIFWSNYRQVTESKGVLRHMLRQHLAHGALPVATVDRPDFYPPAYEESLEVEKQSCPAEREASGIPPPLYTETGLEFQDGNDSHPEAPPSYRESIAGLVVTAISEDAQRRGQEC

SEQ ID NO: 91639 - protein, 217 aa, Homo sapiens
  Payload ID: 18341
  Gene Name: transmembrane protein 253
  Uniprot ID: P0C7T8
  ENSP ID: ENSP00000451229
MEDRAGEQEQERHSLRLEKLQHWARHRQSGHLLVLAVSQLWLAVVVVPLAVSVACLNSDCHMATALPLGPGASGLLTGTVTLELRRAPRLWKVRAMMIFNTFNLILGFIVVVVEVMKTALGPAPTASSQHAGLLVLELSAEAFTLGGVLVSVHALFLLSQRKPGCCRSQSLHYQELQEGFSELEEVPGLENGPTVASTGANERVGQREQTRAALLPP

SEQ ID NO: 91640 - protein, 127 aa, Homo sapiens
  Payload ID: 18341
  Gene Name: transmembrane protein 253
  ENSP ID: ENSP00000453121
MEDRAGEQEQERHSLRLEKLQHWARHRQSGHLLVLAGLLTGTVTLELRRAPRLWKVRAMMIFNTFNLILGFIVVVVEVMKTALGPAPTASSQHAGLLVLELSAEAFTLGGVLVSVHALFLLSQRKPG

SEQ ID NO: 91641 - protein, 217 aa, Homo sapiens; identical to SEQ ID NO: 91639
  Payload ID: 18341
  Gene Name: transmembrane protein 253
  Uniprot ID: P0C7T8
  ENSP ID: ENSP00000453962

SEQ ID NO: 91642 - protein, 144 aa, Homo sapiens
  Payload ID: 18342
  Gene Name: transmembrane protein 254
  ENSP ID: ENSP00000361347
  MOD_RES (1)..(1): Any amino acid
XTAGELPANSVSGFFKRMVKSEASNAATAYFRPARPLPSLVTVLGLGYFAWVVFWPQSIPYQNLGPLGPFTQYLVDHHHTLLCNGYWLAWLIHVGESLYAIVLCKHKGITSGRAQLLWFLQTFFFGIASLTILIAYKRKRQKQT

SEQ ID NO: 91643 - protein, 103 aa, Homo sapiens
  Payload ID: 18342
  Gene Name: transmembrane protein 254
  Uniprot ID: Q8TBM7
  ENSP ID: ENSP00000361348
MATAAGATYFQRGSLFWFTVITLSFGYYTWVVFWPQSIPYQNLGPLGPFTQYLVDHHHTLLCNGYWLAWLIHVGESLYAIVLCKQNELRIRIKMRKLILRDSE

SEQ ID NO: 91644 - protein, 84 aa, Homo sapiens
  Payload ID: 18342
  Gene Name: transmembrane protein 254
  Uniprot ID: Q8TBM7
  ENSP ID: ENSP00000361349
MATAAGATYFQRGSLFWFTVITLSFGYYTWVVFWPQSIPYQNLGPLGPFTQYLVDHHHTLLCNGYWLAWLIHVGESLYAIVLCK

SEQ ID NO: 91645 - protein, 103 aa, Homo sapiens; identical to SEQ ID NO: 91643
  Payload ID: 18342
  Gene Name: transmembrane protein 254
  Uniprot ID: Q8TBM7
  ENSP ID: ENSP00000361351

SEQ ID NO: 91646 - protein, 123 aa, Homo sapiens
  Payload ID: 18342
  Gene Name: transmembrane protein 254
  Uniprot ID: Q8TBM7
  ENSP ID: ENSP00000361355
MATAAGATYFQRGSLFWFTVITLSFGYYTWVVFWPQSIPYQNLGPLGPFTQYLVDHHHTLLCNGYWLAWLIHVGESLYAIVLCKHKGITSGRAQLLWFLQTFFFGIASLTILIAYKRKRQKQT

SEQ ID NO: 91647 - protein, 101 aa, Homo sapiens
  Payload ID: 18342
  Gene Name: transmembrane protein 254
  ENSP ID: ENSP00000393450
  MOD_RES (1)..(1): Any amino acid
XEFLRSVWVVFWPQSIPYQNLGPLGPFTQYLVDHHHTLLCNGYWLAWLIHVGESLYAIVLCKHKGITSGRAQLLWFLQTFFFGIASLTILIAYKRKRQKQT

SEQ ID NO: 91648 - protein, 101 aa, Homo sapiens
  Payload ID: 18342
  Gene Name: transmembrane protein 254
  ENSP ID: ENSP00000482766
MATAAGATYFQRGSLFWFTVITLSFGYYTPQQRSETLSKKKERKKIEAKNGDPNDCSEFLRGLSSGLRVSLIRTLGPWAPSLSTWWTTITPSCAMGIGLPG

SEQ ID NO: 91649 - protein, 349 aa, Homo sapiens
  Payload ID: 18343
  Gene Name: transmembrane protein 255A
  Uniprot ID: Q5JRV8
  ENSP ID: ENSP00000310110
MHQSLTQQRSSDMSLPDSMGAFNRRKRNSIYVTVTLLIVSVLILTVGLAATTRTQNVTVGGYYPGVILGFGSFLGIIGSNLIENKRQMLVASIVFISFGVIAAFCCAIVDGVFAARHIDLKPLYANRCHYVPKTSQKEAEEVISSSTKNSPSTRVMRNLTQAAREVNCPHLSREFCTPRIRGNTCFCCDLYNCGNRVEITGGYYEYIDVSSCQDIIHLYHLLWSATILNIVGLFLGIITAAVLGGFKDMNPTLPALNCSVENTHPTVSYYAHPQVASYNTYYHSPPHLPPYSAYDFQHSGVFPSSPPSGLSDEPQSASPSPSYMWSSSAPPRYSPPYYPPFEKPPPYSP

SEQ ID NO: 91650 - protein, 185 aa, Homo sapiens
  Payload ID: 18343
  Gene Name: transmembrane protein 255A
  Uniprot ID: Q5JRV8
  ENSP ID: ENSP00000360403
MVNCPHLSREFCTPRIRGNTCFCCDLYNCGNRVEITGGYYEYIDVSSCQDIIHLYHLLWSATILNIVGLFLGIITAAVLGGFKDMNPTLPALNCSVENTHPTVSYYAHPQVASYNTYYHSPPHLPPYSAYDFQHSGVFPSSPPSGLSDEPQSASPSPSYMWSSSAPPRYSPPYYPPFEKPPPYSP

SEQ ID NO: 91651 - protein, 325 aa, Homo sapiens
  Payload ID: 18343
  Gene Name: transmembrane protein 255A
  Uniprot ID: Q5JRV8
  ENSP ID: ENSP00000360420
MHQSLTQQRSSDMSLPDSMGAFNRRKRNSIYVTVTLLIVSVLILTVGLAATTRTQNVTVGGYYPGVILGFGSFLGIIGSNLIENKRQMLVASIVFISFGVIAAFCCAIVDGVFAARHIDLKPLYANRCHYVPKTSQKEAEEVNCPHLSREFCTPRIRGNTCFCCDLYNCGNRVEITGGYYEYIDVSSCQDIIHLYHLLWSATILNIVGLFLGIITAAVLGGFKDMNPTLPALNCSVENTHPTVSYYAHPQVASYNTYYHSPPHLPPYSAYDFQHSGVFPSSPPSGLSDEPQSASPSPSYMWSSSAPPRYSPPYYPPFEKPPPYSP

SEQ ID NO: 91652 - protein, 241 aa, Homo sapiens
  Payload ID: 18343
  Gene Name: transmembrane protein 255A
  Uniprot ID: Q5JRV8
  ENSP ID: ENSP00000405781
MHQSLTQQRSSDMSLPDSMGAFNRRKRNSIYVTVTLLIVSVLILTVGLAATTRTQNVTVGGYYPGVILGFGSFLGIIGSNLIENKRQMLVASIVFISFGVIAAFCCAIVDGVFAARHIDLKPLYANRCHYVPKTSQKEAEENPTLPALNCSVENTHPTVSYYAHPQVASYNTYYHSPPHLPPYSAYDFQHSGVFPSSPPSGLSDEPQSASPSPSYMWSSSAPPRYSPPYYPPFEKPPPYSP

SEQ ID NO: 91653 - protein, 149 aa, Homo sapiens
  Payload ID: 18343
  Gene Name: transmembrane protein 255A
  ENSP ID: ENSP00000428013
MHQSLTQQRSSDMSLPDSMGAFNRRKRNSIYVTVTLLIVSVLILTVGLAATTRTQNVTVGGYYPGVILGFGSFLGIIGSNLIENKRQMLVASIVFISFGVIAAFCCAIVDGVFAARHIDLKPLYANRCHYVPKTSQKEAEENPTLPALN

SEQ ID NO: 91654 - protein, 326 aa, Homo sapiens
  Payload ID: 18344
  Gene Name: transmembrane protein 255B
  Uniprot ID: Q8WV15
  ENSP ID: ENSP00000364502
MQPPVPGPLGLLDPAEGLSRRKKTSLWFVGSLLLVSVLIVTVGLAATTRTENVTVGGYYPGIILGFGSFLGIIGINLVENRRQMLVAAIVFISFGVVAAFCCAIVDGVFAAQHIEPRPLTTGRCQFYSSGVGYLYDVYQTEVTCHSLDGKCQLKVRSNTCYCCDLYACGSAEPSPAYYEFIGVSGCQDVLHLYRLLWASAVLNVLGLFLGIITAAVLGAFKDMVPLSQLAYGPAVPPQTLYNPAQQILAYAGFRLTPEPVPTCSSYPLPLQPCSRFPVAPSSALASSEDLQPPSPSSSGSGLPGQAPPCYAPTYFPPGEKPPPYAP

SEQ ID NO: 91655 - protein, 166 aa, Homo sapiens
  Payload ID: 18344
  Gene Name: transmembrane protein 255B
  ENSP ID: ENSP00000479391
MQPPVPGPLGLLDPAEGLSRRKKTSLWFVGSLLLVSVLIVTVGLAATTRTENVTVGGYYPGIILGFGSFLGIIGINLVENRRQMLVAAIVFISFGVVAAFCCAIVDGVFAAQHIEPRPLTTGRCQFYSSGVGYLYDVYQTEVSRSTEIHVGFAQLTPPTPRGFPCT

SEQ ID NO: 91656 - protein, 15 aa, Homo sapiens
  Payload ID: 18344
  Gene Name: transmembrane protein 255B
  ENSP ID: ENSP00000488348
MQPPVPGPLGLLDPA

SEQ ID NO: 91657 - protein, 15 aa, Homo sapiens
  Payload ID: 18344
  Gene Name: transmembrane protein 255B
  ENSP ID: ENSP00000488630
MQPPVPGPLGLLDPA

SEQ ID NO: 91658 - protein, 113 aa, Homo sapiens
  Payload ID: 18345
  Gene Name: transmembrane protein 256
  Uniprot ID: Q8N2U0
  ENSP ID: ENSP00000301939
MAGPAAAFRRLGALSGAAALGFASYGAHGAQFPDAYGKELFDKANKHHFLHSLALLGVPHCRKPLWAGLLLASGTTLFCTSFYYQALSGDPSIQTLAPAGGTLLLLGWLALAL

SEQ ID NO: 91659 - protein, 26 aa, Homo sapiens
  Payload ID: 18345
  Gene Name: transmembrane protein 256
  ENSP ID: ENSP00000468314
GAAALGFASYGAHGAQFPDAYGKEVK

SEQ ID NO: 91660 - protein, 111 aa, Homo sapiens
  Payload ID: 18346
  Gene Name: transmembrane protein 257
  Uniprot ID: O96002
  ENSP ID: ENSP00000386149
MYSRLFYLKSSYIIYFEPLFSNAIINILSFINSLASPLTIFCFALSAQALSTIFYFRIFIFIFHSWILLFHFYFTCSFKTYEHQHSKMVPAYRMQSPRALPRTYLYVWPYK

SEQ ID NO: 91661 - protein, 79 aa, Homo sapiens
  Payload ID: 18347
  Gene Name: transmembrane protein 258
  Uniprot ID: P61165
  ENSP ID: ENSP00000257262
MELEAMSRYTSPVNPAVFPHLTVVLLAIGMFFTAWFFVYEVTSTKYTRDIYKELLISLVASLFMGFGVLFLLLWVGIYV

SEQ ID NO: 91662 - protein, 49 aa, Homo sapiens
  Payload ID: 18347
  Gene Name: transmembrane protein 258
  ENSP ID: ENSP00000437809
MELEAMSRYTSPVNPAVFPHLTVVLLAIGMFFTAWFFVYPFTEQPEDQH

SEQ ID NO: 91663 - protein, 49 aa, Homo sapiens; identical to SEQ ID NO: 91662
  Payload ID: 18347
  Gene Name: transmembrane protein 258
  ENSP ID: ENSP00000441836

SEQ ID NO: 91664 - protein, 79 aa, Homo sapiens; identical to SEQ ID NO: 91661
  Payload ID: 18347
  Gene Name: transmembrane protein 258
  Uniprot ID: P61165
  ENSP ID: ENSP00000443216

SEQ ID NO: 91665 - protein, 74 aa, Homo sapiens
  Payload ID: 18347
  Gene Name: transmembrane protein 258
  ENSP ID: ENSP00000443836
MSRYTSPVNPAVFPHLTVVLLAIGMFFTAWFFVYEVTSTKYTRDIYKELLISLVASLFMGFGVLFLLLWVGIYV

SEQ ID NO: 91666 - protein, 49 aa, Homo sapiens; identical to SEQ ID NO: 91662
  Payload ID: 18347
  Gene Name: transmembrane protein 258
  ENSP ID: ENSP00000445404

SEQ ID NO: 91667 - protein, 408 aa, Homo sapiens
  Payload ID: 18348
  Gene Name: transmembrane protein 259
  Uniprot ID: Q4ZIN3
  ENSP ID: ENSP00000331423
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRIP

SEQ ID NO: 91668 - protein, 620 aa, Homo sapiens
  Payload ID: 18348
  Gene Name: transmembrane protein 259
  Uniprot ID: Q4ZIN3
  ENSP ID: ENSP00000349087
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 91669 - protein, 209 aa, Homo sapiens
  Payload ID: 18348
  Gene Name: transmembrane protein 259
  ENSP ID: ENSP00000475219
  MOD_RES (1)..(1): Any amino acid
XFLRNVVSGEHYRFVSMWMARTSYLAAFAIMVIFTLSVSMLLRYSHHQIFVFIAPLLTVILALVGMEAIMSEFFNDTTTAFYIILIVWLADQYDAICCHTSTSKRHWLRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVS

SEQ ID NO: 91670 - protein, 421 aa, Homo sapiens
  Payload ID: 18348
  Gene Name: transmembrane protein 259
  ENSP ID: ENSP00000475354
MWVPAGEPGSGTGSWSVGDWTTQGMRVAEPGCGQRVARGPWEHLQALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIAPLLTVILALVGEDPTRPPPPRAAPRPARFNRRRLSLQGWRPSCRSSSTTPPPPSTSSSSCGSRTSMTPSAATPAPASGIGCGSSISTTSPSMPITTASMGSIAAWPWSPPGSSSSIP

SEQ ID NO: 91671 - protein, 205 aa, Homo sapiens
  Payload ID: 18348
  Gene Name: transmembrane protein 259
  ENSP ID: ENSP00000475704
  MOD_RES (1)..(1): Any amino acid
XVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLR

SEQ ID NO: 91672 - protein, 139 aa, Homo sapiens
  Payload ID: 18348
  Gene Name: transmembrane protein 259
  ENSP ID: ENSP00000476127
  MOD_RES (1)..(1): Any amino acid
XGRGSFPGLAVEPGSNLDMEDEEEEELTMEMFGNSSIKVPGRPQFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDD

SEQ ID NO: 91673 - protein, 169 aa, Homo sapiens
  Payload ID: 18349
  Gene Name: transmembrane protein 26
  ENSP ID: ENSP00000277749
YCSIQAEGTSQNTSRKEDFNQTLTSNEQTSRADDLIETAKVFVNNLSTVCEKVWTLGLHQTFLLMLIIGRWLLPIGGGITRDQLSQLLLMFVGTAADILEFTSETLEEQNVRNSPALVYAILVIWTWSMLQFPLDLADPCIRTSEDIGAVKIVLIGGPWNPTGLTLIKT

SEQ ID NO: 91674 - protein, 368 aa, Homo sapiens
  Payload ID: 18349
  Gene Name: transmembrane protein 26
  Uniprot ID: Q6ZUK4
  ENSP ID: ENSP00000382237
MEGLVFLNALATRLLFLLHSLVGVWRVTEVKKEPRYWLLALLNLLLFLETALTLKFKRGRGYKWFSPAIFLYLISIVPSLWLLELHHETQYCSIQAEGTSQNTSRKEDFNQTLTSNEQTSRADDLIETAKVFVNNLSTVCEKVWTLGLHQTFLLMLIIGRWLLPIGGGITRDQLSQLLLMFVGTAADILEFTSETLEEQNVRNSPALVYAILVIWTWSMLQFPLDLAVQNVVCPVSVTERGFPSLFFCQYSADLWNIGISVFIQDGPFLVVRLILMTYFKVINQMLVFFAAKNFLVVVLQLYRLVVLALAVRASLRSQSEGLKGEHGCRAQTSESGPSQRDWQNESKEGLAIPLRGSPVTSDDSHHTP

SEQ ID NO: 91675 - protein, 368 aa, Homo sapiens; identical to SEQ ID NO: 91674
  Payload ID: 18349
  Gene Name: transmembrane protein 26
  Uniprot ID: Q6ZUK4
  ENSP ID: ENSP00000425286

SEQ ID NO: 91676 - protein, 223 aa, Homo sapiens
  Payload ID: 18349
  Gene Name: transmembrane protein 26
  Uniprot ID: Q6ZUK4
  ENSP ID: ENSP00000426071
MEGLVFLNALATRLLFLLHSLVGVWRVTEVKKEPRYWLLALLNLLLFLETALTLKFKRGRGYKWFSPAIFLYLISIVPSLWLLELHHETQYCSIQAEGTSQNTSRKEDFNQTLTSNEQTSRADDLIETAKVFVNNLSTVCEKVWTLGLHQTFLLMLIIGRWLLPIGGGITRDQLSQLLLMFVGTAADILEFTSETLEEQNVRLCWKNSTNRRHTNPKWQLVLF

SEQ ID NO: 91677 - protein, 707 aa, Homo sapiens
  Payload ID: 18350
  Gene Name: transmembrane protein 260
  Uniprot ID: Q9NX78
  ENSP ID: ENSP00000261556
MSPHGDGRGQAQGRAVRVGLRRSGGIRGGVAVFAAVAAVFTFTLPPSVPGGDSGELITAAHELGVAHPPGYPLFTLVAKLAITLFPFGSIAYRVNLLCGLFGAVAASLLFFTVFRLSGSSAGGILAAGVFSFSRLTWQWSIAAEVFSLNNLFVGLLMALTVHFEEAATAKERSKVAKIGAFCCGLSLCNQHTIILYVLCIIPWILFQLLKKKELSLGSLLKLSLYFSAGLLPYVHLPISSYLNHARWTWGDQTTLQGFLTHFLREEYGTFSLAKSEIGSSMSEILLSQVTNMRTELSFNIQALAVCANICLATKDRQNPSLVWLFTGMFCIYSLFFAWRANLDISKPLFMGVVERFWMQSNAVVAVLAGIGLAAVVSETNRVLNSNGLQCLEWLSATLFVVYQIYSNYSVCDQRTNYVIDKFAKNLLTSMPHDAIILLRGDLPGNSLRYMHYCEGLRPDISLVDQEMMTYEWYLPKMAKHLPGVNFPGNRWNPVEGILPSGMVTFNLYHFLEVNKQKETFVCIGIHEGDPTWKKNYSLWPWGSCDKLVPLEIVFNPEEWIKLTKSIYNWTEEYGRFDPSSWESVANEEMWQARMKTPFFIFNLAETAHMPSKVKAQLYAQAYDLYKEIVYLQKEHPVNWHKNYAIACERMLRLQARDADPEVLLSETIRHFRLYSQKAPNDPQQADILGALKHLRKELQSLRNRKNV

SEQ ID NO: 91678 - protein, 409 aa, Homo sapiens
  Payload ID: 18350
  Gene Name: transmembrane protein 260
  ENSP ID: ENSP00000441934
MSPHGDGRGQAQGRAVRVGLRRSGGIRGGVAVFAAVAAVFTFTLPPSVPGGDSGELITAAHELGVAHPPGYPLFTLVAKLAITLFPFGSIAYRVNLLCGLFGAVAASLLFFTVFRLSGSSAGGILAAGVFSFSRLTWQWSIAAEVFSLNNLFVGLLMALTVHFEEAATAKERSKVAKIGAFCCGLSLCNQHTIILYVLCIIPWILFQLLKKKELSLGSLLKLSLYFSAGLLPYVHLPISSYLNHARWTWGDQTTLQGFLTHFLREEYGTFSLAKSEIGSSMSEILLSQVTNMRTELSFNIQALAVCANICLATKDRQNPSLVWLFTGMFCIYSLFFAWRANLDISKPLFMGVVERFWMQSNAVVAVLAGIGLAAVVSETNRVLNSNGLQCLEWLSATLFVVYQIYSNYR

SEQ ID NO: 91679 - protein, 324 aa, Homo sapiens
  Payload ID: 18350
  Gene Name: transmembrane protein 260
  ENSP ID: ENSP00000442602
MSPHGDGRGQAQGRAVRVGLRRSGGIRGGVAVFAAVAAVFTFTLPPSVPGGDSGELITAAHELGVAHPPGYPLFTLVAKLAITLFPFGSIAYRVNLLCGLFGAVAASLLFFTVFRLSGSSAGGILAAGVFSFSRLTWQWSIAAEVFSLNNLFVGLLMALTVHFEEAATAKERSKVAKIGAFCCGLSLCNQHTIILYVLCIIPWILFQLLKKKELSLGSLLKLSLYFSAGLLPYVHLPISSYLNHARWTWGDQTTLQGFLTHFLREEYGTFSLAKSEIGSSMSEILLSQVTNMRTELSFNIQALAVCANICLATKWNDSGCRAMQ

SEQ ID NO: 91680 - protein, 253 aa, Homo sapiens
  Payload ID: 18350
  Gene Name: transmembrane protein 260
  ENSP ID: ENSP00000450988
MALTVHFEEAATAKERSKVAKIGAFCCGLSLCNQHTIILYVLCIIPWILFQLLKKKELSLGSLLKLSLYFSAGLLPYVHLPISSYLNHARWTWGDQTTLQGFLTHFLREEYGTFSLAKSEIGSSMSEILLSQVTNMRTELSFNIQALAVCANICLATKDRQNPSLVWLFTGMFCIYSLFFAWRANLDISKPLFMGVVERFWMQSNAVVAVLAGIGLAAVVSETNRVLNSNGLQCLEWLSATLFVVYQIYSNYR

SEQ ID NO: 91681 - protein, 74 aa, Homo sapiens
  Payload ID: 18350
  Gene Name: transmembrane protein 260
  ENSP ID: ENSP00000451677
MNFLRSPPDPAKDHCNGELITAAHELGVAHPPGYPLFTLVAKLAITLFPFGSIAYRVNLLCGLFGAVAASLLFF

SEQ ID NO: 91682 - protein, 41 aa, Homo sapiens
  Payload ID: 18350
  Gene Name: transmembrane protein 260
  ENSP ID: ENSP00000451695
  MOD_RES (1)..(1): Any amino acid
XPFFIFNLAETAHMPSKVKAQLYAQAYDCTDSIKSDKRGFL

SEQ ID NO: 91683 - protein, 115 aa, Homo sapiens
  Payload ID: 18350
  Gene Name: transmembrane protein 260
  ENSP ID: ENSP00000452065
MSPHGDGRGQAQGRAVRVGLRRSGGIRGGVAVFAAVAAVFTFTLPPSVPGGDSGELITAAHELGVAHPPGYPLFTLVAKLAITLFPFGSIAYRVNLLCGLFGAVAASLLFFTVFR

SEQ ID NO: 91684 - protein, 101 aa, Homo sapiens
  Payload ID: 18350
  Gene Name: transmembrane protein 260
  ENSP ID: ENSP00000452441
  MOD_RES (1)..(1): Any amino acid
XYFSAGLLPYVHLPISSYLNHARWTWGDQTTLQGFLTHFLREEYGTFSLAKSEIGSSMSEILLSQVTNMRTELSFNIQALAVCANICLATKWNDSGCRAMQ

SEQ ID NO: 91685 - protein, 20 aa, Homo sapiens
  Payload ID: 18350
  Gene Name: transmembrane protein 260
  ENSP ID: ENSP00000452579
  MOD_RES (1)..(1): Any amino acid
XLCGLFGAVAASLLFFTVFR

SEQ ID NO: 91686 - protein, 112 aa, Homo sapiens
  Payload ID: 18351
  Gene Name: transmembrane protein 261
  Uniprot ID: Q96GE9
  ENSP ID: ENSP00000350961
MGSRLSQPFESYITAPPGTAAAPAKPAPPATPGAPTSPAEHRLLKTCWSCRVLSGLGLMGAGGYVYWVARKPMKMGYPPSPWTITQMVIGLSIATWGIVVMADPKGKAYRVV

SEQ ID NO: 91687 - protein, 116 aa, Homo sapiens
  Payload ID: 18352
  Gene Name: transmembrane protein 262
  Uniprot ID: E9PQX1
  ENSP ID: ENSP00000432459
MWLQDRIATFFFPKGMMLTTAALMLFFLHLGIFIRDVHNFCITYHYDHMSFHYTVVLMFSQVISICWAAMGSLYAEMTENKYVCFSALTILMLNGAMFFNRLSLEFLAIEYREEHH

SEQ ID NO: 91688 - protein, 106 aa, Homo sapiens
  Payload ID: 18352
  Gene Name: transmembrane protein 262
  ENSP ID: ENSP00000435002
MWLQDRIATFFFPKGMMLTTAALMLFFLHLGIFIRDVHNFCITYHYDHMSFHYTVVLMFSQVISICWAAMGSLYAEMTENKYVCFSALTILMLNGAMFFNRLSLEF

SEQ ID NO: 91689 - protein, 112 aa, Homo sapiens
  Payload ID: 18352
  Gene Name: transmembrane protein 262
  ENSP ID: ENSP00000436355
LQDRIATFFFPKGMMLTTAALMLFFLHLGIFIRDVHNFCITYHYDHMSFHYTVVLMFSQVISICWAAMGSLYAEMTENNAQRSHVLQPPVLGVSGHRVPGGAPLRPGESEQG

SEQ ID NO: 91690 - protein, 110 aa, Homo sapiens [sequence omitted]

SEQ ID NO: 91691 - protein, 116 aa, Homo sapiens
  Payload ID: 18353
  Gene Name: transmembrane protein 263
  Uniprot ID: Q8WUH6
  ENSP ID: ENSP00000280756
MNQTDKNQQEIPSYLNDEPPEGSMKDHPQQQPGMLSRVTGGIFSVTKGAVGATIGGVAWIGGKSLEVTKTAVTTVPSMGIGLVKGGVSAVAGGVTAVGSAVVNKVPLTGKKKDKSD

SEQ ID NO: 91692 - protein, 116 aa, Homo sapiens; identical to SEQ ID NO: 91691
  Payload ID: 18353
  Gene Name: transmembrane protein 263
  Uniprot ID: Q8WUH6
  ENSP ID: ENSP00000446537

SEQ ID NO: 91693 - protein, 116 aa, Homo sapiens; identical to SEQ ID NO: 91691
  Payload ID: 18353
  Gene Name: transmembrane protein 263
  Uniprot ID: Q8WUH6
  ENSP ID: ENSP00000446717

SEQ ID NO: 91694 - protein, 116 aa, Homo sapiens; identical to SEQ ID NO: 91691
  Payload ID: 18353
  Gene Name: transmembrane protein 263
  Uniprot ID: Q8WUH6
  ENSP ID: ENSP00000449106

SEQ ID NO: 91695 - protein, 116 aa, Homo sapiens; identical to SEQ ID NO: 91691
  Payload ID: 18353
  Gene Name: transmembrane protein 263
  Uniprot ID: Q8WUH6
  ENSP ID: ENSP00000449785

SEQ ID NO: 91696 - protein, 56 aa, Homo sapiens
  Payload ID: 18353
  Gene Name: transmembrane protein 263
  ENSP ID: ENSP00000450304
MNQTDKNQQEIPSYLNDEPPEESYSVNPGWSAMARSWPTATSASWVQAVLLPQPPK

SEQ ID NO: 91697 - protein, 116 aa, Homo sapiens; identical to SEQ ID NO: 91691
  Payload ID: 18353
  Gene Name: transmembrane protein 263
  Uniprot ID: Q8WUH6
  ENSP ID: ENSP00000450350

SEQ ID NO: 91698 - protein, 108 aa, Homo sapiens
  Payload ID: 18354
  Gene Name: transmembrane protein 265
  Uniprot ID: A0A087WTH1
  ENSP ID: ENSP00000477871
MEDEEKAVEILGNTEAAHPPSPIRCCWLRLRCLAATSIICGCSCLGVMALVFAIKAEERHKAGRSEEAVRWGARARKLILASFAVWLAVLILGPLLLWLLSYAIAQAE

SEQ ID NO: 91699 - protein, 531 aa, Homo sapiens
  Payload ID: 18355
  Gene Name: transmembrane protein 266
  Uniprot ID: Q2M3C6
  ENSP ID: ENSP00000373594
MAVAPSFNMTNPQPAIEGGISEVEIISQQVDEETKSIAPVQLVNFAYRDLPLAAVDLSTAGSQLLSNLDEDYQREGSNWLKPCCGKRAAVWQVFLLSASLNSFLVACVILVVILLTLELLIDIKLLQFSSAFQFAGVIHWISLVILSVFFSETVLRIVVLGIWDYIENKIEVFDGAVIILSLAPMVASTVANGPRSPWDAISLIIMLRIWRVKRVIDAYVLPVKLEMEMVIQQYEKAKVIQDEQLERLTQICQEQGFEIRQLRAHLAQQDLDLAAEREAALQAPHVLSQPRSRFKVLEAGTWDEETAAESVVEELQPSQEATMKDDMNSYISQYYNGPSSDSGVPEPAVCMVTTAAIDIHQPNISSDLFSLDMPLKLGGNGTSATSESASRSSVTRAQSDSSQTLGSSMDCSTAREEPSSEPGPSPPPLPSQQQVEEATVQDLLSSLSEDPCPSQKALDPAPLARPSPAGSAQTSPELEHRVSLFNQKNQEGFTVFQIRPVIHFQPTVPMLEDKFRSLESKEQKLHRVPEA

SEQ ID NO: 91700 - protein, 101 aa, Homo sapiens
  Payload ID: 18355
  Gene Name: transmembrane protein 266
  ENSP ID: ENSP00000435049
MAVAPSFNMTNPQPAIEGGISEVEIISQQVDEETKSIAPVQLVNFAYRDLPLAAVDLSTAGSQLLSNLDEDYQREGSNWLKPCCGKRAAVWQFPAHSSLLA

SEQ ID NO: 91701 - protein, 121 aa, Homo sapiens
  Payload ID: 18355
  Gene Name: transmembrane protein 266
  ENSP ID: ENSP00000453957
MAVAPSFNMTNPQPAIEGGISEVEIISQQVDEETKSIAPVQLVNFAYRDLPLAAVDLSTAGSQLLSNLDEDYQREGFQRIPVCWRDSLDQPGHSVRVLLRDCSTDCGAWDLGLHRKQNRGV

SEQ ID NO: 91702 - protein, 222 aa, Homo sapiens
  Payload ID: 18356
  Gene Name: transmembrane protein 27
  Uniprot ID: Q9HBJ8
  ENSP ID: ENSP00000369699
MLWLLFFLVTAIHAELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPIWIIIFGVIFCIIIVAIALLILSGIWQRRRKNKEPSEVDDAEDKCENMITIENGIPSDPLDMKGGHINDAFMTEDERLTPL

SEQ ID NO: 91703 - protein, 361 aa, Homo sapiens
  Payload ID: 18357
  Gene Name: transmembrane protein 30A
  Uniprot ID: Q9NV96
  ENSP ID: ENSP00000230461
MAMNYNAKDEVDGGPPCAPGGTAKTRRPDNTAFKQQRLPAWQPILTAGTVLPIFFIIGLIFIPIGIGIFVTSNNIREIEIDYTGTEPSSPCNKCLSPDVTPCFCTINFTLEKSFEGNVFMYYGLSNFYQNHRRYVKSRDDSQLNGDSSALLNPSKECEPYRRNEDKPIAPCGAIANSMFNDTLELFLIGNDSYPIPIALKKKGIAWWTDKNVKFRNPPGGDNLEERFKGTTKPVNWLKPVYMLDSDPDNNGFINEDFIVWMRTAALPTFRKLYRLIERKSDLHPTLPAGRYSLNVTYNYPVHYFDGRKRMILSTISWMGGKNPFLGIAYIAVGSISFLLGVVLLVINHKYRNSSNTADITI

SEQ ID NO: 91704 - protein, 242 aa, Homo sapiens
  Payload ID: 18357
  Gene Name: transmembrane protein 30A
  Uniprot ID: Q9NV96
  ENSP ID: ENSP00000359067
MYYGLSNFYQNHRRYVKSRDDSQLNGDSSALLNPSKECEPYRRNEDKPIAPCGAIANSMFNDTLELFLIGNDSYPIPIALKKKGIAWWTDKNVKFRNPPGGDNLEERFKGTTKPVNWLKPVYMLDSDPDNNGFINEDFIVWMRTAALPTFRKLYRLIERKSDLHPTLPAGRYSLNVTYNYPVHYFDGRKRMILSTISWMGGKNPFLGIAYIAVGSISFLLGVVLLVINHKYRNSSNTADITI

SEQ ID NO: 91705 - protein, 77 aa, Homo sapiens
  Payload ID: 18357
  Gene Name: transmembrane protein 30A
  ENSP ID: ENSP00000430270
MYYGLSNFYQNHRRYVKSRDDSQLNGDSSALLNPSKECEPYRRNEDKPIAPCGAIANSMFNDTLELFLIGNDSYPIP

SEQ ID NO: 91706 - protein, 325 aa, Homo sapiens
  Payload ID: 18357
  Gene Name: transmembrane protein 30A
  Uniprot ID: Q9NV96
  ENSP ID: ENSP00000431007
MAMNYNAKDEVDGGPPCAPGGTAKTRRPDNTAFKQQRLPAWQPILTAGTVLPIFFIIGLIFIPIGIGIFVTSNNIREIEGNVFMYYGLSNFYQNHRRYVKSRDDSQLNGDSSALLNPSKECEPYRRNEDKPIAPCGAIANSMFNDTLELFLIGNDSYPIPIALKKKGIAWWTDKNVKFRNPPGGDNLEERFKGTTKPVNWLKPVYMLDSDPDNNGFINEDFIVWMRTAALPTFRKLYRLIERKSDLHPTLPAGRYSLNVTYNYPVHYFDGRKRMILSTISWMGGKNPFLGIAYIAVGSISFLLGVVLLVINHKYRNSSNTADITI

SEQ ID NO: 91707 - protein, 351 aa, Homo sapiens
  Payload ID: 18358
  Gene Name: transmembrane protein 30B
  Uniprot ID: Q3MIR4
  ENSP ID: ENSP00000450842
MTWSATARGAHQPDNTAFTQQRLPAWQPLLSASIALPLFFCAGLAFIGLGLGLYYSSNGIKELEYDYTGDPGTGNCSVCAAAGQGRALPPPCSCAWYFSLPELFQGPVYLYYELTNFYQNNRRYGVSRDDAQLSGLPSALRHPVNECAPYQRSAAGLPIAPCGAIANSLFNDSFSLWHQRQPGGPYVEVPLDRSGIAWWTDYHVKFRNPPLVNGSLALAFQGTAPPPNWRRPVYELSPDPNNTGFINQDFVVWMRTAALPTFRKLYARIRQGNYSAGLPRGAYRVNITYNYPVRAFGGHKLLIFSSISWMGGKNPFLGIAYLVVGSLCILTGFVMLVVYIRYQDQDDDDEE

SEQ ID NO: 91708 - protein, 68 aa, Homo sapiens
  Payload ID: 18359
  Gene Name: transmembrane protein 30C
  ENSP ID: ENSP00000419663
  MOD_RES (1)..(1): Any amino acid
XLCMGIILILSARSTQEIEINYTRICANCAKLRENASNFDKECTCSIPFYLSGKMMVGEIQETRLTLH

SEQ ID NO: 91709 - protein, 168 aa, Homo sapiens
  Payload ID: 18360
  Gene Name: transmembrane protein 31
  Uniprot ID: Q5JXX7
  ENSP ID: ENSP00000316940
MRLTEKSEGEQQLKPNNSNAPNEDQEEEIQQSEQHTPARQRTQRADTQPSRCRLPSRRTPTTSSDRTINLLEVLPWPTEWIFNPYRLPALFELYPEFLLVFKEAFHDISHCLKAQMEKIGLPIILHLFALSTLYFYKFFLPTILSLSFFILLVLLLLLFIIVFILIFF

SEQ ID NO: 91710 - protein, 68 aa, Homo sapiens
  Payload ID: 18361
  Gene Name: transmembrane protein 33
  ENSP ID: ENSP00000264452
MADTTPNGPQGAGAVQFMMTNKLDTAMWLSRLFTVYCSALFVLPLLGEYLPSLVILFASCCHIYEKGP

SEQ ID NO: 91711 - protein, 155 aa, Homo sapiens
  Payload ID: 18361
  Gene Name: transmembrane protein 33
  ENSP ID: ENSP00000421546
  MOD_RES (1)..(1): Any amino acid
XLRLHQRLPHFQLSRAFLAQALLEDSCHYLLYSLIFVNSYPVTMSIFPVLLFSLLHAATYTKKVLDARGSNSLPLLRSVLDKLSANQQNILKFIACNEIFLMPATVFMLFSGQGSLLQPFIYYRFLTLRYSSRRNPYCRLWCPKTVTIVTPKRSP

SEQ ID NO: 91712 - protein, 247 aa, Homo sapiens
  Payload ID: 18361
  Gene Name: transmembrane protein 33
  Uniprot ID: P57088
  ENSP ID: ENSP00000422473
MADTTPNGPQGAGAVQFMMTNKLDTAMWLSRLFTVYCSALFVLPLLGLHEAASFYQRALLANALTSALRLHQRLPHFQLSRAFLAQALLEDSCHYLLYSLIFVNSYPVTMSIFPVLLFSLLHAATYTKKVLDARGSNSLPLLRSVLDKLSANQQNILKFIACNEIFLMPATVFMLFSGQGSLLQPFIYYRFLTLRYSSRRNPYCRTLFNELRIVVEHIIMKPACPLFVRRLCLQSIAFISRLAPTVP

SEQ ID NO: 91713 - protein, 68 aa, Homo sapiens
  Payload ID: 18361
  Gene Name: transmembrane protein 33
  ENSP ID: ENSP00000422517
MADTTPNGPQGAGAVQFMMTNKLDTAMWLSRLFTVYCSALFVLPLLGVQMSCFKKERSSALSILTPVN

SEQ ID NO: 91714 - protein, 222 aa, Homo sapiens
  Payload ID: 18361
  Gene Name: transmembrane protein 33
  ENSP ID: ENSP00000422810
MADTTPNGPQGAGAVQFMMTNKLDTAMWLSRLFTVYCSALFVLPLLGLHEAASFYQRALLANALTSALRLHQRLPHFQLSRAFLAQALLEDSCHYLLYSLIFVNSYPVTMSIFPVLLFSLLHAATYTKKVLDARGSNSLPLLRSVLDKLSANQQNILKFIACNEIFLMPATVFMLFSGQGSLLQPFIYYRFLTLRYSSRRNPYCRTLFNELRIVVEHIIMKP

SEQ ID NO: 91715 - protein, 247 aa, Homo sapiens; identical to SEQ ID NO: 91712
  Payload ID: 18361
  Gene Name: transmembrane protein 33
  Uniprot ID: P57088
  ENSP ID: ENSP00000427006

SEQ ID NO: 91716 - protein, 247 aa, Homo sapiens; identical to SEQ ID NO: 91712
  Payload ID: 18361
  Gene Name: transmembrane protein 33
  Uniprot ID: P57088
  ENSP ID: ENSP00000441455

SEQ ID NO: 91717 - protein, 167 aa, Homo sapiens
  Payload ID: 18362
  Gene Name: transmembrane protein 35
  Uniprot ID: Q53FP2
  ENSP ID: ENSP00000362021
MASPRTVTIVALSVALGLFFVFMGTIKLTPRLSKDAYSEMKRAYKSYVRALPLLKKMGINSILLRKSIGALEVACGIVMTLVPGRPKDVANFFLLLLVLAVLFFHQLVGDPLKRYAHALVFGILLTCRLLIARKPEDRSSEKKPLPGNAEEQPSLYEKAPQGKVKVS

SEQ ID NO: 91718 - protein, 190 aa, Homo sapiens
  Payload ID: 18363
  Gene Name: transmembrane protein 37
  Uniprot ID: Q8WXS4
  ENSP ID: ENSP00000303148
MTAVGVQAQRPLGQRQPRRSFFESFIRTLIITCVALAVVLSSVSICDGHWLLAEDRLFGLWHFCTTTNQTICFRDLGQAHVPGLAVGMGLVRSVGALAVVAAIFGLEFLMVSQLCEDKHSQCKWVMGSILLLVSFVLSSGGLLGFVILLRNQVTLIGFTLMFWCEFTASFLLFLNAISGLHINSITHPWE

SEQ ID NO: 91719 - protein, 202 aa, Homo sapiens
  Payload ID: 18363
  Gene Name: transmembrane protein 37
  ENSP ID: ENSP00000387015
MTRPDCSSDFNSRHFPLGQAQRPLGQRQPRRSFFESFIRTLIITCVALAVVLSSVSICDGHWLLAEDRLFGLWHFCTTTNQTICFRDLGQAHVPGLAVGMGLVRSVGALAVVAAIFGLEFLMVSQLCEDKHSQCKWVMGSILLLVSFVLSSGGLLGFVILLRNQVTLIGFTLMFWCEFTASFLLFLNAISGLHINSITHPWE

SEQ ID NO: 91720 - protein, 66 aa, Homo sapiens
  Payload ID: 18363
  Gene Name: transmembrane protein 37
  ENSP ID: ENSP00000400770
MVARTQTWTRPAGPRGLWAKGSPAGPSLNPSSGPSSSRVWPWLWSCPRSPFVMGTGSWLRTASSGS

SEQ ID NO: 91721 - protein, 299 aa, Homo sapiens
  Payload ID: 18364
  Gene Name: transmembrane protein 38A
  Uniprot ID: Q9H6F2
  ENSP ID: ENSP00000187762
MELLSALSLGELALSFSRVPLFPVFDLSYFIVSILYLKYEPGAVELSRRHPIASWLCAMLHCFGSYILADLLLGEPLIDYFSNNSSILLASAVWYLIFFCPLDLFYKCVCFLPVKLIFVAMKEVVRVRKIAVGIHHAHHHYHHGWFVMIATGWVKGSGVALMSNFEQLLRGVWKPETNEILHMSFPTKASLYGAILFTLQQTRWLPVSKASLIFIFTLFMVSCKVFLTATHSHSSPFDALEGYICPVLFGSACGGDHHHDNHGGSHSGGGPGAQHSAMPAKSKEELSEGSRKKKAKKAD

SEQ ID NO: 91722 - protein, 115 aa, Homo sapiens
  Payload ID: 18364
  Gene Name: transmembrane protein 38A
  ENSP ID: ENSP00000469721
  MOD_RES (1)..(1): Any amino acid
XFSRVPLFPVFDLSYFIVSILYLKYEPGAVELSRRHPIASWLCAMLHCFGSYILADLLLGEPLIDYFSNNSSILLASAVWYLIFFCPLDLFYKCVCFLPVKLIFVAMKEVEVAVS

SEQ ID NO: 91723 - protein, 237 aa, Homo sapiens
  Payload ID: 18365
  Gene Name: transmembrane protein 38B
  ENSP ID: ENSP00000363820
MLHCFGGGILSCLLLAEPPLKFLANHTNILLASSIWYITFFCPHDLVSQGYSYLPVQLLASGMKEVTRTWKIVGGVTHANSYYKNGWIVMIAIGWARGAGGTIITNFERLVKGDWKPEGDEWLKMSYPAKVTLLGSVIFTFQHTQHLAISKHNLMFLYTIFIVATKITMMTTQTSTMTFAPFEDTLSWMLFGWQQPFSSCEKKSEAKSPSNGVGSLASKPVDVASDNVKKKHTKKNE

SEQ ID NO: 91724 - protein, 291 aa, Homo sapiens
  Payload ID: 18365
  Gene Name: transmembrane protein 38B
  Uniprot ID: Q9NVV0
  ENSP ID: ENSP00000363824
MDSPWDELALAFSRTSMFPFFDIAHYLVSVMAVKRQPGAAALAWKNPISSWFTAMLHCFGGGILSCLLLAEPPLKFLANHTNILLASSIWYITFFCPHDLVSQGYSYLPVQLLASGMKEVTRTWKIVGGVTHANSYYKNGWIVMIAIGWARGAGGTIITNFERLVKGDWKPEGDEWLKMSYPAKVTLLGSVIFTFQHTQHLAISKHNLMFLYTIFIVATKITMMTTQTSTMTFAPFEDTLSWMLFGWQQPFSSCEKKSEAKSPSNGVGSLASKPVDVASDNVKKKHTKKNE

SEQ ID NO: 91725 - protein, 35 aa, Homo sapiens
  Payload ID: 18365
  Gene Name: transmembrane protein 38B
  ENSP ID: ENSP00000403026
MLHCFGGGILSCLLLAEPPLKFLANHTNILLASSI

SEQ ID NO: 91726 - protein, 162 aa, Homo sapiens
  Payload ID: 18365
  Gene Name: transmembrane protein 38B
  ENSP ID: ENSP00000410800
  MOD_RES (1)..(1): Any amino acid
XSCLLLAEPPLKFLANHTNILLASSIWYITFFCPHDLVSQGYSYLPVQLLASGMKEVTRTWKIVGGVTHANSYYKNGWIVMIAIGWARGAGGTIITNFERLVKGDWKPEGDEWLKMSYPAKVTLLGSVIFTFQHTQHLAISKHNLMFLYTIFIVATKSLNWR

SEQ ID NO: 91727 - protein, 81 aa, Homo sapiens
  Payload ID: 18365
  Gene Name: transmembrane protein 38B
  ENSP ID: ENSP00000416680
  MOD_RES (1)..(1): Any amino acid
XWIVMIAIGWARGAGGTIITNFERLVKGDWKPEGDEWLKMSYPAKVTLLGSVIFTFQHTQHLAISKHNLMFLYTIFIVATK

SEQ ID NO: 91728 - protein, 488 aa, Homo sapiens
  Payload ID: 18366
  Gene Name: transmembrane protein 39A
  Uniprot ID: Q9NV64
  ENSP ID: ENSP00000326063
MPGGRRGPSRQQLSRSALPSLQTLVGGGCGNGTGLRNRNGSAIGLPVPPITALITPGPVRHCQIPDLPVDGSLLFEFLFFIYLLVALFIQYINIYKTVWWYPYNHPASCTSLNFHLIDYHLAAFITVMLARRLVWALISEATKAGAASMIHYMVLISARLVLLTLCGWVLCWTLVNLFRSHSVLNLLFLGYPFGVYVPLCCFHQDSRAHLLLTDYNYVVQHEAVEESASTVGGLAKSKDFLSLLLESLKEQFNNATPIPTHSCPLSPDLIRNEVECLKADFNHRIKEVLFNSLFSAYYVAFLPLCFVKSTQYYDMRWSCEHLIMVWINAFVMLTTQLLPSKYCDLLHKSAAHLGKWQKLEHGSYSNAPQHIWSENTIWPQGVLVRHSRCLYRAMGPYNVAVPSDVSHARFYFLFHRPLRLLNLLILIEGSVVFYQLYSLLRSEKWNHTLSMALILFCNYYVLFKLLRDRIVLGRAYSYPLNSYELKAN

SEQ ID NO: 91729 - protein, 146 aa, Homo sapiens
  Payload ID: 18366
  Gene Name: transmembrane protein 39A
  Uniprot ID: Q9NV64
  ENSP ID: ENSP00000402149
MPGGRRGPSRQQLSRSALPSLQTLVGGGCGNGTGLRNRNGSAIGLPVPPITALITPGPVRHCQIPDLPVDGSLLFEFLFFIYLLVALFIQYINIYKTVWWYPYNHPASCTSLNFHLIDYHLAAFITVMLARRLVWALISEVCVCKL

SEQ ID NO: 91730 - protein, 46 aa, Homo sapiens
  Payload ID: 18366
  Gene Name: transmembrane protein 39A
  ENSP ID: ENSP00000417233
MPGGRRGPSRQQLSRSALPSLQTLVGGGCGNGTGLRNRSCSSLPNS

SEQ ID NO: 91731 - protein, 191 aa, Homo sapiens
  Payload ID: 18366
  Gene Name: transmembrane protein 39A
  ENSP ID: ENSP00000418796
MPGGRRGPSRQQLSRSALPSLQTLVGGGCGNGTGLRNRNGSAIGLPVPPITALITPGPVRHCQIPDLPVDGSLLFEFLFFIYLLVALFIQYINIYKTVWWYPYNHPASCTSLNFHLIDYHLAAFITVMLARRLVWALISEATKAGAASMIHYMVLISARLVLLTLCGWVLCWTLVNLFRSHSVLNLLFLGY

SEQ ID NO: 91732 - protein, 112 aa, Homo sapiens
  Payload ID: 18366
  Gene Name: transmembrane protein 39A
  ENSP ID: ENSP00000419068
MPGGRRGPSRQQLSRSALPSLQTLVGGGCGNGTGLRNRNGSAIGLPVPPITALITPGPVRHCQIPDLPVDGSLLFEFLFFIYLLVALFIQYINIYKTVWWYPYNHPASCTSL

SEQ ID NO: 91733 - protein, 140 aa, Homo sapiens
  Payload ID: 18366
  Gene Name: transmembrane protein 39A
  ENSP ID: ENSP00000419405
MPGGRRGPSRQQLSRSALPSLQTLVGGGCGNGTGLRNRNGSAIGLPVPPITALITPGPVRHCQIPDLPVDGSLLFEFLFFIYLLVALFIQYINIYKTVWWYPYNHPASCTSLNFHLIDYHLAAFITVMLARRLVWALISE

SEQ ID NO: 91734 - protein, 165 aa, Homo sapiens
  Payload ID: 18366
  Gene Name: transmembrane protein 39A
  ENSP ID: ENSP00000419641
MPGGRRGPSRQQLSRSALPSLQTLVGGGCGNGTGLRNRFGVYVPLCCFHQDSRAHLLLTDYNYVVQHEAVEESASTVGGLAKSKDFLSLLLESLKEQFNNATPIPTHSCPLSPDLIRNEVECLKADFNHRIKEVLFNSLFSAYYVAFLPLCFVKSTQYYDMRWSC

SEQ ID NO: 91735 - protein, 18 aa, Homo sapiens
  Payload ID: 18366
  Gene Name: transmembrane protein 39A
  ENSP ID: ENSP00000420432
SYSNAPQHILAQAFKPRN

SEQ ID NO: 91736 - protein, 492 aa, Homo sapiens
  Payload ID: 18367
  Gene Name: transmembrane protein 39B
  Uniprot ID: Q9GZU3
  ENSP ID: ENSP00000338165
MGGRRGPNRTSYCRNPLCEPGSSGGSSGSHTSSASVTSVRSRTRSSSGTGLSSPPLATQTVVPLQHCKIPELPVQASILFELQLFFCQLIALFVHYINIYKTVWWYPPSHPPSHTSLNFHLIDFNLLMVTTIVLGRRFIGSIVKEASQRGKVSLFRSILLFLTRFTVLTATGWSLCRSLIHLFRTYSFLNLLFLCYPFGMYIPFLQLNCDLRKTSLFNHMASMGPREAVSGLAKSRDYLLTLRETWKQHTRQLYGPDAMPTHACCLSPSLIRSEVEFLKMDFNWRMKEVLVSSMLSAYYVAFVPVWFVKNTHYYDKRWSCELFLLVSISTSVILMQHLLPASYCDLLHKAAAHLGCWQKVDPALCSNVLQHPWTEECMWPQGVLVKHSKNVYKAVGHYNVAIPSDVSHFRFHFFFSKPLRILNILLLLEGAVIVYQLYSLMSSEKWHQTISLALILFSNYYAFFKLLRDRLVLGKAYSYSASPQRDLDHRFS

SEQ ID NO: 91737 - protein, 193 aa, Homo sapiens
  Payload ID: 18367
  Gene Name: transmembrane protein 39B
  ENSP ID: ENSP00000390889
MGGRRGPNRTSYCRNPLCEPGSSGGSSGSHTSSASVTSVRSRTRSSSGTGLSSPPLATQTVVPLQHCKIPELPVQASILFELQLFFCQLIALFVHYINIYKTVWWYPPSHPPSHTSLVWDVHSVPAAELRPPQDKPLQPHGLHGAPGGGQWPGKEPGLPPDTAGDVEAAHKTAVWPGRHAHPCLLPVTQPHPQ

SEQ ID NO: 91738 - protein, 192 aa, Homo sapiens
  Payload ID: 18367
  Gene Name: transmembrane protein 39B
  ENSP ID: ENSP00000414616
MGGRRGPNRTSYCRNPLCEPGSSGGSSGSHTSSASVTSVRSRTRSSSGTGLSSPPLATQTVVPLQHCKIPELPVQASILFELQLFFCQLIALFVHYINIYKTVWWYPPSHPPSHTSLASQRGKVSLFRSILLFLTRFTVLTATGWSLCRSLIHLFRTYSFLNLLFLCYPFGMYIPFLQLNCDLRKTSLFNHM

SEQ ID NO: 91739 - protein, 233 aa, Homo sapiens
  Payload ID: 18368
  Gene Name: transmembrane protein 40
  Uniprot ID: Q8WWA1
  ENSP ID: ENSP00000264728
METSASSSQPQDNSQVHRETEDVDYGETDFHKQDGKAGLFSQEQYERNKSSSSSSSSSSSSSSSSSSSSSESNDEDQQPRATGKHRRSLGAGYPHGNGSPGPGHGEPDVLKDELQLYGDAPGEVVPSGESGLRRRGSDPASGEVEASQLRRLNIKKDDEFFHFVLLCFAIGALLVCYHYYADWFMSLGVGLLTFASLETVGIYFGLVYRIHSVLQGFIPLFQKFRLTGFRKTD

SEQ ID NO: 91740 - protein, 233 aa, Homo sapiens; identical to SEQ ID NO: 91739
  Payload ID: 18368
  Gene Name: transmembrane protein 40
  Uniprot ID: Q8WWA1
  ENSP ID: ENSP00000322837

SEQ ID NO: 91741 - protein, 97 aa, Homo sapiens
  Payload ID: 18368
  Gene Name: transmembrane protein 40
  ENSP ID: ENSP00000392140
LHPGPGHGEPDVLKDELQLYGDEFFHFVLLCFAIGALLVCYHYYADWFMSLGVGLLTFASLETVGIYFGLVYRIHSVLQGFIPLFQKFRLTGFRKTD

SEQ ID NO: 91742 - protein, 157 aa, Homo sapiens
  Payload ID: 18368
  Gene Name: transmembrane protein 40
  Uniprot ID: Q8WWA1
  ENSP ID: ENSP00000396895
METSASSSQPQDNSQVHRETEDVDCPGHGEPDVLKDELQLYGDAPGEVVPSGESGLRRRGSDPASGEVEASQLRRLNIKKDDEFFHFVLLCFAIGALLVCYHYYADWFMSLGVGLLTFASLETVGIYFGLVYRIHSVLQGFIPLFQKFRLTGFRKTD

SEQ ID NO: 91743 - protein, 203 aa, Homo sapiens
  Payload ID: 18368
  Gene Name: transmembrane protein 40
  Uniprot ID: Q8WWA1
  ENSP ID: ENSP00000405740
METSASSSQPQDNSQVHRETEDVDYGETDFHKQDGKAGLFSQEQYERNKSSSSSSSSSSSSSSSSSSSSSGPGHGEPDVLKDELQLYGDAPGEVVPSGESGLRRRGSDPASGEVEASQLRRLNIKKDDEFFHFVLLCFAIGALLVCYHYYADWFMSLGVGLLTFASLETVGIYFGLVYRIHSVLQGFIPLFQKFRLTGFRKTD

SEQ ID NO: 91744 - protein, 92 aa, Homo sapiens
  Payload ID: 18369
  Gene Name: transmembrane protein 41A
  ENSP ID: ENSP00000296254
MRPLLGLLLVFAGCTFALYLLSTRLPRGRRLGSTEEAGGRSLWFPSDLAELRELSEVLREYRKEHQAYVFLLFCGAYLYKQGFAIPGSSFLV

SEQ ID NO: 91745 - protein, 99 aa, Homo sapiens
  Payload ID: 18369
  Gene Name: transmembrane protein 41A
  ENSP ID: ENSP00000371662
MRPLLGLLLVFAGCTFALYLLSTRLPRGRRLGSTEEAGGRSLWFPSDLAELRELSEVLREYRKEHQAYVFLLFCGAYLYKQGFAIPGSSFLGTYDGGPA

SEQ ID NO: 91746 - protein, 264 aa, Homo sapiens
  Payload ID: 18369
  Gene Name: transmembrane protein 41A
  Uniprot ID: Q96HV5
  ENSP ID: ENSP00000406885
MRPLLGLLLVFAGCTFALYLLSTRLPRGRRLGSTEEAGGRSLWFPSDLAELRELSEVLREYRKEHQAYVFLLFCGAYLYKQGFAIPGSSFLNVLAGALFGPWLGLLLCCVLTSVGATCCYLLSSIFGKQLVVSYFPDKVALLQRKVEENRNSLFFFLLFLRLFPMTPNWFLNLSAPILNIPIVQFFFSVLIGLIPYNFICVQTGSILSTLTSLDALFSWDTVFKLLAIAMVALIPGTLIKKFSQKHLQLNETSTANHIHSRKDT

SEQ ID NO: 91747 - protein, 291 aa, Homo sapiens
  Payload ID: 18370
  Gene Name: transmembrane protein 41B
  Uniprot ID: Q5BJD5
  ENSP ID: ENSP00000299596
MAKGRVAERSQLGAHHTTPVGDGAAGTRGLAAPGSRDHQKEKSWVEAGSARMSLLILVSIFLSAAFVMFLVYKNFPQLSEEERVNMKVPRDMDDAKALGKVLSKYKDTFYVQVLVAYFATYIFLQTFAIPGSIFLSILSGFLYPFPLALFLVCLCSGLGASFCYMLSYLVGRPVVYKYLTEKAVKWSQQVERHREHLINYIIFLRITPFLPNWFINITSPVINVPLKVFFIGTFLGVAPPSFVAIKAGTTLYQLTTAGEAVSWNSIFILMILAVLSILPAIFQKKLKQKFE

SEQ ID NO: 91748 - protein, 192 aa, Homo sapiens
  Payload ID: 18370
  Gene Name: transmembrane protein 41B
  Uniprot ID: Q5BJD5
  ENSP ID: ENSP00000431934
MAKGRVAERSQLGAHHTTPVGDGAAGTRGLAAPGSRDHQKEKSWVEAGSARMSLLILVSIFLSAAFVMFLVYKNFPQLSEEERVNMKVPRDMDDAKALGKVLSKYKDTFYVQVLVAYFATYIFYQLANICYSRLYISQYTLRVSLSLSTSLISCLFVFWTWCLFLLYAFLFSWETSCIQIPNRESSKMVTAG

SEQ ID NO: 91749 - protein, 291 aa, Homo sapiens; identical to SEQ ID NO: 91747
  Payload ID: 18370
  Gene Name: transmembrane protein 41B
  Uniprot ID: Q5BJD5
  ENSP ID: ENSP00000433126

SEQ ID NO: 91750 - protein, 196 aa, Homo sapiens
  Payload ID: 18370
  Gene Name: transmembrane protein 41B
  ENSP ID: ENSP00000435685
MAKGRVAERSQLGAHHTTPVGDGAAGTRGLAAPGSRDHQKEKSWVEAGSARMSLLILVSIFLSAAFVMFLVYKNFPQLSEEERVNMKVPRDMDDAKALGKVLSKYKDTFYVQVLVAYFATYIFLQTFAIPGSIFLSILSGFLYPFPLALFLVCLCSGLGASFCYMLSYLVGRPVVYKYLTEKAVKWSQQVSHLLLL

SEQ ID NO: 91751 - protein, 127 aa, Homo sapiens
  Payload ID: 18370
  Gene Name: transmembrane protein 41B
  Uniprot ID: Q5BJD5
  ENSP ID: ENSP00000436480
MAKGRVAERSQLGAHHTTPVGDGAAGTRGLAAPGSRDHQKEKSWVEAGSARMSLLILVSIFLSAAFVMFLVYKNFPQLSEEERVNMKVPRDMDDAKALGKVLSKYKDTFYVQVLVAYFATYILYPFN

SEQ ID NO: 91752 - protein, 291 aa, Homo sapiens; identical to SEQ ID NO: 91747
  Payload ID: 18370
  Gene Name: transmembrane protein 41B
  Uniprot ID: Q5BJD5
  ENSP ID: ENSP00000480141

SEQ ID NO: 91753 - protein, 159 aa, Homo sapiens
  Payload ID: 18371
  Gene Name: transmembrane protein 42
  Uniprot ID: Q69YG0
  ENSP ID: ENSP00000306564
MAERPGPPGGAVSATAYPDTPAEFPPHLQAGAMRRRFWGVFNCLCAGAFGALAAASAKLAFGSEVSMGLCVLGIIVMASTNSLMWTFFSRGLSFSMSSAIASVTVTFSNILSSAFLGYVLYGECQEVLWWGGVFLILCGLTLIHRKLPPTWKPLPHKQQ

SEQ ID NO: 91754 - protein, 159 aa, Homo sapiens; identical to SEQ ID NO: 91753
  Payload ID: 18371
  Gene Name: Transmembrane protein 42
  ENSP ID: ENSP00000486141

SEQ ID NO: 91755 - protein, 400 aa, Homo sapiens
  Payload ID: 18372
  Gene Name: transmembrane protein 43
  Uniprot ID: Q9BTV4
  ENSP ID: ENSP00000303992
MAANYSSTSTRREHVKVKTSSQPGFLERLSETSGGMFVGLMAFLLSFYLIFTNEGRALKTATSLAEGLSLVVSPDSIHSVAPENEGRLVHIIGALRTSKLLSDPNYGVHLPAVKLRRHVEMYQWVETEESREYTEDGQVKKETRYSYNTEWRSEIINSKNFDREIGHKNPSAMAVESFMATAPFVQIGRFFLSSGLIDKVDNFKSLSLSKLEDPHVDIIRRGDFFYHSENPKYPEVGDLRVSFSYAGLSGDDPDLGPAHVVTVIARQRGDQLVPFSTKSGDTLLLLHHGDFSAEEVFHRELRSNSMKTWGLRAAGWMAMFMGLNLMTRILYTLVDWFPVFRDLVNIGLKAFAFCVATSLTLLTVAAGWLFYRPLWALLIAGLALVPILVARTRVPAKKLE

SEQ ID NO: 91756 - protein, 66 aa, Homo sapiens
  Payload ID: 18372
  Gene Name: transmembrane protein 43
  ENSP ID: ENSP00000395617
MAANPKPGSCQDTHPLTNDSAHCGIVINGILLSHEKEQIPDKHHNMNELQKQCSESKKLGRKELVP

SEQ ID NO: 91757 - protein, 113 aa, Homo sapiens
  Payload ID: 18373
  Gene Name: transmembrane protein 44
  ENSP ID: ENSP00000328300
MFILFPVCGSKFKSNSDREARERKRRRQLRASVFALALPLSLGPCWALWVAVPKASATIRGPQRRLLASLLQENTEILGYLLGSVAAFGSWASRIPPLSRIVRPGVGMGLWVT

SEQ ID NO: 91758 - protein, 428 aa, Homo sapiens
  Payload ID: 18373
  Gene Name: transmembrane protein 44
  Uniprot ID: Q2T9K0
  ENSP ID: ENSP00000333355
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRICRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEWDPEDVNLEGSKENVELLGSQVHQDSVRTAHLSDDD

SEQ ID NO: 91759 - protein, 396 aa, Homo sapiens
  Payload ID: 18373
  Gene Name: transmembrane protein 44
  Uniprot ID: Q2T9K0
  ENSP ID: ENSP00000371402
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRICRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAAVPPGCQVTGRRAPEMRPCRTPRRTLPFRSSGPGCLPAAPLRSPPSTPTWSGTLKM

SEQ ID NO: 91760 - protein, 475 aa, Homo sapiens
  Payload ID: 18373
  Gene Name: transmembrane protein 44
  Uniprot ID: Q2T9K0
  ENSP ID: ENSP00000376227
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRIAPPPTLGITTQHEIWRGQMSKPSQSPSRSPSGHWRAAAQRQVLGTEMCRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEWDPEDVNLEGSKENVELLGSQVHQDSVRTAHLSDDD

SEQ ID NO: 91761 - protein, 121 aa, Homo sapiens
  Payload ID: 18373
  Gene Name: transmembrane protein 44
  ENSP ID: ENSP00000390186
MGEAPSPAPALWDWDYLDRCFARHRVCISFGLWICASSCWIAAHALLLYLRCAQKPRQDQSALCAACCLLTSLCDTVGALLARQLTIQSVDPNSSLIQIGKPERGRGGGSSGPVCLPWPCR

SEQ ID NO: 91762 - protein, 119 aa, Homo sapiens
  Payload ID: 18373
  Gene Name: transmembrane protein 44
  ENSP ID: ENSP00000403053
MKSKMRQALGFAKEARESPDTQALLTCAEKEEENQENLDWVPLTTLSHCKSLRTMTAISRYMELTIEPVQQAAVPPGCQVTGRRAPEMRPCRTPRRTLPFRSSGPGCLPAAPLSGTLKM

SEQ ID NO: 91763 - protein, 197 aa, Homo sapiens
  Payload ID: 18373
  Gene Name: transmembrane protein 44
  ENSP ID: ENSP00000409963
LRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEQKYWEALNSEQWDPEDVNLEGSKENVELLGSQVHQDSVRTAHLSDDD

SEQ ID NO: 91764 - protein, 150 aa, Homo sapiens
  Payload ID: 18373
  Gene Name: transmembrane protein 44
  ENSP ID: ENSP00000414077
MFILFPVCGSKFKSNSDREARERKRRRQLRASVFALALPLSLGPCWALWVAVPKASATIRGPQRRLLASLLQENTEILGYLLGSVAAFGSWASRIPPLSRIMESRCVAQAGVQWRDLGSLQPSPPNFKQFSCLSLPSSWDYSCQWSCRSC

SEQ ID NO: 91765 - protein, 261 aa, Homo sapiens
  Payload ID: 18373
  Gene Name: transmembrane protein 44
  ENSP ID: ENSP00000414333
NFMFILFPVCGSKFKSNSDREARERKRRRQLRASVFALALPLSLGPCWALWVAVPKASATIRGPQRRLLASLLQENTEILGYLLGSVAAFGSWASRIPPLSRISKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEWDPEDVNLEGSKENVELLGSQVHQDSVRTAHLSDDD

SEQ ID NO: 91766 - protein, 438 aa, Homo sapiens
  Payload ID: 18373
  Gene Name: transmembrane protein 44
  Uniprot ID: Q2T9K0
  ENSP ID: ENSP00000418674
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRICRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEKYWEALNSEQWDPEDVNLEGSKENVELLGSQVHQDSVRTAHLSDDD

SEQ ID NO: 91767 - protein, 275 aa, Homo sapiens
  Payload ID: 18374
  Gene Name: transmembrane protein 45A
  Uniprot ID: Q9NWC5
  ENSP ID: ENSP00000319009
MGNFRGHALPGTFFFIIGLWWCTKSILKYICKKQKRTCYLGSKTLFYRLEILEGITIVGMALTGMAGEQFIPGGPHLMLYDYKQGHWNQLLGWHHFTMYFFFGLLGVADILCFTISSLPVSLTKLMLSNALFVEAFIFYNHTHGREMLDIFVHQLLVLVVFLTGLVAFLEFLVRNNVLLELLRSSLILLQGSWFFQIGFVLYPPSGGPAWDLMDHENILFLTICFCWHYAVTIVIVGMNYAFITWLVKSRLKRLCSSEVGLLKNAEREQESEEEM

SEQ ID NO: 91768 - protein, 291 aa, Homo sapiens
  Payload ID: 18374
  Gene Name: transmembrane protein 45A
  ENSP ID: ENSP00000385089
MTNDSEGKMGFKHPKIMGNFRGHALPGTFFFIIGLWWCTKSILKYICKKQKRTCYLGSKTLFYRLEILEGITIVGMALTGMAGEQFIPGGPHLMLYDYKQGHWNQLLGWHHFTMYFFFGLLGVADILCFTISSLPVSLTKLMLSNALFVEAFIFYNHTHGREMLDIFVHQLLVLVVFLTGLVAFLEFLVRNNVLLELLRSSLILLQGSWFFQIGFVLYPPSGGPAWDLMDHENILFLTICFCWHYAVTIVIVGMNYAFITWLVKSRLKRLCSSEVGLLKNAEREQESEEEM

SEQ ID NO: 91769 - protein, 191 aa, Homo sapiens
  Payload ID: 18374
  Gene Name: transmembrane protein 45A
  ENSP ID: ENSP00000405597
MTNDSEGKMGFKHPKIMGNFRGHALPGTFFFIIGLWWCTKSILKYICKKQKRTCYLGSKTLFYRLEILEGITIVGMALTGMAGEQFIPGGPHLMLYDYKQGHWNQLLGWHHFTMYFFFGLLGVADILCFTISSLPVSLTKLMLSNALFVEAFIFYNHTHGREMLDIFVHQLLVLVVFLTGLVAFLEFLVRN

SEQ ID NO: 91770 - protein, 275 aa, Homo sapiens
  Payload ID: 18375
  Gene Name: transmembrane protein 45B
  Uniprot ID: Q96B21
  ENSP ID: ENSP00000281441
MANFKGHALPGSFFLIIGLCWSVKYPLKYFSHTRKNSPLHYYQRLEIVEAAIRTLFSVTGILAEQFVPDGPHLHLYHENHWIKLMNWQHSTMYLFFAVSGIVDMLTYLVSHVPLGVDRLVMAVAVFMEGFLFYYHVHNRPPLDQHIHSLLLYALFGGCVSISLEVIFRDHIVLELFRTSLIILQGTWFWQIGFVLFPPFGTPEWDQKDDANLMFITMCFCWHYLAALSIVAVNYSLVYCLLTRMKRHGRGEIIGIQKLNSDDTYQTALLSGSDEE

SEQ ID NO: 91771 - protein, 275 aa, Homo sapiens; identical to SEQ ID NO: 91770
  Payload ID: 18375
  Gene Name: transmembrane protein 45B
  Uniprot ID: Q96B21
  ENSP ID: ENSP00000436293

SEQ ID NO: 91772 - protein, 181 aa, Homo sapiens
  Payload ID: 18376
  Gene Name: transmembrane protein 47
  Uniprot ID: Q9BQJ4
  ENSP ID: ENSP00000275954
MASAGSGMEEVRVSVLTPLKLVGLVCIFLALCLDLGAVLSPAWVTADHQYYLSLWESCRKPASLDIWHCESTLSSDWQIATLALLLGGAAIILIAFLVGLISICVGSRRRFYRPVAVMLFAAVVLQVCSLVLYPIKFIETVSLKIYHEFNWGYGLAWGATIFSFGGAILYCLNPKNYEDYY

SEQ ID NO: 91773 - protein, 443 aa, Homo sapiens
  Payload ID: 18377
  Gene Name: transmembrane protein 5
  Uniprot ID: Q9Y2B1
  ENSP ID: ENSP00000261234
MRLTRKRLCSFLIALYCLFSLYAAYHVFFGRRRQAPAGSPRGLRKGAAPARERRGREQSTLESEEWNPWEGDEKNEQQHRFKTSLQILDKSTKGKTDLSVQIWGKAAIGLYLWEHIFEGLLDPSDVTAQWREGKSIVGRTQYSFITGPAVIPGYFSVDVNNVVLILNGREKAKIFYATQWLLYAQNLVQIQKLQHLAVVLLGNEHCDNEWINPFLKRNGGFVELLFIIYDSPWINDVDVFQWPLGVATYRNFPVVEASWSMLHDERPYLCNFLGTIYENSSRQALMNILKKDGNDKLCWVSAREHWQPQETNESLKNYQDALLQSDLTLCPVGVNTECYRIYEACSYGSIPVVEDVMTAGNCGNTSVHHGAPLQLLKSMGAPFIFIKNWKELPAVLEKEKTIILQEKIERRKMLLQWYQHFKTELKMKFTNILESSFLMNNKS

SEQ ID NO: 91774 - protein, 183 aa, Homo sapiens
  Payload ID: 18377
  Gene Name: transmembrane protein 5
  ENSP ID: ENSP00000440280
MLHDERPYLCNFLGTIYENSSRQALMNILKKDGNDKLCWVSAREHWQPQETNESLKNYQDALLQSDLTLCPVGVNTECYRIYEACSYGSIPVVEDVMTAGNCGNTSVHHGAPLQLLKSMGAPFIFIKNWKELPAVLEKEKTIILQEKIERRKMLLQWYQHFKTELKMKFTNILESSFLMNNKS

SEQ ID NO: 91775 - protein, 120 aa, Homo sapiens
  Payload ID: 18377
  Gene Name: transmembrane protein 5
  ENSP ID: ENSP00000440845
MRLTRKRLCSFLIALYCLFSLYAAYHVFFGRRRQAPAGSPRGLRKGAAPARERRGREQSTLESEEWNPWEGDEKNEQQHRFKTSLQILDKSTKGKTDLSVQIWGKAAIVQAGSVSAHKTF

SEQ ID NO: 91776 - protein, 157 aa, Homo sapiens
  Payload ID: 18378
  Gene Name: transmembrane protein 50A
  Uniprot ID: O95807
  ENSP ID: ENSP00000363478
MSGFLEGLRCSECIDWGEKRNTIASIAAGVLFFTGWWIIIDAAVIYPTMKDFNHSYHACGVIATIAFLMINAVSNGQVRGDSYSEGCLGQTGARIWLFVGFMLAFGSLIASMWILFGGYVAKEKDIVYPGIAVFFQNAFIFFGGLVFKFGRTEDLWQ

SEQ ID NO: 91777 - protein, 81 aa, Homo sapiens
  Payload ID: 18379
  Gene Name: transmembrane protein 50B
  ENSP ID: ENSP00000387622
MAGFLDNFRWPECECIDWSERRNAVASVVAGILFFTGWWIMIDAAVVYPKPEQLNHAFHTCGVFSTLAFFMINAVSNAQVR

SEQ ID NO: 91778 - protein, 158 aa, Homo sapiens
  Payload ID: 18379
  Gene Name: transmembrane protein 50B
  Uniprot ID: P56557
  ENSP ID: ENSP00000397773
MAGFLDNFRWPECECIDWSERRNAVASVVAGILFFTGWWIMIDAAVVYPKPEQLNHAFHTCGVFSTLAFFMINAVSNAQVRGDSYESGCLGRTGARVWLFIGFMLMFGSLIASMWILFGAYVTQNTDVYPGLAVFFQNALIFFSTLIYKFGRTEELWT

SEQ ID NO: 91779 - protein, 44 aa, Homo sapiens
  Payload ID: 18379
  Gene Name: transmembrane protein 50B
  ENSP ID: ENSP00000398859
MAGFLDNFRWPECECIDWSERRNAVASVVAGILVLEFGFSLVSC

SEQ ID NO: 91780 - protein, 151 aa, Homo sapiens
  Payload ID: 18379
  Gene Name: transmembrane protein 50B
  ENSP ID: ENSP00000409942
MAGFLDNFRWPECECIDWSERRNAVASVVAGILFFTGWWIMIDAAVVYPKPEQLNHAFHTCGVFSTLAFFMINAVSNAQVRGDSYESGCLGRTGARVWLFIGFMLMFGSLIASMWILFGAYVTQMLAIGGKGASYCFLSSFDVARTSNYFD

SEQ ID NO: 91781 - protein, 158 aa, Homo sapiens; identical to SEQ ID NO: 91778
  Payload ID: 18379
  Gene Name: transmembrane protein 50B
  Uniprot ID: P56557
  ENSP ID: ENSP00000439768

SEQ ID NO: 91782 - protein, 158 aa, Homo sapiens; identical to SEQ ID NO: 91778
  Payload ID: 18379
  Gene Name: transmembrane protein 50B
  Uniprot ID: P56557
  ENSP ID: ENSP00000458900

SEQ ID NO: 91783 - protein, 81 aa, Homo sapiens; identical to SEQ ID NO: 91777
  Payload ID: 18379
  Gene Name: transmembrane protein 50B
  ENSP ID: ENSP00000459785

SEQ ID NO: 91784 - protein, 158 aa, Homo sapiens; identical to SEQ ID NO: 91778
  Payload ID: 18379
  Gene Name: transmembrane protein 50B
  Uniprot ID: P56557
  ENSP ID: ENSP00000460121

SEQ ID NO: 91785 - protein, 151 aa, Homo sapiens; identical to SEQ ID NO: 91780
  Payload ID: 18379
  Gene Name: transmembrane protein 50B
  ENSP ID: ENSP00000461292

SEQ ID NO: 91786 - protein, 44 aa, Homo sapiens; identical to SEQ ID NO: 91779
  Payload ID: 18379
  Gene Name: transmembrane protein 50B
  ENSP ID: ENSP00000461339

SEQ ID NO: 91787 - protein, 253 aa, Homo sapiens
  Payload ID: 18380
  Gene Name: transmembrane protein 51
  Uniprot ID: Q9NW97
  ENSP ID: ENSP00000365176
MMAQSKANGSHYALTAIGLGMLVLGVIMAMWNLVPGFSAAEKPTAQGSNKTEVGGGILKSKTFSVAYVLVGAGVMLLLLSICLSIRDKRKQRQGEDLAHVQHPTGAGPHAQEEDSQEEEEEDEEAASRYYVPSYEEVMNTNYSEARGEEQNPRLSISLPSYESLTGLDETTPTSTRADVEASPGNPPDRQNSKLAKRLKPLKVRRIKSEKLHLKDFRINLPDKNVPPPSIEPLTPPPQYDEVQEKAPDTRPPD

SEQ ID NO: 91788 - protein, 253 aa, Homo sapiens; identical to SEQ ID NO: 91787
  Payload ID: 18380
  Gene Name: transmembrane protein 51
  Uniprot ID: Q9NW97
  ENSP ID: ENSP00000365182

SEQ ID NO: 91789 - protein, 253 aa, Homo sapiens; identical to SEQ ID NO: 91787
  Payload ID: 18380
  Gene Name: transmembrane protein 51
  Uniprot ID: Q9NW97
  ENSP ID: ENSP00000383600

SEQ ID NO: 91790 - protein, 253 aa, Homo sapiens; identical to SEQ ID NO: 91787
  Payload ID: 18380
  Gene Name: transmembrane protein 51
  Uniprot ID: Q9NW97
  ENSP ID: ENSP00000394899

SEQ ID NO: 91791 - protein, 135 aa, Homo sapiens
  Payload ID: 18380
  Gene Name: transmembrane protein 51
  ENSP ID: ENSP00000409665
MMAQSKANGSHYALTAIGLGMLVLGVIMAMWNLVPGFSAAEKPTAQGSNKTEVGGGILKSKTFSVAYVLVGAGVMLLLLSICLSIRDKRKQRQGEDLAHVQHPTGAGPHAQEEDRRKKRRMRRLPQGTMFPATRK

SEQ ID NO: 91792 - protein, 121 aa, Homo sapiens
  Payload ID: 18380
  Gene Name: transmembrane protein 51
  ENSP ID: ENSP00000412298
MMAQSKANGSHYALTAIGLGMLVLGVIMAMWNLVPGFSAAEKPTAQGSNKTEVGGGILKSKTFSVAYVLVGAGVMLLLLSICLSIRDKRKQRQGEDLAHVQHPTGAGPHAQEEDSQEEEEE

SEQ ID NO: 91793 - protein, 209 aa, Homo sapiens
  Payload ID: 18381
  Gene Name: transmembrane protein 52
  Uniprot ID: Q8NDY8
  ENSP ID: ENSP00000311122
MARGPLAARGLRLLLPLLPLLPLLPLPQVALGFADGSCDPSDQCPPQARWSSLWHVGLILLAVLLLLLCGVTAGCVRFCCLRKQAQAQPHLPPARQPCDVAVIPMDSDSPVHSTVTSYSSVQYPLGMRLPLPFGELDLDSMAPPAYSLYTPEPPPSYDEAVKMAKPREEGPALSQKPSPLLGASGLETTPVPQESGPNTQLPPCSPGAP

SEQ ID NO: 91794 - protein, 124 aa, Homo sapiens
  Payload ID: 18381
  Gene Name: transmembrane protein 52
  ENSP ID: ENSP00000367861
GGRWPPADCGCCCRSCRSCRSCRCRRWVGRRSLSVRPPRGGSLLGPRPSRAHPCPHRWRWASRTAAATPRTSARPRPAGAACGTWACTPRSLHPPTMKLSRWPSPERKDQHSPRNPALSLGPRA

SEQ ID NO: 91795 - protein, 194 aa, Homo sapiens
  Payload ID: 18381
  Gene Name: transmembrane protein 52
  Uniprot ID: Q8NDY8
  ENSP ID: ENSP00000367865
MERHCLLFILLTCLRWLCHDIPQGAGARWPRVSPVVEPCSPRLILLAVLLLLLCGVTAGCVRFCCLRKQAQAQPHLPPARQPCDVAVIPMDSDSPVHSTVTSYSSVQYPLGMRLPLPFGELDLDSMAPPAYSLYTPEPPPSYDEAVKMAKPREEGPALSQKPSPLLGASGLETTPVPQESGPNTQLPPCSPGAP

SEQ ID NO: 91796 - protein, 103 aa, Homo sapiens
  Payload ID: 18381
  Gene Name: transmembrane protein 52
  ENSP ID: ENSP00000409669
MARGPLAARGLRLLLPLLPLLPLLPLPQVGRAAFSLGSATAGRVPARTTPLPGSPLSPQVALGFADGSCDPSDQCPPQARWSSLWHVGLILLAVLLLLLCGVT

SEQ ID NO: 91797 - protein, 43 aa, Homo sapiens
  Payload ID: 18381
  Gene Name: transmembrane protein 52
  ENSP ID: ENSP00000473350
MARGPLAARGLRLLLPLLPLLPLLPLPQVALGFADGSCDPSDQ

SEQ ID NO: 91798 - protein, 163 aa, Homo sapiens
  Payload ID: 18382
  Gene Name: transmembrane protein 52B
  Uniprot ID: Q4KMG9
  ENSP ID: ENSP00000298530
MSWRPQPCCISSCCLTTDWVHLWYIWLLVVIGALLLLCGLTSLCFRCCCLSRQQNGEDGGPPPCEVTVIAFDHDSTLQSTITSLQSVFGPAARRILAVAHSHSSLGQLPSSLDTLPGYEEALHMSRFTVAMCGQKAPDLPPVPEEKQLPPTEKESTRIVDSWN

SEQ ID NO: 91799 - protein, 183 aa, Homo sapiens
  Payload ID: 18382
  Gene Name: transmembrane protein 52B
  Uniprot ID: Q4KMG9
  ENSP ID: ENSP00000371348
MGVRVHVVAASALLYFILLSGTRCEENCGNPEHCLTTDWVHLWYIWLLVVIGALLLLCGLTSLCFRCCCLSRQQNGEDGGPPPCEVTVIAFDHDSTLQSTITSLQSVFGPAARRILAVAHSHSSLGQLPSSLDTLPGYEEALHMSRFTVAMCGQKAPDLPPVPEEKQLPPTEKESTRIVDSWN

SEQ ID NO: 91800 - protein, 90 aa, Homo sapiens
  Payload ID: 18382
  Gene Name: transmembrane protein 52B
  ENSP ID: ENSP00000445582
MGVRVHVVAASALLYFILLSGTRCEENCGNPEHCLTTDWVHLWYIWLLVVIGALLLLCGLTSLCFRCCCLSRQQNGEDGGPPPCEVTVIA

SEQ ID NO: 91801 - protein, 247 aa, Homo sapiens
  Payload ID: 18383
  Gene Name: transmembrane protein 53
  ENSP ID: ENSP00000361309
MASAELDYTIEIPDQPCWSQKNSPSPGGKEAETRQPVVILLGWGGCKDKNLAKYSAIYHKRKLLELLFDYEIEKEPLLFHVFSNGGVMLYRYVLELLQTRRFCRLRVVGTIFDSAPGDSNLVGALRALAAILERRAAMLRLLLLVAFALVVVLFHVLLAPITALFHTHFYDRLQDAGSRWPELYLYSRADEVVLARDIERMVEARLARRVLARSVDFVSSAHVSHLRDYPTYYTSLCVDFMRNCVRC

SEQ ID NO: 91802 - protein, 277 aa, Homo sapiens
  Payload ID: 18383
  Gene Name: transmembrane protein 53
  Uniprot ID: Q6P2H8
  ENSP ID: ENSP00000361311
MASAELDYTIEIPDQPCWSQKNSPSPGGKEAETRQPVVILLGWGGCKDKNLAKYSAIYHKRGCIVIRYTAPWHMVFFSESLGIPSLRVLAQKLLELLFDYEIEKEPLLFHVFSNGGVMLYRYVLELLQTRRFCRLRVVGTIFDSAPGDSNLVGALRALAAILERRAAMLRLLLLVAFALVVVLFHVLLAPITALFHTHFYDRLQDAGSRWPELYLYSRADEVVLARDIERMVEARLARRVLARSVDFVSSAHVSHLRDYPTYYTSLCVDFMRNCVRC

SEQ ID NO: 91803 - protein, 201 aa, Homo sapiens
  Payload ID: 18383
  Gene Name: transmembrane protein 53
  ENSP ID: ENSP00000361316
MASAELDYTIEIPDQPCWSQKNSPSPGGKEAETRQPVVILLGWGGCKDKNLAKYSAIYHKRGCIVIRYTAPWHMVFFSESLGIPSLRVLAQKLLELLFDYEIEKEPLLFHVFSNGGVMLYRYVLELLQTRRFCRLRVVGTIFDSAPGDSNLVFCMASCLLLSPLLVDGISAGTEGQLTLRPDWAAQVLTRLGCHLQCITRS

SEQ ID NO: 91804 - protein, 111 aa, Homo sapiens
  Payload ID: 18383
  Gene Name: transmembrane protein 53
  ENSP ID: ENSP00000361317
MASAELDYTIEIPDQPCWSQKNSPSPGGKEAETRQPVVILLGWGGCKDKNLAKYSAIYHKRVFCMASCLLLSPLLVDGISAGTEGQLTLRPDWAAQVLTRLGCHLQCITRS

SEQ ID NO: 91805 - protein, 78 aa, Homo sapiens
  Payload ID: 18383
  Gene Name: transmembrane protein 53
  ENSP ID: ENSP00000361318
MASAELDYTIEIPDQPCWSQSLLHGLLLAAFTIAGGWHLCWDRGATHTPARLGSTGANAAWLSPSMHHPKLRAPLRHS

SEQ ID NO: 91806 - protein, 134 aa, Homo sapiens
  Payload ID: 18383
  Gene Name: transmembrane protein 53
  ENSP ID: ENSP00000391576
MASAELDYTIEIPDQPCWSQKNSPSPGGKEAETRQPVVILLGWGGCKDKNLAKYSAIYHKRLLELLFDYEIEKEPLLFHVFSNGGVMLYRYVLELLQTRRFCRLRVVGTIFDSAPGDSNLVGALRALAAILERR

SEQ ID NO: 91807 - protein, 169 aa, Homo sapiens
  Payload ID: 18384
  Gene Name: transmembrane protein 54
  Uniprot ID: Q969K7
  ENSP ID: ENSP00000328630
MCLRLGGLSVGDFRKVLMKTGLVLVVLGHVSFITAALFHGTVLRYVGTPQDAVALQYCVVNILSVTSAIVGKALLAACTFGSSELLALAPDCPFDPTRIYSSSLCLWGIALVLCVAENVFAVRCAQLTHQLLELRPWWGKSSHHMMRENPELVEGRDLLSCTSSEPLTL

SEQ ID NO: 91808 - protein, 222 aa, Homo sapiens
  Payload ID: 18384
  Gene Name: transmembrane protein 54
  Uniprot ID: Q969K7
  ENSP ID: ENSP00000362562
MCLRLGGLSVGDFRKVLMKTGLVLVVLGHVSFITAALFHGTVLRYVGTPQDAVALQYCVVNILSVTSAIVVITSGIAAIVLSRYLPSTPLRWTVFSSSVACALLSLTCALGLLASIAMTFATQGKALLAACTFGSSELLALAPDCPFDPTRIYSSSLCLWGIALVLCVAENVFAVRCAQLTHQLLELRPWWGKSSHHMMRENPELVEGRDLLSCTSSEPLTL

SEQ ID NO: 91809 - protein, 257 aa, Homo sapiens
  Payload ID: 18385
  Gene Name: transmembrane protein 55A
  Uniprot ID: Q8N4L2
  ENSP ID: ENSP00000285419
MAADGVDERSPLLSASHSGNVTPTAPPYLQESSPRAELPPPYTAIASPDASGIPVINCRVCQSLINLDGKLHQHVVKCTVCNEATPIKNPPTGKKYVRCPCNCLLICKDTSRRIGCPRPNCRRIINLGPVMLISEEQPAQPALPIQPEGTRVVCGHCGNTFLWMELRFNTLAKCPHCKKISSVGSALPRRRCCAYITIGMICIFIGVGLTVGTPDFARRFRATYVSWAIAYLLGLICLIRACYWGAIRVSYPEHSFA

SEQ ID NO: 91810 - protein, 250 aa, Homo sapiens
  Payload ID: 18385
  Gene Name: transmembrane protein 55A
  ENSP ID: ENSP00000427974
MAADGVDERSPLLSASHSGNVTPTAPPYLQESSPRVTNIFSAELPPPYTAIASPDASGIPVINCRVCQSLINLDGKLHQHVVKCTVCNEATPIKNPPTGKKYVRCPCNCLLICKDTSRRIGCPRPNCRRIINLGPVMLISEEQPAQPALPIQPEGTRVVCGHCGNTFLWMELRFNTLAKCPHCKKISSVGSALPRRRCCAYITIGMICIFIGVGLTVGTPDFARRFRATYVSWAIAYLLGLICLIRACYW

SEQ ID NO: 91811 - protein, 56 aa, Homo sapiens
  Payload ID: 18385
  Gene Name: transmembrane protein 55A
  ENSP ID: ENSP00000429112
MAADGVDERSPLLSASHSGNVTPTAPPYLQESSPRGLLTVESPELQVPYKRRWSYK

SEQ ID NO: 91812 - protein, 166 aa, Homo sapiens
  Payload ID: 18385
  Gene Name: transmembrane protein 55A
  ENSP ID: ENSP00000429280
MAADGVDERSPLLSASHSGNVTPTAPPYLQESSPRAELPPPYTAIASPDASGIPVINCRVCQSLINLDGKLHQHVVKCTVCNEATPIKNPPTGKKYVRCPCNCLLICKDTSRRIGCPRPNCRRIINLGPVMLISEEQPAQPALPIQPEGTRVVCGHCGNTFLLLSG

SEQ ID NO: 91813 - protein, 57 aa, Homo sapiens
  Payload ID: 18385
  Gene Name: transmembrane protein 55A
  ENSP ID: ENSP00000430707
MAADGVDERSPLLSASHSGNVTPTAPPYLQESSPRVDGTEVQHSGKMPTLQKNLLSG

SEQ ID NO: 91814 - protein, 56 aa, Homo sapiens; identical to SEQ ID NO: 91811
  Payload ID: 18385
  Gene Name: transmembrane protein 55A
  ENSP ID: ENSP00000486788

SEQ ID NO: 91815 - protein, 277 aa, Homo sapiens
  Payload ID: 18386
  Gene Name: transmembrane protein 55B
  Uniprot ID: Q86T03
  ENSP ID: ENSP00000250489
MAADGERSPLLSEPIDGGAGGNGLVGPGGSGAGPGGGLTPSAPPYGAAFPPFPEGHPAVLPGEDPPPYSPLTSPDSGSAPMITCRVCQSLINVEGKMHQHVVKCGVCNEATPIKNAPPGKKYVRCPCNCLLICKVTSQRIACPRPYCKRIINLGPVHPGPLSPEPQPMGVRVICGHCKNTFLWTEFTDRTLARCPHCRKVSSIGRRYPRKRCICCFLLGLLLAVTATGLAFGTWKHARRYGGIYAAWAFVILLAVLCLGRALYWACMKVSHPVQNFS

SEQ ID NO: 91816 - protein, 284 aa, Homo sapiens
  Payload ID: 18386
  Gene Name: transmembrane protein 55B
  Uniprot ID: Q86T03
  ENSP ID: ENSP00000381102
MAADGERSPLLSEPIDGGAGGNGLVGPGGSGAGPGGGLTPSAPPYGAGKHAPPQAFPPFPEGHPAVLPGEDPPPYSPLTSPDSGSAPMITCRVCQSLINVEGKMHQHVVKCGVCNEATPIKNAPPGKKYVRCPCNCLLICKVTSQRIACPRPYCKRIINLGPVHPGPLSPEPQPMGVRVICGHCKNTFLWTEFTDRTLARCPHCRKVSSIGRRYPRKRCICCFLLGLLLAVTATGLAFGTWKHARRYGGIYAAWAFVILLAVLCLGRALYWACMKVSHPVQNFS

SEQ ID NO: 91817 - protein, 112 aa, Homo sapiens
  Payload ID: 18386
  Gene Name: transmembrane protein 55B
  ENSP ID: ENSP00000451014
  MOD_RES (1)..(1): Any amino acid
XSPEPQPMGVRVICGHCKNTFLWTEFTDRTLARCPHCRKVSSIGRRYPRKRCICCFLLGLLLAVTATGLAFGTWKHARRYGGIYAAWAFVILLAVLCLGRALYWACMKGCCV

SEQ ID NO: 91818 - protein, 43 aa, Homo sapiens
  Payload ID: 18386
  Gene Name: transmembrane protein 55B
  ENSP ID: ENSP00000452508
MITCRVCQSLINVEGKMHQHVVKCGVCNEATPIKNAPPGKKYV

SEQ ID NO: 91819 - protein, 263 aa, Homo sapiens
  Payload ID: 18387
  Gene Name: transmembrane protein 56
  Uniprot ID: Q96MV1
  ENSP ID: ENSP00000359222
MEINTKLLISVTCISFFTFQLLFYFVSYWFSAKVSPGFNSLSFKKKIEWNSRVVSTCHSLVVGIFGLYIFLFDEATKADPLWGGPSLANVNIAIASGYLISDLSIIILYWKVIGDKFFIMHHCASLYAYYLVLKNGVLAYIGNFRLLAELSSPFVNQRWFFEALKYPKFSKAIVINGILMTVVFFIVRIASMLPHYGFMYSVYGTEPYIRLGVLIQLSWVISCVVLDVMNVMWMIKISKGCIKVISHIRQEKAKNSLQNGKLD

SEQ ID NO: 91820 - protein, 154 aa, Homo sapiens
  Payload ID: 18387
  Gene Name: transmembrane protein 56
  ENSP ID: ENSP00000395364
MEINTKLLISVTCISFFTFQLLFYFVSYWFSAKVSPGFNSLSFKKKIEWNSRVVSTCHSLVVGIFGLYIFLFDEATKADPLWGGPSLANVNIAIASGYLISDLSIIILYWKVIGDKFFIMHHCASLYAYYLVLKNGVLAYIGNFRLLAELSSPF

SEQ ID NO: 91821 - protein, 143 aa, Homo sapiens
  Payload ID: 18387
  Gene Name: transmembrane protein 56
  ENSP ID: ENSP00000417043
MEINTKLLISVTCISFFTFQLLFYFVSYWFSAKVSPGFNSLSFKKKIEWNSRVVSTCHSLVVGIFGLYIFLFDEATKADPLWGGPSLANVNIAIASGYLISDLSIIILYWKVIGDKFFIMHHCASLYAYYLVLKNGVLAYIGN

SEQ ID NO: 91822 - protein, 664 aa, Homo sapiens
  Payload ID: 18388
  Gene Name: transmembrane protein 57
  Uniprot ID: Q8N5G2
  ENSP ID: ENSP00000363463
MKRRNADCSKLRRPLKRNRITEGIYGSTFLYLKFLVVWALVLLADFVLEFRFEYLWPFWLFIRSVYDSFRYQGLAFSVFFVCVAFTSNIICLLFIPIQWLFFAASTYVWVQYVWHTERGVCLPTVSLWILFVYIEAAIRFKDLKNFHVDLCRPFAAHCIGYPVVTLGFGFKSYVSYKMRLRKQKEVQKENEFYMQLLQQALPPEQQMLQKQEKEAEEAAKGLPDMDSSILIHHNGGIPANKKLSTTLPEIEYREKGKEKDKDAKKHNLGINNNNILQPVDSKIQEIEYMENHINSKRLNNDLVGSTENLLKEDSCTASSKNYKNASGVVNSSPRSHSATNGSIPSSSSKNEKKQKCTSKSPSTHKDLMENCIPNNQLSKPDALVRLEQDIKKLKADLQASRQVEQELRSQISSLSSTERGIRSEMGQLRQENELLQNKLHNAVQMKQKDKQNISQLEKKLKAEQEARSFVEKQLMEEKKRKKLEEATAARAVAFAAASRGECTETLRNRIRELEAEGKKLTMDMKVKEDQIRELELKVQELRKYKENEKDTEVLMSALSAMQDKTQHLENSLSAETRIKLDLFSALGDAKRQLEIAQGQILQKDQEIKDLKQKIAEVMAVMPSITYSAATSPLSPVSPHYSSKFVETSPSGLDPNASVYQPLKK

SEQ ID NO: 91823 - protein, 437 aa, Homo sapiens
  Payload ID: 18388
  Gene Name: transmembrane protein 57
  Uniprot ID: Q8N5G2
  ENSP ID: ENSP00000382668
MKRRNADCSKLRRPLKRNRITEGIYGSTFLYLKFLVVWALVLLADFVLEFRFEYLWPFWLFIRSVYDSFRYQGLAFSVFFVCVAFTSNIICLLFIPIQWLFFAASTYVWVQYVWHTERGVCLPTVSLWILFVYIEAAIRFKDLKNFHVDLCRPFAAHWLEQDIKKLKADLQASRQVEQELRSQISSLSSTERGIRSEMGQLRQENELLQNKLHNAVQMKQKDKQNISQLEKKLKAEQEARSFVEKQLMEEKKRKKLEEATAARAVAFAAASRGECTETLRNRIRELEAEGKKLTMDMKVKEDQIRELELKVQELRKYKENEKDTEVLMSALSAMQDKTQHLENSLSAETRIKLDLFSALGDAKRQLEIAQGQILQKDQEIKDLKQKIAEVMAVMPSITYSAATSPLSPVSPHYSSKFVETSPSGLDPNASVYQPLKK

SEQ ID NO: 91824 - protein, 323 aa, Homo sapiens
  Payload ID: 18389
  Gene Name: transmembrane protein 59
  Uniprot ID: Q9BXS4
  ENSP ID: ENSP00000234831
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEKLSIYGDLEFMNEQKLNRYPASSLVVVRSKTEDHEEAGPLPTKVNLAHSEI

SEQ ID NO: 91825 - protein, 145 aa, Homo sapiens
  Payload ID: 18389
  Gene Name: transmembrane protein 59
  ENSP ID: ENSP00000360388
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQVRNNTAFQTSLLRWH

SEQ ID NO: 91826 - protein, 192 aa, Homo sapiens
  Payload ID: 18389
  Gene Name: transmembrane protein 59
  ENSP ID: ENSP00000360392
MSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEKLSIYGDLEFMNEQKLNRYPASSLVVVRSKTEDHEEAGPLPTKVNLAHSEI

SEQ ID NO: 91827 - protein, 192 aa, Homo sapiens; identical to SEQ ID NO: 91826
  Payload ID: 18389
  Gene Name: transmembrane protein 59
  ENSP ID: ENSP00000360395

SEQ ID NO: 91828 - protein, 192 aa, Homo sapiens; identical to SEQ ID NO: 91826
  Payload ID: 18389
  Gene Name: transmembrane protein 59
  ENSP ID: ENSP00000360399

SEQ ID NO: 91829 - protein, 285 aa, Homo sapiens
  Payload ID: 18389
  Gene Name: transmembrane protein 59
  ENSP ID: ENSP00000397772
MAAPKGSLWVRTQLGLPPLLLLTMALAGGSGTASAEAFDSVLGDTASCHRACQLTYPLHTYPKVSASLYTVDHIEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEVN

SEQ ID NO: 91830 - protein, 144 aa, Homo sapiens
  Payload ID: 18389
  Gene Name: transmembrane protein 59
  ENSP ID: ENSP00000399761
MSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEVNL

SEQ ID NO: 91831 - protein, 144 aa, Homo sapiens; identical to SEQ ID NO: 91830
  Payload ID: 18389
  Gene Name: transmembrane protein 59
  ENSP ID: ENSP00000413792

SEQ ID NO: 91832 - protein, 342 aa, Homo sapiens
  Payload ID: 18390
  Gene Name: transmembrane protein 59-like
  Uniprot ID: Q9UK28
  ENSP ID: ENSP00000262817
MAAVALMPPPLLLLLLLASPPAASAPSARDPFAPQLGDTQNCQLRCRDRDLGPQPSQAGLEGASESPYDRAVLISACERGCRLFSICRFVARSSKPNATQTECEAACVEAYVKEAEQQACSHGCWSQPAEPEPEQKRKVLEAPSGALSLLDLFSTLCNDLVNSAQGFVSSTWTYYLQTDNGKVVVFQTQPIVESLGFQGGRLQRVEVTWRGSHPEALEVHVDPVGPLDKVRKAKIRVKTSSKAKVESEEPQDNDFLSCMSRRSGLPRWILACCLFLSVLVMLWLSCSTLVTAPGQHLKFQPLTLEQHKGFMMEPDWPLYPPPSHACEDSLPPYKLKLDLTKL

SEQ ID NO: 91833 - protein, 342 aa, Homo sapiens; identical to SEQ ID NO: 91832
  Payload ID: 18390
  Gene Name: transmembrane protein 59-like
  Uniprot ID: Q9UK28
  ENSP ID: ENSP00000470879

SEQ ID NO: 91834 - protein, 134 aa, Homo sapiens
  Payload ID: 18390
  Gene Name: transmembrane protein 59-like
  ENSP ID: ENSP00000471612
  MOD_RES (1)..(1): Any amino acid
XKVLEAPSGALSLLDLFSTLCNDLVNSAQGFVSSTWTYYLQTDNGKVVVFQTQPIVESLGFQGGRLQRVEVTWRGSHPEALEVHVDPVGPLDKVRKAKIRVKTSSKAKALGSASLDPGLLPLPLRAGDAVAELL

SEQ ID NO: 91835 - protein, 133 aa, Homo sapiens
  Payload ID: 18391
  Gene Name: transmembrane protein 60
  Uniprot ID: Q9H2L4
  ENSP ID: ENSP00000257663
MRMSLAQRVLLTWLFTLLFLIMLVLKLDEKAPWNWFLIFIPVWIFDTILLVLLIVKMAGRCKSGFDPRHGSHNIKKKAWYLIAMLLKLAFCLALCAKLEQFTTMNLSYVFIPLWALLAGALTELGYNVFFVRD

SEQ ID NO: 91836 - protein, 210 aa, Homo sapiens
  Payload ID: 18392
  Gene Name: transmembrane protein 61
  Uniprot ID: Q8N0U2
  ENSP ID: ENSP00000360315
MALPQMCDGSHLASTLRYCMTVSGTVVLVAGTLCFAWWSEGDATAQPGQLAPPTEYPVPEGPSPLLRSVSFVCCGAGGLLLLIGLLWSVKASIPGPPRWDPYHLSRDLYYLTVESSEKESCRTPKVVDIPTYEEAVSFPVAEGPPTPPAYPTEEALEPSGSRDALLSTQPAWPPPSYESISLALDAVSAETTPSATRSCSGLVQTARGGS

SEQ ID NO: 91837 - protein, 643 aa, Homo sapiens
  Payload ID: 18393
  Gene Name: transmembrane protein 62
  Uniprot ID: Q0P6H9
  ENSP ID: ENSP00000260403
MAAVLALRVVAGLAAAALVAMLLEHYGLAGQPSPLPRPAPPRRPHPAPGPGDSNIFWGLQISDIHLSRFRDPGRAVDLEKFCSETIDIIQPALVLATGDLTDAKTKEQLGSRQHEVEWQTYQGILKKTRVMEKTKWLDIKGNHDAFNIPSLDSIKNYYRKYSAVRRDGSFHYVHSTPFGNYSFICVDATVNPGPKRPYNFFGILDKKKMEELLLLAKESSRSNHTIWFGHFTTSTILSPSPGIRSIMSSAIAYLCGHLHTLGGLMPVLHTRHFQGTLELEVGDWKDNRRYRIFAFDHDLFSFADLIFGKWPVVLITNPKSLLYSCGEHEPLERLLHSTHIRVLAFSLSSITSVTVKIDGVHLGQAVHVSGPIFVLKWNPRNYSSGTHNIEVIVQDSAGRSKSVHHIFSVQENNHLSFDPLASFILRTDHYIMARVLFVLIVLSQLTILIIFRYRGYPELKEPSGFINLTSFSLHVLSKINIFYYSVLLLTLYTVLGPWFFGEIIDGKFGCCFSFGIFVNGHFLQGSITFIIGILQLAFFNIPLMAYMCWSLLQRCFGHNFRSHLHQRKYLKIMPVHLLMLLLYIWQVYSCYFLYATYGTLAFLFSPLRTWLTLLTPVLIRYVWTLNSTKFGIFMVQLKSHLSS

SEQ ID NO: 91838 - protein, 40 aa, Homo sapiens
  Payload ID: 18393
  Gene Name: transmembrane protein 62
  ENSP ID: ENSP00000454683
MEKTKWLDIKGNHGNILLYVEMALSIMSTVLPLATIRSSV

SEQ ID NO: 91839 - protein, 62 aa, Homo sapiens
  Payload ID: 18393
  Gene Name: transmembrane protein 62
  ENSP ID: ENSP00000455413
MAAVLALRVVAGLAAAALVAMLLEHYGLAGQPSPLPRPAPPRRPHPAPGPGDSNIFWGLQET

SEQ ID NO: 91840 - protein, 129 aa, Homo sapiens
  Payload ID: 18393
  Gene Name: transmembrane protein 62
  ENSP ID: ENSP00000455482
MEKTKWLDIKGNHDAFNIPSLDSIKNYYRKYSAVRRDGSFHYVHSTPFGNYSFICVDATVNPGPKRPYNFFGILDKKKMEELLLLAKESSRSNHTIWFGHFTTSTILSPSPGIRSIMSSAIAYLCGHLH

SEQ ID NO: 91841 - protein, 49 aa, Homo sapiens
  Payload ID: 18393
  Gene Name: transmembrane protein 62
  ENSP ID: ENSP00000456003
AAAALVAMLLEHYGLAGQPSPLPRPAPPRRPHPAPGPGDSNIFWGLQET

SEQ ID NO: 91842 - protein, 21 aa, Homo sapiens
  Payload ID: 18393
  Gene Name: transmembrane protein 62
  ENSP ID: ENSP00000456151
RRPHPAPGPGDSNIFWGLQET

SEQ ID NO: 91843 - protein, 38 aa, Homo sapiens
  Payload ID: 18393
  Gene Name: transmembrane protein 62
  ENSP ID: ENSP00000457314
MEKTKWLDIKGNHDAFNIPSLDSIKNYYRKYSAVRRDG

SEQ ID NO: 91844 - protein, 49 aa, Homo sapiens
  Payload ID: 18393
  Gene Name: transmembrane protein 62
  ENSP ID: ENSP00000457503
  MOD_RES (1)..(1): Any amino acid
XAAALVAMLLEHYGLAGQPSPLPRPAPPRRPHPAPGPGDSNIFWGLQET

SEQ ID NO: 91845 - protein, 540 aa, Homo sapiens
  Payload ID: 18393
  Gene Name: transmembrane protein 62
  ENSP ID: ENSP00000458098
  MOD_RES (1)..(1): Any amino acid
XRDPGRAVDLEKFCSETIDIIQPALVLATGDLTDAKTKEQLGSRQHEVEWQTYQGILKKTRVMEKTKWLDIKGNHDAFNIPSLDSIKNYYRKYSAVRRDGSFHYVHSTPFGNYSFICVDATVNPGPKRPYNFFGILDKKKMEELLLLAKESSRSNHTIWFGHFTTSTILSPSPGIRSIMSSAIAYLCGHLHTLGGLMPVLHTRHFQGTLELEVGDWKDNRRYRIFAFDHDLFSFADLIFGKWPVVLITNPKSLLYSCGEHEPLERLLHSTHIRVLAFSLSSITSVTVKIDGVHLGQAVHVSGPIFVLKWNPRNYSSGTHNIEVIVQDSAGRSKSVHHIFSVQENNHLSFDPLASFILRTDHYIMARVLFVLIVLSQLTILIIFRYRGYPELKGPWFFGEIIDGKFGCCFSFGIFVNGHFLQGSITFIIGILQLAFFNIPLMAYMCWSLLQRCFGHNFRSHLHQRKYLKIMPVHLLMLLLYIWQVYSCYFLYATYGTLAFLFSPLRTWLTLLTPVLIRYVWTLNSTKFGIFMVQLKSHLSS

SEQ ID NO: 91846 - protein, 807 aa, Homo sapiens
  Payload ID: 18394
  Gene Name: transmembrane protein 63A
  Uniprot ID: O94886
  ENSP ID: ENSP00000355800
MMDSPFLELWQSKAVSIREQLGLGDRPNDSYCYNSAKNSTVLQGVTFGGIPTVLLIDVSCFLFLILVFSIIRRRFWDYGRIALVSEADSESRFQRLSSTSSSGQQDFENELGCCPWLTAIFRLHDDQILEWCGEDAIHYLSFQRHIIFLLVVVSFLSLCVILPVNLSGDLLDKDPYSFGRTTIANLQTDNDLLWLHTIFAVIYLFLTVGFMRHHTQSIKYKEENLVRRTLFITGLPRDARKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTPYVPRILNGLASERTALSPQQQQQQTYGAIHNISGTIPGQCLAQSATGSVAAAPQEA

SEQ ID NO: 91847 - protein, 118 aa, Homo sapiens
  Payload ID: 18394
  Gene Name: transmembrane protein 63A
  ENSP ID: ENSP00000409002
MMDSPFLELWQSKAVSIREQLGLGDRPNDSYCYNSAKNSTVLQGVTFGGIPTVLLIDVSCFLFLILVFSIIRRRFWDYGRIALVSEADSESRFQRLSSTSSSGQQDFENELGCCPWLT

SEQ ID NO: 91848 - protein, 82 aa, Homo sapiens
  Payload ID: 18394
  Gene Name: transmembrane protein 63A
  ENSP ID: ENSP00000445237
MKDRLLERITEEERHVQDQPLGMAFVTFQEKSMATYILKDFNACKCQSLQCKGEPQPSSHSRELYTSKWTVTFAADPEDICW

SEQ ID NO: 91849 - protein, 832 aa, Homo sapiens
  Payload ID: 18395
  Gene Name: transmembrane protein 63B
  Uniprot ID: Q5T3F8
  ENSP ID: ENSP00000259746
MLPFLLATLGTTALNNSNPKDYCYSARIRSTVLQGLPFGGVPTVLALDFMCFLALLFLFSILRKVAWDYGRLALVTDADRLRRQERDRVEQEYVASAMHGDSHDRYERLTSVSSSVDFDQRDNGFCSWLTAIFRIKDDEIRDKCGGDAVHYLSFQRHIIGLLVVVGVLSVGIVLPVNFSGDLLENNAYSFGRTTIANLKSGNNLLWLHTSFAFLYLLLTVYSMRRHTSKMRYKEDDLVKRTLFINGISKYAESEKIKKHFEEAYPNCTVLEARPCYNVARLMFLDAERKKAERGKLYFTNLQSKENVPTMINPKPCGHLCCCVVRGCEQVEAIEYYTKLEQKLKEDYKREKEKVNEKPLGMAFVTFHNETITAIILKDFNVCKCQGCTCRGEPRPSSCSESLHISNWTVSYAPDPQNIYWEHLSIRGFIWWLRCLVINVVLFILLFFLTTPAIIITTMDKFNVTKPVEYLNNPIITQFFPTLLLWCFSALLPTIVYYSAFFEAHWTRSGENRTTMHKCYTFLIFMVLLLPSLGLSSLDLFFRWLFDKKFLAEAAIRFECVFLPDNGAFFVNYVIASAFIGNAMDLLRIPGLLMYMIRLCLARSAAERRNVKRHQAYEFQFGAAYAWMMCVFTVVMTYSITCPIIVPFGLMYMLLKHLVDRYNLYYAYLPAKLDKKIHSGAVNQVVAAPILCLFWLLFFSTMRTGFLAPTSMFTFVVLVITIVICLCHVCFGHFKYLSAHNYKIEHTETDTVDPRSNGRPPTAAAVPKSAKYIAQVLQDSEVDGDGDGAPGSSGDEPPSSSSQDEELLMPPDALTDTDFQSCEDSLIENEIHQ

SEQ ID NO: 91850 - protein, 832 aa, Homo sapiens; identical to SEQ ID NO: 91849
  Payload ID: 18395
  Gene Name: transmembrane protein 63B
  Uniprot ID: Q5T3F8
  ENSP ID: ENSP00000327154

SEQ ID NO: 91851 - protein, 761 aa, Homo sapiens
  Payload ID: 18395
  Gene Name: transmembrane protein 63B
  ENSP ID: ENSP00000360960
  MOD_RES (1)..(1): Any amino acid
XSILRKVAWDYGRLALVTDADSVASAMHGDSHDRYERLTSVSSSVDFDQRDNGFCSWLTAIFRIKDDEIRDKCGGDAVHYLSFQRHIIGLLVVVGVLSVGIVLPVNFSGDLLENNAYSFGRTTIANLKSGNNLLWLHTSFAFLYLLLTVYSMRRHTSKMRYKEDDLVKRTLFINGISKYAESEKIKKHFEEAYPNCTVLEARPCYNVARLMFLDAERKKAERGKLYFTNLQSKENVPTMINPKPCGHLCCCVVRGCEQVEAIEYYTKLEQKLKEDYKREKEKVNEKPLGMAFVTFHNETITAIILKDFNVCKCQGCTCRGEPRPSSCSESLHISNWTVSYAPDPQNIYWEHLSIRGFIWWLRCLVINVVLFILLFFLTTPAIIITTMDKFNVTKPVEYLNNPIITQFFPTLLLWCFSALLPTIVYYSAFFEAHWTRSGENRTTMHKCYTFLIFMVLLLPSLGLSSLDLFFRWLFDKKFLAEAAIRFECVFLPDNGAFFVNYVIASAFIGNAMDLLRIPGLLMYMIRLCLARSAAERRNVKRHQAYEFQFGAAYAWMMCVFTVVMTYSITCPIIVPFGLMYMLLKHLVDRYNLYYAYLPAKLDKKIHSGAVNQVVAAPILCLFWLLFFSTMRTGFLAPTSMFTFVVLVITIVICLCHVCFGHFKYLSAHNYKIEHTETDTVDPRSNGRPPTAAAVPKSAKYIAQVLQDSEVDGDGDGAPGSSGDEPPSSSSQDEELLMPPDALTDTDFQSCEDSLIENEIHQ

SEQ ID NO: 91852 - protein, 520 aa, Homo sapiens
  Payload ID: 18395
  Gene Name: transmembrane protein 63B
  ENSP ID: ENSP00000432085
  MOD_RES (1)..(1): Any amino acid
XNAYSFGRTTIANLKSGNNLLWLHTSFAFLYLLLTVYSMRRHTSKMRYKEDDLVKRTLFINGISKYAESEKIKKHFEEAYPNCTVLEARPCYNVARLMFLDAERKKAERGKLYFTNLQSKENVPTMINPKPCGHLCCCVVRGCEQVEAIEYYTKLEQKLKEDYKREKEKVNEKPLGMAFVTFHNETITAIILKDFNVCKCQGCTCRGEPRPSSCSESLHISNWTVSYAPDPQNIYWEHLSIRGFIWWLRCLVINVVLFILLFFLTTPAIIITTMDKFNVTKPVEYLNNPIITQFFPTLLLWCFSALLPTIVYYSAFFEAHWTRSGENRTTMHKCYTFLIFMVLLLPSLGLSSLDLFFRWLFDKKFLAEAAIRFECVFLPDNGAFFVNYVIASAFIGNAMDLLRIPGLLMYMIRLCLARSAAERRNVKRHQAYEFQFGAAYAWMMCVFTVVMTYSITCPIIVPFGLMYMLLKHLVDRYNLYYAYLPAKLDKKIHSGAVNQVVAAPILCLFWLLFFSTMRTD

SEQ ID NO: 91853 - protein, 27 aa, Homo sapiens
  Payload ID: 18395
  Gene Name: transmembrane protein 63B
  ENSP ID: ENSP00000433750
  MOD_RES (1)..(1): Any amino acid
XSVSSSVDFDQRDNGFCSWLTAIFRIK

SEQ ID NO: 91854 - protein, 226 aa, Homo sapiens
  Payload ID: 18395
  Gene Name: transmembrane protein 63B
  ENSP ID: ENSP00000437163
MLPFLLATLGTTALNNSNPKDYCYSARIRSTVLQGLPFGGVPTVLALDFMCFLALLFLFSILRKVAWDYGRLALVTDADRLRRQERDRVEQEYVASAMHGDSHDRYERLTSVSSSVDFDQRDNGFCSWLTAIFRIKDDEIRDKCGGDAVHYLSFQRHIIGLLVVVGVLSVGIVLPVNFSGDLLENNAYSFGRTTIANLKSGNNLLWLHTSFAFLYLLLTVYSMRRH

SEQ ID NO: 91855 - protein, 806 aa, Homo sapiens
  Payload ID: 18396
  Gene Name: transmembrane protein 63C
  Uniprot ID: Q9P1W3
  ENSP ID: ENSP00000298351
MSASPDDLSTGGRLQNMTVDECFQSRNTVLQGQPFGGVPTVLCLNIALWVLVLVVYSFLRKAAWDYGRLALLIHNDSLTSLIYGEQSEKTSPSETSLEMERRDKGFCSWFFNSITMKDEDLINKCGDDARIYIVFQYHLIIFVLIICIPSLGIILPINYTGSVLDWSSHFARTTIVNVSTESKLLWLHSLLSFFYFITNFMFMAHHCLGFAPRNSQKVTRTLMITYVPKDIEDPELIIKHFHEAYPGSVVTRVHFCYDVRNLIDLDDQRRHAMRGRLFYTAKAKKTGKVMIRIHPCARLCFCKCWTCFKEVDAEQYYSELEEQLTDEFNAELNRVPLKRLDLIFVTFQDSRMAKRVRKDYKYVQCGVQPQQSSVTTIVKSYYWRVTMAPHPKDIIWKHLSVRRFFWWARFIAINTFLFFLFFFLTTPAIIMNTIDMYNVTRPIEKLQNPIVTQFFPSVMLWGFTVILPLIVYFSAFLEAHWTRSSQNLVMVHKCYIFLVFMVVILPSMGLTSLDVFLRWLFDIYYLEQASIRFQCVFLPDNGAFFVNYVITAALLGTGMELLRLGSLFCYSTRLFFSRSEPERVNIRKNQAIDFQFGREYAWMMNVFSVVMAYSITCPIIVPFGLLYLCMKHLTDRYNMYYSFAPTKLNEQIHMAAVSQAIFAPLLGLFWMLFFSILRLGSLHAITIFSLSTLLIAMVIAFVGIFLGKLRMVADYEPEEEEIQTVFDMEPSSTSSTPTSLLYVATVLQEPELNLTPASSPARHTYGTMNNQPEEGEEESGLRGFARELDSAQFQEGLELEGQNQYH

SEQ ID NO: 91856 - protein, 23 aa, Homo sapiens
  Payload ID: 18396
  Gene Name: transmembrane protein 63C
  ENSP ID: ENSP00000450879
MSASPDDLSTGGRLQNMTVDECF

SEQ ID NO: 91857 - protein, 50 aa, Homo sapiens
  Payload ID: 18396
  Gene Name: transmembrane protein 63C
  ENSP ID: ENSP00000451237
MSASPDDLSTGGRLQNMTVDECFQSRNTVLQGQPFGGVPTVLCLNIALWV

SEQ ID NO: 91858 - protein, 51 aa, Homo sapiens
  Payload ID: 18396
  Gene Name: transmembrane protein 63C
  ENSP ID: ENSP00000451398
MSASPDDLSTGGRLQNMTVDECFQSRNTVLQGQPFGGVPTVLCLNIALWVL

SEQ ID NO: 91859 - protein, 36 aa, Homo sapiens
  Payload ID: 18396
  Gene Name: transmembrane protein 63C
  ENSP ID: ENSP00000451404
MSASPDDLSTGGRLQNMTVDECFQSRNTVLQGQPFG

SEQ ID NO: 91860 - protein, 164 aa, Homo sapiens
  Payload ID: 18396
  Gene Name: transmembrane protein 63C
  ENSP ID: ENSP00000451842
MSASPDDLSTGGRLQNMTVDECFQSRNTVLQGQPFGGVPTVLCLNIALWVLVLVVYSFLRKAAWDYGRLALLIHNDSLTSLIYGEQSEKTSPSETSLEMERRDKGFCSWFFNSITMKDEDLINKCGDDARIYIVFQYHLIIFVLIICIPSLGIILPINYTGSVL

SEQ ID NO: 91861 - protein, 197 aa, Homo sapiens
  Payload ID: 18397
  Gene Name: transmembrane protein 64
  ENSP ID: ENSP00000407617
LCFASLALVRRYLHHLLLWVESLDSLLGVLLFVVGFIVVSFPCGWGYIVLNVAAGYLYGFVLGMGLMMVGVLIGTFIAHVVCKRLLTAWVAARIQSSEKLSAVIRVVEGGSGLKVVALARLTPIPFGLQNAVFSIIISIGLMFYVVHRAQVELNAAIVACEMELKSSLVKGNQPNTSGSSFYNKRTLTFSGGGINVV

SEQ ID NO: 91862 - protein, 328 aa, Homo sapiens
  Payload ID: 18397
  Gene Name: transmembrane protein 64
  Uniprot ID: Q6YI46
  ENSP ID: ENSP00000411951
MRSPGGILLQALPRLLQHAALPGLAELPARWALPRGAGGDGPADRLPRGGGASAAAAAAAASGALLGAYLERHGPPEASELPEPGGALAGGPGSGGGGVVVGVAEVRNWRCCCLGSTCWCRSLVLVCVLAALCFASLALVRRYLHHLLLWVESLDSLLGVLLFVVGFIVVSFPCGWGYIVLNVAAGYLYGFVLGMGLMMVGVLIGTFIAHVVCKRLLTAWVAARIQSSEKLSAVIRVVEGGSGLKVVALARLTPIPFGLQNAVFSIIISIGLMFYVVHRAQVELNAAIVACEMELKSSLVKGNQPNTSGSSFYNKRTLTFSGGGINVV

SEQ ID NO: 91863 - protein, 380 aa, Homo sapiens
  Payload ID: 18397
  Gene Name: transmembrane protein 64
  Uniprot ID: Q6YI46
  ENSP ID: ENSP00000414786
MRSPGGILLQALPRLLQHAALPGLAELPARWALPRGAGGDGPADRLPRGGGASAAAAAAAASGALLGAYLERHGPPEASELPEPGGALAGGPGSGGGGVVVGVAEVRNWRCCCLGSTCWCRSLVLVCVLAALCFASLALVRRYLHHLLLWVESLDSLLGVLLFVVGFIVVSFPCGWGYIVLNVAAGYLYGFVLGMGLMMVGVLIGTFIAHVVCKRLLTAWVAARIQSSEKLSAVIRVVEGGSGLKVVALARLTPIPFGLQNAVFSITDLSLPNYLMASSVGLLPTQLLNSYLGTTLRTMEDVIAEQSVSGYFVFCLQIIISIGLMFYVVHRAQVELNAAIVACEMELKSSLVKGNQPNTSGSSFYNKRTLTFSGGGINVV

SEQ ID NO: 91864 - protein, 119 aa, Homo sapiens
  Payload ID: 18397
  Gene Name: transmembrane protein 64
  Uniprot ID: Q6YI46
  ENSP ID: ENSP00000429832
MPPRITDLSLPNYLMASSVGLLPTQLLNSYLGTTLRTMEDVIAEQSVSGYFVFCLQIIISIGLMFYVVHRAQVELNAAIVACEMELKSSLVKGNQPNTSGSSFYNKRTLTFSGGGINVV

SEQ ID NO: 91865 - protein, 51 aa, Homo sapiens
  Payload ID: 18397
  Gene Name: transmembrane protein 64
  ENSP ID: ENSP00000430689
MPPRITDLSLPNYLMASSVGLLPTQLLNSYLGTTLRTMEDVIAEQSVSGYF

SEQ ID NO: 91866 - protein, 240 aa, Homo sapiens
  Payload ID: 18398
  Gene Name: transmembrane protein 65
  Uniprot ID: Q6PI78
  ENSP ID: ENSP00000297632
MSRLLPLLRSRTARSLRPGPAAAAAPRPPSWCCCGRGLLALAPPGGLPGGPRRLGTHPKKEPMEALNTAQGARDFIYSLHSTERSCLLKELHRFESIAIAQEKLEAPPPTPGQLRYVFIHNAIPFIGFGFLDNAIMIVAGTHIEMSIGIILGISTMAAAALGNLVSDLAGLGLAGYVEALASRLGLSIPDLTPKQVDMWQTRLSTHLGKAVGVTIGCILGMFPLIFFGGGEEDEKLETKS

SEQ ID NO: 91867 - protein, 985 aa, Homo sapiens
  Payload ID: 18399
  Gene Name: transmembrane protein 67
  ENSP ID: ENSP00000314488
MAVWSLLSARAVTAFLLLFLPRFLQAQTFSFPFQQPEKCDNNQYFDISALSCVPCGANQRQDARGTSCVCLPGFQMISNNGGPAIICKKCPENMKGVTEDGWNCISCPSDLTAEGKCHCPIGHILVERDINGTLLSQATCELCDGNENSFMVVNALGDRCVRCEPTFVNTSRSCACSEPNILTGGLCFSSTGNFPLRRISAARYGEVGMSLTSEWFAKYLQSSAAACWVYANLTSCQALGNMCVMNMNSYDFATFDACGLFQFIFENTAGLSTVHSISFWRQNLPWLFYGDQLGLAPQVLSSTSLPTNFSFKGENQNTKLKFVAASYDIRGNFLKWQTLEGGVLQLCPDTETRLNAAYSFGTTYQQNCEIPISKILIDFPTPIFYDVYLEYTDENQHQYILAVPVLNLNLQHNKIFVNQDSNSGKWLLTRRIFLVDAVSGRENDLGTQPRVIRVATQISLSVHLVPNTINGNIYPPLITIAYSDIDIKDANSQSVKVSFSVTYEMDHGEAHVQTDIALGVLGGLAVLASLLKTAGWKRRIGSPMIDLQTVVKFLVYYAGDLANVFFIITVGTGLYWLIFFKAQKSVSVLLPMPIQEERFVTYVGCAFALKALQFLHKLISQITIDVFFIDWERPKGKVLKAVEGEGGVRSATVPVSIWRTYFVANEWNEIQTVRKINSLFQVLTVLFFLEVVGFKNLALMDSSSSLSRNPPSYIAPYSCILRYAVSAALWLAIGIIQVVFFAVFYERFIEDKIRQFVDLCSMSNISVFLLSHKCFGYYIHGRSVHGHADTNMEEMNMNLKREAENLCSQRGLVPNTDGQTFEIAISNQMRQHYDRIHETLIRKNGPARLLSSSASTFEQSIKAYHMMNKFLGSFIDHVHKEMDYFIKDKLLLERILGMEFMEPMEKSIFYNDEGYSFSSVLYYGNEATLLIFDLLFFCVVDLACQNFILASFLTYLQQEIFRYIRNTVGQKNLASKTLVDQRFLI

SEQ ID NO: 91868 - protein, 914 aa, Homo sapiens
  Payload ID: 18399
  Gene Name: transmembrane protein 67
  Uniprot ID: Q5HYA8
  ENSP ID: ENSP00000386966
MSLSHWPYFRLVLNFRPQVICLPQPPKVLGYRLEPPHLTLACTLEGMYNIIEEILERDINGTLLSQATCELCDGNENSFMVVNALGDRCVRCEPTFVNTSRSCACSEPNILTGGLCFSSTGNFPLRRISAARYGEVGMSLTSEWFAKYLQSSAAACWVYANLTSCQALGNMCVMNMNSYDFATFDACGLFQFIFENTAGLSTVHSISFWRQNLPWLFYGDQLGLAPQVLSSTSLPTNFSFKGENQNTKLKFVAASYDIRGNFLKWQTLEGGVLQLCPDTETRLNAAYSFGTTYQQNCEIPISKILIDFPTPIFYDVYLEYTDENQHQYILAVPVLNLNLQHNKIFVNQDSNSGKWLLTRRIFLVDAVSGRENDLGTQPRVIRVATQISLSVHLVPNTINGNIYPPLITIAYSDIDIKDANSQSVKVSFSVTYEMDHGEAHVQTDIALGVLGGLAVLASLLKTAGWKRRIGSPMIDLQTVVKFLVYYAGDLANVFFIITVGTGLYWLIFFKAQKSVSVLLPMPIQEERFVTYVGCAFALKALQFLHKLISQITIDVFFIDWERPKGKVLKAVEGEGGVRSATVPVSIWRTYFVANEWNEIQTVRKINSLFQVLTVLFFLEVVGFKNLALMDSSSSLSRNPPSYIAPYSCILRYAVSAALWLAIGIIQVVFFAVFYERFIEDKIRQFVDLCSMSNISVFLLSHKCFGYYIHGRSVHGHADTNMEEMNMNLKREAENLCSQRGLVPNTDGQTFEIAISNQMRQHYDRIHETLIRKNGPARLLSSSASTFEQSIKAYHMMNKFLGSFIDHVHKEMDYFIKDKLLLERILGMEFMEPMEKSIFYNDEGYSFSSVLYYGNEATLLIFDLLFFCVVDLACQNFILASFLTYLQQEIFRYIRNTVGQKNLASKTLVDQRFLI

SEQ ID NO: 91869 - protein, 397 aa, Homo sapiens
  Payload ID: 18399
  Gene Name: transmembrane protein 67
  ENSP ID: ENSP00000388671
MKGVTEDGWNCISCPSDLTAEGKCHCPIGHILVERDINGTLLSQATCELCDGNENSFMVVNALGDRCVRCEPTFVNTSRSCACSEPNILTGGLCFSSTGNFPLRRISAARYGEVGMSLTSEWFAKYLQSSAAACWVYANLTSCQALGNMCVMNMNSYDFATFDACGLFQFIFENTAGLSTVHSISFWRQNLPWLFYGDQLGLAPQVLSSTSLPTNFSFKGENQNTKLKFVAASYDIRGNFLKWQTLEGGVLQLCPDTETRLNAAYSFGTTYQQNCEIPISKILIDFPTPIFYDVYLEYTDENQHQYILAVPVLNLNLQHNKIFVNQDSNSGKWLLTRRIFLVDAVSGRENDLGTQPRVIRVATQISLSVHLVPNTINGNIYPPLITIAYSDIDIKDA

SEQ ID NO: 91870 - protein, 995 aa, Homo sapiens
  Payload ID: 18399
  Gene Name: transmembrane protein 67
  Uniprot ID: Q5HYA8
  ENSP ID: ENSP00000389998
MATRGGAGVAMAVWSLLSARAVTAFLLLFLPRFLQAQTFSFPFQQPEKCDNNQYFDISALSCVPCGANQRQDARGTSCVCLPGFQMISNNGGPAIICKKCPENMKGVTEDGWNCISCPSDLTAEGKCHCPIGHILVERDINGTLLSQATCELCDGNENSFMVVNALGDRCVRCEPTFVNTSRSCACSEPNILTGGLCFSSTGNFPLRRISAARYGEVGMSLTSEWFAKYLQSSAAACWVYANLTSCQALGNMCVMNMNSYDFATFDACGLFQFIFENTAGLSTVHSISFWRQNLPWLFYGDQLGLAPQVLSSTSLPTNFSFKGENQNTKLKFVAASYDIRGNFLKWQTLEGGVLQLCPDTETRLNAAYSFGTTYQQNCEIPISKILIDFPTPIFYDVYLEYTDENQHQYILAVPVLNLNLQHNKIFVNQDSNSGKWLLTRRIFLVDAVSGRENDLGTQPRVIRVATQISLSVHLVPNTINGNIYPPLITIAYSDIDIKDANSQSVKVSFSVTYEMDHGEAHVQTDIALGVLGGLAVLASLLKTAGWKRRIGSPMIDLQTVVKFLVYYAGDLANVFFIITVGTGLYWLIFFKAQKSVSVLLPMPIQEERFVTYVGCAFALKALQFLHKLISQITIDVFFIDWERPKGKVLKAVEGEGGVRSATVPVSIWRTYFVANEWNEIQTVRKINSLFQVLTVLFFLEVVGFKNLALMDSSSSLSRNPPSYIAPYSCILRYAVSAALWLAIGIIQVVFFAVFYERFIEDKIRQFVDLCSMSNISVFLLSHKCFGYYIHGRSVHGHADTNMEEMNMNLKREAENLCSQRGLVPNTDGQTFEIAISNQMRQHYDRIHETLIRKNGPARLLSSSASTFEQSIKAYHMMNKFLGSFIDHVHKEMDYFIKDKLLLERILGMEFMEPMEKSIFYNDEGYSFSSVLYYGNEATLLIFDLLFFCVVDLACQNFILASFLTYLQQEIFRYIRNTVGQKNLASKTLVDQRFLI

SEQ ID NO: 91871 - protein, 180 aa, Homo sapiens
  Payload ID: 18399
  Gene Name: transmembrane protein 67
  ENSP ID: ENSP00000403035
MATRGGAGVAMAVWSLLSARAVTAFLLLFLPRFLQAQTFSFPFQQPEKCDNNQYFDISALSCVPCGANQRQDARGTSCVCLPGFQMISNNGGPAIICKKCPENMKGVTEDGWNCISCPSDLTAEGKCHCPIGHILDSNSGKWLLTRRIFLVDAVSGRENDLGTQPRVIRVATQISLSVHL

SEQ ID NO: 91872 - protein, 147 aa, Homo sapiens
  Payload ID: 18399
  Gene Name: transmembrane protein 67
  ENSP ID: ENSP00000416339
MATRGGAGVAMAVWSLLSARAVTAFLLLFLPRFLQAQTFSFPFQQPEKCDNNQYFDISALSCVPCGANQRQDARGTSCVCLPGFQMISNNGGPAIICKKCPENMKGVTEDGWNCISCPSDLTAEGKCHCPIGHILGSHSCPGWSVVV

SEQ ID NO: 91873 - protein, 87 aa, Homo sapiens
  Payload ID: 18399
  Gene Name: transmembrane protein 67
  ENSP ID: ENSP00000427947
  MOD_RES (1)..(1): Any amino acid
XTRGGAGVAMAVWSLLSARAVTAFLLLFLPRFLQAQTFSFPFQQPEKCDNNQYFDISALSCVPCGANQRQDARERCYRRWLELHFLP

SEQ ID NO: 91874 - protein, 239 aa, Homo sapiens
  Payload ID: 18399
  Gene Name: transmembrane protein 67
  ENSP ID: ENSP00000428785
  MOD_RES (1)..(1): Any amino acid
XFYDVYLEYTDENQHQYILAVPVLNLNLQHNKIFVNQDSNSGKWLLTRRIFLVDAVSGRENDLGTQPRVIRVATQISLSVHLVPNTINGNIYPPLITIAYSDIDIKDANSQSVKVSFSVTYEMDHGEAHVQTDTEFCTCCPGWSAMARSWLTATSASRVQAILLSQPPEYLGLQIALGVLGGLAVLASLLKTAGWKRRIGSPMIDLQTVVKFLVYYAGDLANVFFIITVGTGLYWLIFF

SEQ ID NO: 91875 - protein, 119 aa, Homo sapiens
  Payload ID: 18399
  Gene Name: transmembrane protein 67
  ENSP ID: ENSP00000429925
MATRGGAGVAMAVWSLLSARAVTAFLLLFLPRFLQAQTFSFPFQQPEKCDNNQYFDISALSCVPCGANQRQDARGTSCVCLPGFQMISNNGGPAIICKKCPENMVLQKMAGTAFLALVT

SEQ ID NO: 91876 - protein, 6 aa, Homo sapiens
  Payload ID: 18399
  Gene Name: transmembrane protein 67
  ENSP ID: ENSP00000430232
MVVNAL

SEQ ID NO: 91877 - protein, 38 aa, Homo sapiens
  Payload ID: 18399
  Gene Name: transmembrane protein 67
  ENSP ID: ENSP00000430289
MVVNALGDRCVRCEPTFVNTSRSCACSEPNILTGGLCF

SEQ ID NO: 91878 - protein, 173 aa, Homo sapiens
  Payload ID: 18399
  Gene Name: transmembrane protein 67
  ENSP ID: ENSP00000430740
  MOD_RES (1)..(1): Any amino acid
XRGGAGVAMAVWSLLSARAVTAFLLLFLPRFLQAQTFSFPFQQPEKCDNNQYFDISALSCVPCGANQRQDARGTSCVCLPGFQMISNNGGPAIICKKCPENMKGVTEDGWNCISCPSDLTAEGKCHCPIGHILVERDINGTLLSQATCELCDGNENSFMVVNALGDRQGDYVS

SEQ ID NO: 91879 - protein, 257 aa, Homo sapiens
  Payload ID: 18400
  Gene Name: transmembrane protein 68
  Uniprot ID: Q96MH6
  ENSP ID: ENSP00000335416
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGYEVHGMEKIPEDGPALIIFYHGAIPIDFYYFMAKIFIHKGRTCRVVADHFVFKIPGFSLLLDVFCALHGPREKCVEILRSGHLLAISPGGVREALISDETYNIVWGHRRGFAQVAIDAKVTKNAVQALIDKHQRIPGNIMSALLERFH

SEQ ID NO: 91880 - protein, 324 aa, Homo sapiens
  Payload ID: 18400
  Gene Name: transmembrane protein 68
  Uniprot ID: Q96MH6
  ENSP ID: ENSP00000395204
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGYEVHGMEKIPEDGPALIIFYHGAIPIDFYYFMAKIFIHKGRTCRVVADHFVFKIPGFSLLLDVFCALHGPREKCVEILRSGHLLAISPGGVREALISDETYNIVWGHRRGFAQVAIDAKVPIIPMFTQNIREGFRSLGGTRLFRWLYEKFRYPFAPMYGGFPVKLRTYLGDPIPYDPQITAEELAEKTKNAVQALIDKHQRIPGNIMSALLERFH

SEQ ID NO: 91881 - protein, 2 aa, Homo sapiens
  Payload ID: 18400
  Gene Name: transmembrane protein 68
  ENSP ID: ENSP00000427939
MI

SEQ ID NO: 91882 - protein, 108 aa, Homo sapiens
  Payload ID: 18400
  Gene Name: transmembrane protein 68
  ENSP ID: ENSP00000428236
  MOD_RES (1)..(1): Any amino acid
XLLYLTIIFLHIYKRKNVLKEAYSHNLWDGARKTVATLWDGHAAVWHGYEVHGMEKIPEDGPALIIFYHGAIPIDFYYFMAKIFIHKGRTCRVVADHFVFKIPGLMED

SEQ ID NO: 91883 - protein, 67 aa, Homo sapiens
  Payload ID: 18400
  Gene Name: transmembrane protein 68
  ENSP ID: ENSP00000428318
FCALHGPREKCVEILRSGHLLAISPGGVREALISDETYNIVWGHRRGFAQVAIDAKVALTGMACFHI

SEQ ID NO: 91884 - protein, 143 aa, Homo sapiens
  Payload ID: 18400
  Gene Name: transmembrane protein 68
  ENSP ID: ENSP00000428688
MEKIPEDGPALIIFYHGAIPIDFYYFMAKIFIHKGRTCRVVADHFVFKIPGFSLLLDVFCALHGPREKCVEILRSGHLLAISPGGVREALISDETYNIVWGHRRGFAQVAIDAKVTKNAVQALIDKHQRIPGNIMSALLERFH

SEQ ID NO: 91885 - protein, 144 aa, Homo sapiens
  Payload ID: 18400
  Gene Name: transmembrane protein 68
  ENSP ID: ENSP00000429026
MEKIPEDGPALIIFYHGAIPIDFYYFMAKIFIHKGRTCRVVADHFVFKIPGFSLLLDVFCALHGPREKCVEILRSGHLLAISPGGVREALISDETYNIVWGHRRGFAQVAIDAKVPIIPMFTQNIREGFRSLGGTNEECCSSFD

SEQ ID NO: 91886 - protein, 164 aa, Homo sapiens
  Payload ID: 18400
  Gene Name: transmembrane protein 68
  ENSP ID: ENSP00000429175
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGYEVHGMEKIPEDGPALIIFYHGAIPIDFYYFMAKIFIHKGRTCRVVADHFVFKIP

SEQ ID NO: 91887 - protein, 135 aa, Homo sapiens
  Payload ID: 18400
  Gene Name: transmembrane protein 68
  Uniprot ID: Q96MH6
  ENSP ID: ENSP00000429210
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGKQGYFHLCVAIHVCCIGTVLPFHFID

SEQ ID NO: 91888 - protein, 182 aa, Homo sapiens
  Payload ID: 18400
  Gene Name: transmembrane protein 68
  ENSP ID: ENSP00000429667
MEKIPEDGPALIIFYHGAIPIDFYYFMAKIFIHKGRTCRVVADHFVFKIPGFSLLLDVFCALHGPREKCVEILRSGHLLAISPGGVREALISDETYNIVWGHRRGFAQVAIDAKVPIIPMFTQNIREGFRSLGGTRLFRWLYEKFRYPFAPMYGGFPVKLRTYLGDPIPYDPQITAEELAEK

SEQ ID NO: 91889 - protein, 126 aa, Homo sapiens
  Payload ID: 18400
  Gene Name: transmembrane protein 68
  ENSP ID: ENSP00000429758
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGYEVHGMEKIPEDGPALI

SEQ ID NO: 91890 - protein, 243 aa, Homo sapiens
  Payload ID: 18400
  Gene Name: transmembrane protein 68
  ENSP ID: ENSP00000430542
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGYEVHGMEKIPEDGPALIIFYHGAIPIDFYYFMAKIFIHKGRTCRVVADHFVFKIPGFSLLLDVFCALHGPREKCVEILRSGHLLAISPGGVREALISDETYNIVWGHRRGFAQVAIDAKVPIIPMFTQNIREGF

SEQ ID NO: 91891 - protein, 144 aa, Homo sapiens
  Payload ID: 18400
  Gene Name: transmembrane protein 68
  ENSP ID: ENSP00000430838
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGFSLLLDVFCALHGPREKCVEILRSGHLLAISPGGV

SEQ ID NO: 91892 - protein, 134 aa, Homo sapiens
  Payload ID: 18400
  Gene Name: transmembrane protein 68
  ENSP ID: ENSP00000431018
IPEDGPALIIFYHGAIPIDFYYFMAKIFIHKGRTCRVVADHFVFKIPGFSLLLDVFCALHGPREKCVEILRSGHLLAISPGGVREALISDETYNIVWGHRRGFAQVAIDAKVGYLGGFMKNSAIHLLQCMEVFQ

SEQ ID NO: 91893 - protein, 135 aa, Homo sapiens; identical to SEQ ID NO: 91887
  Payload ID: 18400
  Gene Name: transmembrane protein 68
  Uniprot ID: Q96MH6
  ENSP ID: ENSP00000431047

SEQ ID NO: 91894 - protein, 324 aa, Homo sapiens; identical to SEQ ID NO: 91880
  Payload ID: 18400
  Gene Name: transmembrane protein 68
  Uniprot ID: Q96MH6
  ENSP ID: ENSP00000478242

SEQ ID NO: 91895 - protein, 91 aa, Homo sapiens
  Payload ID: 18400
  Gene Name: transmembrane protein 68
  ENSP ID: ENSP00000481143
MFTQNIREGFRSLGGTRLFRWLYEKFRYPFAPMYGGFPVKLRTYLGDPIPYDPQITAEELAEKTKNAVQALIDKHQRIPGNIMSALLERFH

SEQ ID NO: 91896 - protein, 247 aa, Homo sapiens
  Payload ID: 18401
  Gene Name: transmembrane protein 69
  Uniprot ID: Q5SWH9
  ENSP ID: ENSP00000361095
MLRFIQKFSQASSKILKYSFPVGLRTSRTDILSLKMSLQQNFSPCPRPWLSSSFPAYMSKTQCYHTSPCSFKKQQKQALLARPSSTITYLTDSPKPALCVTLAGLIPFVAPPLVMLMTKTYIPILAFTQMAYGASFLSFLGGIRWGFALPEGSPAKPDYLNLASSAAPLFFSWFAFLISERLSEAIVTVIMGMGVAFHLELFLLPHYPNWFKALRIVVTLLATFSFIITLVVKSSFPEKGHKRPGQV

SEQ ID NO: 91897 - protein, 260 aa, Homo sapiens
  Payload ID: 18402
  Gene Name: transmembrane protein 70
  Uniprot ID: Q9BUB7
  ENSP ID: ENSP00000312599
MLFLALGSPWAVELPLCGRRTALCAAAALRGPRASVSRASSSSGPSGPVAGWSTGPSGAARLLRRPGRAQIPVYWEGYVRFLNTPSDKSEDGRLIYTGNMARAVFGVKCFSYSTSLIGLTFLPYIFTQNNAISESVPLPIQIIFYGIMGSFTVITPVLLHFITKGYVIRLYHEATTDTYKAITYNAMLAETSTVFHQNDVKIPDAKHVFTTFYAKTKSLLVNPVLFPNREDYIHLMGYDKEEFILYMEETSEEKRHKDDK

SEQ ID NO: 91898 - protein, 111 aa, Homo sapiens
  Payload ID: 18402
  Gene Name: transmembrane protein 70
  ENSP ID: ENSP00000407695
MLFLALGSPWAVELPLCGRRTALCAAAALRGPRASVSRASSSSGPSGPVAGWSTGPSGAARLLRRPGRAQIPVYWEGYVRFLNTPSDKSEDGRLIYTGNMARAVFGWSAVA

SEQ ID NO: 91899 - protein, 107 aa, Homo sapiens
  Payload ID: 18402
  Gene Name: transmembrane protein 70
  Uniprot ID: Q9BUB7
  ENSP ID: ENSP00000429467
MLFLALGSPWAVELPLCGRRTALCAAAALRGPRASVSRASSSSGPSGPVAGWSTGPSGAARLLRRPGRAQIPVYWEGYVRFLNTPSDKSEDGRLIYTGNMARAVFGK

SEQ ID NO: 91900 - protein, 276 aa, Homo sapiens
  Payload ID: 18403
  Gene Name: transmembrane protein 71
  Uniprot ID: Q6P5X7
  ENSP ID: ENSP00000349296
MYRISQLMSTPVASSSRLEREYAGELSPTCIFPSFTCDSLDGYHSFECGSIDPLTGSHYTCRRSPRLLTNGYYIWTEDSFLCDKDGNITLNPSQTSVMYKENLVSTSKSWLHGSIFGDINSSPSEDNWLKGTRRLDTDHCNGNADDLDCSSLTDDWESGKMNAESVITSSSSHIISQPPGGNSHSLSLQSQLTASERFQENSSDHSETRLLQEVFFQAILLAVCLIISACARWFMGEILASVFTCSLMITVAYVKSLFLSLASYFKTTACARFVKI

SEQ ID NO: 91901 - protein, 232 aa, Homo sapiens
  Payload ID: 18403
  Gene Name: transmembrane protein 71
  Uniprot ID: Q6P5X7
  ENSP ID: ENSP00000367133
MYRISQLMSTPVASSSRLEREYAGELSPTCIFPSFTCDSLDGYHSFECGSIDPLTGSHYTCRRSPRLLTNGYYIWTEDSFLCDKDGNITLNPSQTSVMYKENLVRIFRKKKRICHSFSSLFNLSTSKSWLHGSIFGDINSSPSEDNWLKGTRRLDTDHCNGNETRLLQEVFFQAILLAVCLIISACARWFMGEILASVFTCSLMITVAYVKSLFLSLASYFKTTACARFVKI

SEQ ID NO: 91902 - protein, 313 aa, Homo sapiens
  Payload ID: 18403
  Gene Name: transmembrane protein 71
  ENSP ID: ENSP00000428228
MYRISQLMSTPVASSSRLEREYAGELSPTCIFPSFTCDSLDGYHSFECGSIDPLTGSHYTCRRSPRLLTNGYYIWTEDSFLCDKDGNITLNPSQTSVMYKENLVRIFRKKKRICHSFSSLFNLSTSKSWLHGSIFGDINSSPSEDNWLKGTRRLDTDHCNGNADDLDCSSLTDDWESGKMNAESVITSSSSHIISQPPGGNSHSLSLQSQLTASERFQENSSDHSETRLLQEVFFQAILLAVCLIISACARWFMGEILASVFTCSLMITVACLSKFDNHLGMPSMNVLHLNIWKLSNLQSTWNQVFYWKGVSE

SEQ ID NO: 91903 - protein, 41 aa, Homo sapiens
  Payload ID: 18403
  Gene Name: transmembrane protein 71
  ENSP ID: ENSP00000428397
MYKENLVRIFRKKKRICHSFSSLFNLSTSKSWLHGSIFGDI

SEQ ID NO: 91904 - protein, 100 aa, Homo sapiens
  Payload ID: 18403
  Gene Name: transmembrane protein 71
  ENSP ID: ENSP00000428772
  MOD_RES (1)..(1): Any amino acid
XDDLDCSSLTDDWESGKMNAESVITSSSSHIISQPPGGNSHSLSLQSQLTASERFQENSSDHSETRLLQEVFFQAILLAVCLIISACARNNNANHTMGED

SEQ ID NO: 91905 - protein, 99 aa, Homo sapiens
  Payload ID: 18403
  Gene Name: transmembrane protein 71
  ENSP ID: ENSP00000429873
MYRISQLMSTPVASSSRLEREYAGELSPTCIFPSFTCDSLDGYHSFECGSIDPLTGSHYTCRRSPRLLTNGYYIWTEDSFLCDKDGNITLNPSQTSVMY

SEQ ID NO: 91906 - protein, 91 aa, Homo sapiens
  Payload ID: 18403
  Gene Name: transmembrane protein 71
  ENSP ID: ENSP00000430239
MYRISQLMSTPVASSSRLEREYAGELSPTCIFPSFTCDSLDGYHSFECGSIDPLTGSHYTCRRSPRLLTNGYYIWTEDSFLCDKDGNITLN

SEQ ID NO: 91907 - protein, 63 aa, Homo sapiens
  Payload ID: 18403
  Gene Name: transmembrane protein 71
  ENSP ID: ENSP00000430847
MYKENLVRIFRKKKRICHSFSSLFNLSTSKSWLHGSIFGDINSSPSEDNWLKGTRRLDTDHCN

SEQ ID NO: 91908 - protein, 275 aa, Homo sapiens
  Payload ID: 18404
  Gene Name: transmembrane protein 72
  Uniprot ID: A0PK05
  ENSP ID: ENSP00000374234
MQLQVFWTGLEYTCRLLGITTAAVLIGVGTETFLQGQFKSLAFYLLFTGAAVSICEGAYFVAQLLAICFQCQPGSLADRVREKAHWLGCFQKFLAYLLLSVACFLHPVLVWHVTIPGSMLIITGLAYFLLSKRKKRKAAPEVLASPEQYTDPSSSAVSTTGSGDTEQTYTFHGALKEGPSSLFIHMKSILKGTKKPSALQPPNTLMELSLEPADSLAKKKQVHFEDNLVRIVPSLAEGLDDGDSEPEETTSDTTPIIPPPQAPLFLSSLTATGLF

SEQ ID NO: 91909 - protein, 157 aa, Homo sapiens
  Payload ID: 18404
  Gene Name: transmembrane protein 72
  Uniprot ID: A0PK05
  ENSP ID: ENSP00000439911
MLIITGLAYFLLSKRKKRKAAPEVLASPEQYTDPSSSAVSTTGSGDTEQTYTFHGALKEGPSSLFIHMKSILKGTKKPSALQPPNTLMELSLEPADSLAKKKQVHFEDNLVRIVPSLAEGLDDGDSEPEETTSDTTPIIPPPQAPLFLSSLTATGLF

SEQ ID NO: 91910 - protein, 305 aa, Homo sapiens
  Payload ID: 18405
  Gene Name: transmembrane protein 74
  Uniprot ID: Q96NL1
  ENSP ID: ENSP00000297459
MELHYLAKKSNQADLCDARDWSSRGLPGDQADTAATRAALCCQKQCASTPRATEMEGSKLSSSPASPSSSLQNSTLQPDAFPPGLLHSGNNQITAERKVCNCCSQELETSFTYVDKNINLEQRNRSSPSAKGHNHPGELGWENPNEWSQEAAISLISEEEDDTSSEATSSGKSIDYGFISAILFLVTGILLVIISYIVPREVTVDPNTVAAREMERLEKESARLGAHLDRCVIAGLCLLTLGGVILSCLLMMSMWKGELYRRNRFASSKESAKLYGSFNFRMKTSTNENTLELSLVEEDALAVQS

SEQ ID NO: 91911 - protein, 256 aa, Homo sapiens
  Payload ID: 18406
  Gene Name: transmembrane protein 74B
  Uniprot ID: Q9NUR3
  ENSP ID: ENSP00000371318
MPPAQGYEFAAAKGPRDELGPSFPMASPPGLELKTLSNGPQAPRRSAPLGPVAPTREGVENACFSSEEHETHFQNPGNTRLGSSPSPPGGVSSLPRSQRDDLSLHSEEGPALEPVSRPVDYGFVSALVFLVSGILLVVTAYAIPREARVNPDTVTAREMERLEMYYARLGSHLDRCIIAGLGLLTVGGMLLSVLLMVSLCKGELYRRRTFVPGKGSRKTYGSINLRMRQLNGDGGQALVENEVVQVSETSHTLQRS

SEQ ID NO: 91912 - protein, 154 aa, Homo sapiens
  Payload ID: 18406
  Gene Name: transmembrane protein 74B
  ENSP ID: ENSP00000400552
MPPAQGYEFAAAKGPRDELGPSFPMASPPGLELKTLSNGPQAPRRSAPLGPVAPTREGVENACFSSEEHETHFQNPGNTRLGSSPSPPGGVSSLPRSQRDDLSLHSEEGPALEPVSRPVDYGFVSALVFLVSGILLVVTAYAIPREARVNPDTV

SEQ ID NO: 91913 - protein, 136 aa, Homo sapiens
  Payload ID: 18407
  Gene Name: transmembrane protein 78
  Uniprot ID: Q5T7P6
  ENSP ID: ENSP00000324799
MWLDTRNLGIVISCWKGVCVPQTTTLEMFYNDNDRVEESSNSYQIRREFLLPACLPAFLSFSTSFSFFLSFLPLSLSLFLPFFPSFFLSLSLSPSFLPSFLRQGLALSPRLECDGAIMIHCSLNIPGSSDPPTSAS

SEQ ID NO: 91914 - protein, 394 aa, Homo sapiens
  Payload ID: 18408
  Gene Name: transmembrane protein 79
  Uniprot ID: Q9BSE2
  ENSP ID: ENSP00000295694
MTEQETLALLEVKRSDSPEKSSPQALVPNGRQPEGEGGAESPGAESLRVGSSAGSPTAIEGAEDGLDSTVSEAATLPWGTGPQPSAPFPDPPGWRDIEPEPPESEPLTKLEELPEDDANLLPEKAARAFVPIDLQCIERQPQEDLIVRCEAGEGECRTFMPPRVTHPDPTERKWAEAVVRPPGCSCGGCGSCGDREWLRAVASVGAALILFPCLLYGAYAFLPFDVPRLPTMSSRLIYTLRCGVFATFPIVLGILVYGLSLLCFSALRPFGEPRREVEIHRRYVAQSVQLFILYFFNLAVLSTYLPQDTLKLLPLLTGLFAVSRLIYWLTFAVGRSFRGFGYGLTFLPLLSMLMWNLYYMFVVEPERMLTATESRLDYPDHARSASDYRPRPWG

SEQ ID NO: 91915 - protein, 175 aa, Homo sapiens
  Payload ID: 18408
  Gene Name: transmembrane protein 79
  ENSP ID: ENSP00000350100
MTEQETLALLEVKRDPGVRAEPVMLFCPSALWGATAGGGDPPAICGPVGPALYSLLLQPGRAFHLPAPGYPQTAPSAHWSLCRLPADLLADLCRGPLLPRLRLRPDVSATAVDADVEPLLHVRGGAGAHAHCHREPPGLPGPRPLGLRLQAPPLGLSLSALALGVGGSGLGLTHL

SEQ ID NO: 91916 - protein, 394 aa, Homo sapiens; identical to SEQ ID NO: 91914
  Payload ID: 18408
  Gene Name: transmembrane protein 79
  Uniprot ID: Q9BSE2
  ENSP ID: ENSP00000384748

SEQ ID NO: 91917 - protein, 132 aa, Homo sapiens
  Payload ID: 18408
  Gene Name: transmembrane protein 79
  ENSP ID: ENSP00000394736
MTEQETLALLEVKRDPGVRAEPVMLFCPSALWGATAGGGDPPAICGPVGPALYSLLLQPGRAFHLPAPGYPQTAPSAHWSLCRLPADLLADLCRGPLLPRLRLRPDVSATAVDADVEPLLHVRGGAGAHAHC

SEQ ID NO: 91918 - protein, 216 aa, Homo sapiens
  Payload ID: 18409
  Gene Name: transmembrane protein 80
  ENSP ID: ENSP00000380646
MLPNVGSPPLPFRKCPSGAGRTNRASAVARTSAPETRRGRAPSSGDAKMAEGARARGPRGCRDRDGPAGGAGKMAAPRRGRGSSTVLSSVPLQMLFYLSGTYYALYFLATLLMITYKSQVFSYPHRYLVLDLALLFLMGILEAVRLYLGTRGNLTEAERPLAASLALTAGTALLSAHFLLWQALVLWADWALSATLLALHGLEAVLQVVAIAAFTR

SEQ ID NO: 91919 - protein, 160 aa, Homo sapiens
  Payload ID: 18409
  Gene Name: transmembrane protein 80
  Uniprot ID: Q96HE8
  ENSP ID: ENSP00000380648
MAEGARARGPRGCRDRDGPAGGAGRGSSTVLSSVPLQMLFYLSGTYYALYFLATLLMITYKSQVFSYPHRYLVLDLALLFLMGILEAVRLYLGTRGNLTEAERPLAASLALTAGTALLSAHFLLWQALVLWADWALSATLLALHGLEAVLQVVAIAAFTR

SEQ ID NO: 91920 - protein, 221 aa, Homo sapiens
  Payload ID: 18409
  Gene Name: transmembrane protein 80
  ENSP ID: ENSP00000436199
  MOD_RES (1)..(1): Any amino acid
XRDGPAGGAGKMAAPRRGRGSSTVLSSVPLQMLFYLSGTYYALYFLATLLMITYKSQVFSYPHRYLVLDLALLFLMGILEAVRLYLGTRGNLTEAERPLAASLALTAGTALLSAHFLLWQALVLWADWALSATLLALHGLEAVLQVVAIAAFTSGHGELQDSPEDPLHTPAPERLGPPPSPAPALAEDQLGTPAIWRTQPTNHADQGRTPSLKLETCCLHG

SEQ ID NO: 91921 - protein, 95 aa, Homo sapiens
  Payload ID: 18409
  Gene Name: transmembrane protein 80
  ENSP ID: ENSP00000475039
  MOD_RES (1)..(1): Any amino acid
XPAGGAGKMAAPRRGRGSSTVLSSVPLQMLFYLSGTYYALYFLATLLMITYKSQVFSYPHRYLVLDLALLFLMGILEAVRLYLGEWTVNTVKNLS

SEQ ID NO: 91922 - protein, 129 aa, Homo sapiens
  Payload ID: 18409
  Gene Name: transmembrane protein 80
  ENSP ID: ENSP00000476563
MLPNVGSPPLPFRKCPSGAGRTNRASAVARTSAPETRRGRAPSSGDAKMAEGARARGPRGCRDRDGPAGGAGKMAAPRRGRGSSTVLSSVPLQMLFYLSGTYYALYFLATSASQAGRPGARVDSGFLKQ

SEQ ID NO: 91923 - protein, 255 aa, Homo sapiens
  Payload ID: 18410
  Gene Name: transmembrane protein 81
  Uniprot ID: Q6P7N7
  ENSP ID: ENSP00000356135
MKVLATSFVLGSLGLAFYLPLVVTTPKTLAIPEKLQEAVGKVIINATTCTVTCGLGYKEETVCEVGPDGVRRKCQTRRLECLTNWICGMLHFTILIGKEFELSCLSSDILEFGQEAFRFTWRLARGVISTDDEVFKPFQANSHFVKFKYAQEYDSGTYRCDVQLVKNLRLVKRLYFGLRVLPPNLVNLNFHQSLTEDQKLIDEGLEVNLDSYSKPHHPKWKKKVASALGIGIAIGVVGGVLVRIVLCALRGGLQQ

SEQ ID NO: 91924 - protein, 343 aa, Homo sapiens
  Payload ID: 18411
  Gene Name: transmembrane protein 82
  Uniprot ID: A0PJX8
  ENSP ID: ENSP00000364938
MFSLPSLPSWLPGLPSLEWGSSLLDSLLQGLIGALGVLVLNSLLKVYFFVGCANDPQRRPEKERLRAQWASLETVHLAGLALFLTVVGSRVAALVVLEFSLRAVSTLLSLGKGSQGAAERLQLYLLCQYSLGCGLTCGLSFLQEGAPHRTLNLLLSLGLATLLGLGARRLHRHVCRLYELHSSQRYCGVCLGLLAHAHGLPQLLGRALAIAFAVGDLAAVALINQDFLTTSEAMRFWTPLTICYTLLVIYMQEEQRQHPGLQSQVQTVLVRMGGLFVLLLTVGRWLDLLGILVSLLGELWCLVGVRTLLDLCQIQDFPSQRPPVSTPSQPLPSAPQSQSSAPS

SEQ ID NO: 91925 - protein, 240 aa, Homo sapiens
  Payload ID: 18412
  Gene Name: transmembrane protein 86A
  Uniprot ID: Q8N2M4
  ENSP ID: ENSP00000280734
MVSPVTVVKSEGPKLVPFFKATCVYFVLWLPSSSPSWVSTLIKCLPIFCLWLFLLAHGLGFLLAHPSATRIFVGLVFSAVGDAFLIWQDQGYFVHGLLMFAVTHMFYASAFGMQPLALRTGLVMAALSGLCYALLYPCLSGAFTYLVGVYVALIGFMGWRAMAGLRLAGADWRWTELAAGSGALFFIISDLTIALNKFCFPVPYSRALIMSTYYVAQMLVALSAVESREPVEHYRLTKAN

SEQ ID NO: 91926 - protein, 226 aa, Homo sapiens
  Payload ID: 18413
  Gene Name: transmembrane protein 86B
  Uniprot ID: Q8N661
  ENSP ID: ENSP00000321038
MDAGKAGQTLKTHCSAQRPDVCRWLSPFILSCCVYFCLWIPEDQLSWFAALVKCLPVLCLAGFLWVMSPSGGYTQLLQGALVCSAVGDACLIWPAAFVPGMAAFATAHLLYVWAFGFSPLQPGLLLLIILAPGPYLSLVLQHLEPDMVLPVAAYGLILMAMLWRGLAQGGSAGWGALLFTLSDGVLAWDTFAQPLPHAHLVIMTTYYAAQLLITLSALRSPVPKTD

SEQ ID NO: 91927 - protein, 181 aa, Homo sapiens
  Payload ID: 18414
  Gene Name: transmembrane protein 87A
  Uniprot ID: Q8NBN3
  ENSP ID: ENSP00000305894
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTIQMPFLKKHFLDC

SEQ ID NO: 91928 - protein, 555 aa, Homo sapiens
  Payload ID: 18414
  Gene Name: transmembrane protein 87A
  Uniprot ID: Q8NBN3
  ENSP ID: ENSP00000374484
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 91929 - protein, 494 aa, Homo sapiens
  Payload ID: 18414
  Gene Name: transmembrane protein 87A
  Uniprot ID: Q8NBN3
  ENSP ID: ENSP00000405379
MAHSDTVVDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 91930 - protein, 39 aa, Homo sapiens
  Payload ID: 18414
  Gene Name: transmembrane protein 87A
  ENSP ID: ENSP00000454278
MHRLPLLGEKQEAKENGTNLTFIGDKTAMHEPLQTWQDA

SEQ ID NO: 91931 - protein, 170 aa, Homo sapiens
  Payload ID: 18414
  Gene Name: transmembrane protein 87A
  ENSP ID: ENSP00000454539
MHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTL

SEQ ID NO: 91932 - protein, 110 aa, Homo sapiens
  Payload ID: 18414
  Gene Name: transmembrane protein 87A
  ENSP ID: ENSP00000455343
MHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACY

SEQ ID NO: 91933 - protein, 57 aa, Homo sapiens
  Payload ID: 18414
  Gene Name: transmembrane protein 87A
  ENSP ID: ENSP00000456225
MAAAAWLQVLPVILLLLGAHPSPLSFFSAGPATVAAADRSKWHIPIPSLMENLVTCL

SEQ ID NO: 91934 - protein, 40 aa, Homo sapiens
  Payload ID: 18414
  Gene Name: transmembrane protein 87A
  ENSP ID: ENSP00000456940
MHRLPLLGEKQEAKENGTNLTFIGDKTIQMPFLKKHFLDC

SEQ ID NO: 91935 - protein, 195 aa, Homo sapiens
  Payload ID: 18414
  Gene Name: transmembrane protein 87A
  ENSP ID: ENSP00000457308
  MOD_RES (1)..(1): Any amino acid
XFYAEFQNIRYKGESVQGALILAELLSAVKRSLARTLVIIVSLGYGIVKPRLGVTLHKVVVAGALYLLFSGMEGVLRVTGYFSYPLTLIVNLALSAIDACVILWIFISLTQTMKLLKLRRNIVKLSLYRHFTNTLILAVAASIVFIIWTTMKFRIVTCQSDWRELWVDDAIWRLLFSMILFVIMVLWRPSANNQR

SEQ ID NO: 91936 - protein, 87 aa, Homo sapiens
  Payload ID: 18414
  Gene Name: transmembrane protein 87A
  ENSP ID: ENSP00000457874
MHRLPLLGEKQEAKENGTNLTFIGDKTAMHEPLQTWQDAPYIFIVHIGISSSKESSKENSLSNLFTMTVEVKGPYEYLTLEDYPLMI

SEQ ID NO: 91937 - protein, 555 aa, Homo sapiens
  Payload ID: 18415
  Gene Name: transmembrane protein 87B
  Uniprot ID: Q96K49
  ENSP ID: ENSP00000283206
MVAACRSVAGLLPRRRRCFPARAPLLRVALCLLCWTPAAVRAVPELGLWLETVNDKSGPLIFRKTMFNSTDIKLSVKSFHCSGPVKFTIVWHLKYHTCHNEHSNLEELFQKHKLSVDEDFCHYLKNDNCWTTKNENLDCNSDSQVFPSLNNKELINIRNVSNQERSMDVVARTQKDGFHIFIVSIKTENTDASWNLNVSLSMIGPHGYISASDWPLMIFYMVMCIVYILYGILWLTWSACYWKDILRIQFWIAAVIFLGMLEKAVFYSEYQNISNTGLSTQGLLIFAELISAIKRTLARLLVIIVSLGYGIVKPRLGTVMHRVIGLGLLYLIFAAVEGVMRVIGGSNHLAVVLDDIILAVIDSIFVWFIFISLAQTMKTLRLRKNTVKFSLYRHFKNTLIFAVLASIVFMGWTTKTFRIAKCQSDWMERWVDDAFWSFLFSLILIVIMFLWRPSANNQRYAFMPLIDDSDDEIEEFMVTSENLTEGIKLRASKSVSNGTAKPATSENFDEDLKWVEENIPSSFTDVALPVLVDSDEEIMTRSEMAEKMFSSEKIM

SEQ ID NO: 91938 - protein, 184 aa, Homo sapiens
  Payload ID: 18415
  Gene Name: transmembrane protein 87B
  ENSP ID: ENSP00000393998
  MOD_RES (1)..(1): Any amino acid
XPELGLWLETVNDKSGPLIFRKTMFNSTDIKLSVKSFHCSGPVKFTIVWHLKYHTCHNEHSNLEELFQKHKLSVDEDFCHYLKNDNCWTTKNENLDCNSDSQVFPSLNDVVARTQKDGFHIFIVSIKTENTDASWNLNVSLSMIGPHGYISASDWPLMIFYMVMCIVYILYGILWLTWSACYWK

SEQ ID NO: 91939 - protein, 112 aa, Homo sapiens
  Payload ID: 18415
  Gene Name: transmembrane protein 87B
  ENSP ID: ENSP00000400100
  MOD_RES (1)..(1): Any amino acid
XPELGLWLETVNDKSGPLIFRKTMFNSTDIKLSVKSFHCSGPVKFTIVWHLKYHTCHNEHSNLEELFQKHKLSVDEDFCHYLKNDNCWTTKNENLDCNSDSQVFPSLNFLFL

SEQ ID NO: 91940 - protein, 159 aa, Homo sapiens
  Payload ID: 18416
  Gene Name: transmembrane protein 88
  Uniprot ID: Q6PEY1
  ENSP ID: ENSP00000301599
MADVPGAQRAVPGDGPEPRDPLDCWACAVLVTAQNLLVAAFNLLLLVLVLGTILLPAVTMLGFGFLCHSQFLRSQAPPCTAHLRDPGFTALLVTGFLLLVPLLVLALASYRRLCLRLRLADCLVPYSRALYRRRRAPQPRQIRASPGSQAVPTSGKVWV

SEQ ID NO: 91941 - protein, 126 aa, Homo sapiens
  Payload ID: 18416
  Gene Name: transmembrane protein 88
  ENSP ID: ENSP00000459725
MADVPGAQRAVPGDGPEPRDPLDCWACAVLVTAQNLLVAAFNLLLLVLVLGTILLPAVTMLGFGFLCHSQDLKPGIFRPALPPPLPERSPSIPLGAAASVDPVLRKAPTSRKTHFPFTTHISILNI

SEQ ID NO: 91942 - protein, 163 aa, Homo sapiens
  Payload ID: 18417
  Gene Name: transmembrane protein 88B
  Uniprot ID: A6NKF7
  ENSP ID: ENSP00000455099
MSEQGRETEEEEGGGGASDTAPMLPRGPPDHQASALTCPGWSGPPLLPGRLLAGLLLHLLLPAAAFLLVLLPAAAVVYLGFLCHSRVHPAPGPRCRALFSDRGSAALIVFGLLSLPPLLVLASAVRARLARRLRPLLPPPAGTPGPRRPPGRPDEDEQLCAWV

SEQ ID NO: 91943 - protein, 159 aa, Homo sapiens
  Payload ID: 18418
  Gene Name: transmembrane protein 89
  Uniprot ID: A2RUT3
  ENSP ID: ENSP00000329557
MLHVLASLPLLLLLVTSASTHAWSRPLWYQVGLDLQPWGCQPKSVEGCRGGLSCPGYWLGPGASRIYPVAAVMITTTMLMICRKILQGRRRSQATKGEHPQVTTEPCGPWKRRAPISDHTLLRGVLHMLDALLVHIEGHLRHLATQRQIQIKGTSTQSG

SEQ ID NO: 91944 - protein, 578 aa, Homo sapiens
  Payload ID: 18419
  Gene Name: transmembrane protein 8A
  ENSP ID: ENSP00000250930
MEPDVPLPQTLLSHPSYLKVFVPDYTRELLLELRDCVSNGSLGCPVRLTVGPVTLPSNFQKVLTCTGAPWPCRLLLPSPPWDRWLQVTAESLVGPLGTVAFSAVAALTACRPRSVTIQPLLQSSQNQSFNASSGLLSPSPDHQDLGRSGRVDRSPFCLTNYPVTREDMDVVSVHFQPLDRVSVRVCSDTPSVMRLRLNTGMDSGGSLTISLRANKTEMRNETVVVACVNAASPFLGFNTSLNCTTAFFQGYPLSLSAWSRRANLIIPYPETDNWYLSLQLMCPENAEDCEQAVVHVETTLYLVPCLNDCGPYGQCLLLRRHSYLYASCSCKAGWRGWSCTDNSTAQTVAQQRAATLLLTLSNLMFLAPIAVSVRRFFLVEASVYAYTMFFSTFYHACDQPGEAVLCILSYDTLQYCDFLGSGAAIWVTILCMARLKTVLKYVLFLLGTLVIAMSLQLDRRGMWNMLGPCLFAFVIMASMWAYRCGHRRQCYPTSWQRWAFYLLPGVSMASVGIAIYTSMMTSDNYYYTHSIWHILLAGSAALLLPPPDQPAEPWACSQKFPCHYQICKNDREELYAVT

SEQ ID NO: 91945 - protein, 239 aa, Homo sapiens
  Payload ID: 18419
  Gene Name: transmembrane protein 8A
  ENSP ID: ENSP00000397620
  MOD_RES (1)..(1): Any amino acid
XLVPCLNDCGPYGQCLLLRRHSYLYASCSCKAGWRGWSCTDNSTAQTVAQQRAATLLLTLSNLMFLAPIAVSVRRFFLVEASVYAYTMFFSTFYHACDQPGEAVLCILSYDTLQYCDFLGSGAAIWVTILCMARLKTVLKYAYRCGHRRQCYPTSWQRWAFYLLPGVSMASVGIAIYTSMMTSDNYYYTHSIWHILLAGSAALLLPPPDQPAEPWACSQKFPCHYQICKNDREELYAVT

SEQ ID NO: 91946 - protein, 771 aa, Homo sapiens
  Payload ID: 18419
  Gene Name: transmembrane protein 8A
  Uniprot ID: Q9HCN3
  ENSP ID: ENSP00000401338
MGRAGTGTGGEAVAAVVAGPLLLLLLARPPPASAGYSGKSEVGLVSEHFSQAPQRLSFYSWYGSARLFRFRVPPDAVLLRWLLQVSRESGAACTDAEITVHFRSGAPPVINPLGTSFPDDTAVQPSFQVGVPLSTTPRSNASVNVSHPAPGDWFVAAHLPPSSQKIELKGLAPTCAYVFQPELLVTRVVEISIMEPDVPLPQTLLSHPSYLKVFVPDYTRELLLELRDCVSNGSLGCPVRLTVGPVTLPSNFQKVLTCTGAPWPCRLLLPSPPWDRWLQVTAESLVGPLGTVAFSAVAALTACRPRSVTIQPLLQSSQNQSFNASSGLLSPSPDHQDLGRSGRVDRSPFCLTNYPVTREDMDVVSVHFQPLDRVSVRVCSDTPSVMRLRLNTGMDSGGSLTISLRANKTEMRNETVVVACVNAASPFLGFNTSLNCTTAFFQGYPLSLSAWSRRANLIIPYPETDNWYLSLQLMCPENAEDCEQAVVHVETTLYLVPCLNDCGPYGQCLLLRRHSYLYASCSCKAGWRGWSCTDNSTAQTVAQQRAATLLLTLSNLMFLAPIAVSVRRFFLVEASVYAYTMFFSTFYHACDQPGEAVLCILSYDTLQYCDFLGSGAAIWVTILCMARLKTVLKYVLFLLGTLVIAMSLQLDRRGMWNMLGPCLFAFVIMASMWAYRCGHRRQCYPTSWQRWAFYLLPGVSMASVGIAIYTSMMTSDNYYYTHSIWHILLAGSAALLLPPPDQPAEPWACSQKFPCHYQICKNDREELYAVT

SEQ ID NO: 91947 - protein, 243 aa, Homo sapiens
  Payload ID: 18419
  Gene Name: transmembrane protein 8A
  ENSP ID: ENSP00000401931
RRANLIIPYPETDNWYLSLQLMCPENAEDCEQAVVHVETTLYLVPCLNDCGPYGQCLLLRRHSYLYASCSCKAGWRGWSCTDNSTAQTVAQQRAATLLLTLSNLMFLAPIAVSVRRFFLVEASVYAYTMFFSTFYHACDQPGEAVLCILSYDTLQYCDFLGSGAAIWVTILCMARLKTVLKYVLFLLGTLVIAMSLQLDRRGMWNMLGPCLFAFVIMASMWVRSRAGWHCCPGARRREPGPLL

SEQ ID NO: 91948 - protein, 21 aa, Homo sapiens
  Payload ID: 18419
  Gene Name: transmembrane protein 8A
  ENSP ID: ENSP00000410987
MEPDVPLPQTLLSHPSYLKVF

SEQ ID NO: 91949 - protein, 472 aa, Homo sapiens
  Payload ID: 18420
  Gene Name: transmembrane protein 8B
  Uniprot ID: A6NDV4
  ENSP ID: ENSP00000367227
MNMPQSLGNQPLPPEPPSLGTPAEGPGTTSPPEHCWPVRPTLRNELDTFSVHFYIFFGPSVALPPERPAVFAMRLLPVLDSGGVLSLELQLNASSVRQENVTVFGCLTHEVPLSLGDAAVTCSKESLAGFLLSVSATTRVARLRIPFPQTGTWFLALRSLCGVGPRFVRCRNATAEVRMRTFLSPCVDDCGPYGQCKLLRTHNYLYAACECKAGWRGWGCTDSADALTYGFQLLSTLLLCLSNLMFLPPVVLAIRSRYVLEAAVYTFTMFFSTFYHACDQPGIVVFCIMDYDVLQFCDFLGSLMSVWVTVIAMARLQPVVKQVLYLLGAMLLSMALQLDRHGLWNLLGPSLFALGILATAWTVRSVRRRHCYPPTWRRWLFYLCPGSLIAGSAVLLYAFVETRDNYFYIHSIWHMLIAGSVGFLLPPRAKTDHGVPSGARARGCGYQLCINEQEELGLVGPGGATVSSICAS

SEQ ID NO: 91950 - protein, 472 aa, Homo sapiens; identical to SEQ ID NO: 91949
  Payload ID: 18420
  Gene Name: transmembrane protein 8B
  Uniprot ID: A6NDV4
  ENSP ID: ENSP00000367230

SEQ ID NO: 91951 - protein, 338 aa, Homo sapiens
  Payload ID: 18420
  Gene Name: transmembrane protein 8B
  Uniprot ID: A6NDV4
  ENSP ID: ENSP00000367235
MNMPQSLGNQPLPPEPPSLGTPAEGPGTTSPPEHCWPVRPTLRNELDTFSVHFYIFFGPSVALPPERPAVFAMRLLPVLDSGGVLSLELQLNASSVRQENVTVFGCLTHEVPLSLGDAAVTCSKESLAGFLLSVSATTRVARLRIPFPQTGTWFLALRSLCGVGPRFVRCRNATAEVRMRTFLSPCVDDCGPYGQCKLLRTHNYLYAACECKAGWRGWGCTDSADALTYGFQLLSTLLLCLSNLMFLPPVVLAIRSRYVLEAAVYTFTMFFSTVCGGVCILSLGACAWWWVTVCISTTFSEGLGMSVPSLCLLQTETAVLPKLSCIDNGHFCKTHWSK

SEQ ID NO: 91952 - protein, 338 aa, Homo sapiens; identical to SEQ ID NO: 91951
  Payload ID: 18420
  Gene Name: transmembrane protein 8B
  Uniprot ID: A6NDV4
  ENSP ID: ENSP00000395810

SEQ ID NO: 91953 - protein, 221 aa, Homo sapiens
  Payload ID: 18421
  Gene Name: transmembrane protein 8C
  Uniprot ID: A6NI61
  ENSP ID: ENSP00000419712
MGTLVAKLLLPTLSSLAFLPTVSIAAKRRFHMEAMVYLFTLFFVALHHACNGPGLSVLCFMRHDILEYFSVYGTALSMWVSLMALADFDEPKRSTFVMFGVLTIAVRIYHDRWGYGVYSGPIGTAILIIAAKWLQKMKEKKGLYPDKSVYTQQIGPGLCFGALALMLRFFFEDWDYTYVHSFYHCALAMSFVLLLPKVNKKAGSPGTPAKLDCSTLCCACV

SEQ ID NO: 91954 - protein, 183 aa, Homo sapiens
  Payload ID: 18422
  Gene Name: transmembrane protein 9
  Uniprot ID: Q9P0T7
  ENSP ID: ENSP00000356299
MKLLSLVAVVGCLLVPPAEANKSSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 91955 - protein, 186 aa, Homo sapiens
  Payload ID: 18422
  Gene Name: transmembrane protein 9
  ENSP ID: ENSP00000356301
MKLLSLVAVVGCLLVPPAEANKVRESSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 91956 - protein, 183 aa, Homo sapiens; identical to SEQ ID NO: 91954
  Payload ID: 18422
  Gene Name: transmembrane protein 9
  Uniprot ID: Q9P0T7
  ENSP ID: ENSP00000356302

SEQ ID NO: 91957 - protein, 183 aa, Homo sapiens; identical to SEQ ID NO: 91954
  Payload ID: 18422
  Gene Name: transmembrane protein 9
  Uniprot ID: Q9P0T7
  ENSP ID: ENSP00000356303

SEQ ID NO: 91958 - protein, 138 aa, Homo sapiens
  Payload ID: 18422
  Gene Name: transmembrane protein 9
  ENSP ID: ENSP00000390184
MKLLSLVAVVGCLLVPPAEANKSSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSM

SEQ ID NO: 91959 - protein, 163 aa, Homo sapiens
  Payload ID: 18422
  Gene Name: transmembrane protein 9
  ENSP ID: ENSP00000398557
MKLLSLVAVVGCLLVPPAEANKVREVSLQHLVTTTVHGHPVYRADSESSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSM

SEQ ID NO: 91960 - protein, 151 aa, Homo sapiens
  Payload ID: 18422
  Gene Name: transmembrane protein 9
  ENSP ID: ENSP00000405329
MKLLSLVAVVGCLLVPPAEANKSSEDIRCKCICPPYRNISGHIYNQNVSQKDCPVSLCCSNCLHVVEPMPVPGHDVEAYCLLCECRYEERSTTTIKVIIVIYLSVVGALLLYMAFLMLVDPLIRKPDAYTEQLHNEEENEDARSMAAAAAS

SEQ ID NO: 91961 - protein, 98 aa, Homo sapiens
  Payload ID: 18422
  Gene Name: transmembrane protein 9
  ENSP ID: ENSP00000437181
MKLLSLVAVVGCLLVPPAEANKSSEDIRCKCICPPYRNISGHIYNQNVSQKDCNCLHVVEPMPVPGHDVEAYCLLCECRSSLSSTCPWWVPCCSTWPS

SEQ ID NO: 91962 - protein, 183 aa, Homo sapiens; identical to SEQ ID NO: 91954
  Payload ID: 18422
  Gene Name: transmembrane protein 9
  Uniprot ID: Q9P0T7
  ENSP ID: ENSP00000476893

SEQ ID NO: 91963 - protein, 122 aa, Homo sapiens
  Payload ID: 18423
  Gene Name: transmembrane protein 91
  ENSP ID: ENSP00000345589
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKTN

SEQ ID NO: 91964 - protein, 139 aa, Homo sapiens
  Payload ID: 18423
  Gene Name: transmembrane protein 91
  Uniprot ID: Q6ZNR0
  ENSP ID: ENSP00000348750
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKHPQCLTYSRCYVSAFGIHA

SEQ ID NO: 91965 - protein, 172 aa, Homo sapiens
  Payload ID: 18423
  Gene Name: transmembrane protein 91
  Uniprot ID: Q6ZNR0
  ENSP ID: ENSP00000375859
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKTNKAWAKGDIQGAGAASRRAFLLGVLAVGLGVCTYAAALVTLAAYLASRDPP

SEQ ID NO: 91966 - protein, 127 aa, Homo sapiens
  Payload ID: 18423
  Gene Name: transmembrane protein 91
  Uniprot ID: Q6ZNR0
  ENSP ID: ENSP00000405647
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKLPLQPSL

SEQ ID NO: 91967 - protein, 123 aa, Homo sapiens
  Payload ID: 18423
  Gene Name: transmembrane protein 91
  Uniprot ID: Q6ZNR0
  ENSP ID: ENSP00000407003
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKPSL

SEQ ID NO: 91968 - protein, 133 aa, Homo sapiens
  Payload ID: 18423
  Gene Name: transmembrane protein 91
  Uniprot ID: Q6ZNR0
  ENSP ID: ENSP00000413192
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKTRPSCPYSPHCEP

SEQ ID NO: 91969 - protein, 133 aa, Homo sapiens; identical to SEQ ID NO: 91968
  Payload ID: 18423
  Gene Name: transmembrane protein 91
  Uniprot ID: Q6ZNR0
  ENSP ID: ENSP00000437779

SEQ ID NO: 91970 - protein, 114 aa, Homo sapiens
  Payload ID: 18423
  Gene Name: transmembrane protein 91
  ENSP ID: ENSP00000437868
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAA

SEQ ID NO: 91971 - protein, 132 aa, Homo sapiens
  Payload ID: 18423
  Gene Name: transmembrane protein 91
  ENSP ID: ENSP00000440225
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKVSLCVGLGGDWA

SEQ ID NO: 91972 - protein, 63 aa, Homo sapiens
  Payload ID: 18423
  Gene Name: transmembrane protein 91
  ENSP ID: ENSP00000440752
EGTECETPAQKPGRHELGSPLREIAFAESLRGLQFLSPPLPSVSAGLGEPRPPDVELPLQPSL

SEQ ID NO: 91973 - protein, 87 aa, Homo sapiens
  Payload ID: 18423
  Gene Name: transmembrane protein 91
  ENSP ID: ENSP00000441729
  MOD_RES (1)..(1): Any amino acid
XLPSVSAGLGEPRPPDVEDMSSSDSDSDWDGGSRLSPFLPHDHLGLAVFSMLCCFWPVGIAAFCLAQKHPQCLTYSRCYVSAFGIHA

SEQ ID NO: 91974 - protein, 132 aa, Homo sapiens; identical to SEQ ID NO: 91971
  Payload ID: 18423
  Gene Name: transmembrane protein 91
  ENSP ID: ENSP00000441900

SEQ ID NO: 91975 - protein, 60 aa, Homo sapiens
  Payload ID: 18423
  Gene Name: transmembrane protein 91
  ENSP ID: ENSP00000443375
  MOD_RES (1)..(1): Any amino acid
XWDGGSRLSPFLPHDHLGLAVFSMLCCFWPVGIAAFCLAQKHPQCLTYSRCYVSAFGIHA

SEQ ID NO: 91976 - protein, 190 aa, Homo sapiens
  Payload ID: 18423
  Gene Name: transmembrane protein 91
  ENSP ID: ENSP00000474871
MRCGFAGGVGHQRKRTRRRRLNPGDETQGSRPEEGDPERKESQAGKQGNPSWSFPKAMDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKTRPSCPYSPHCEP

SEQ ID NO: 91977 - protein, 159 aa, Homo sapiens
  Payload ID: 18424
  Gene Name: transmembrane protein 92
  Uniprot ID: Q6UXU6
  ENSP ID: ENSP00000300433
MSQAWVPGLAPTLLFSLLAGPQKIAAKCGLILACPKGFKCCGDSCCQENELFPGPVRIFVIIFLVILSVFCICGLAKCFCRNCREPEPDSPVDCRGPLELPSIIPPERVRVSLSAPPPPYSEVILKPSLGPTPTEPPPPYSFRPEEYTGDQRGIDNPAF

SEQ ID NO: 91978 - protein, 159 aa, Homo sapiens; identical to SEQ ID NO: 91977
  Payload ID: 18424
  Gene Name: transmembrane protein 92
  Uniprot ID: Q6UXU6
  ENSP ID: ENSP00000425144

SEQ ID NO: 91979 - protein, 1356 aa, Homo sapiens
  Payload ID: 18425
  Gene Name: transmembrane protein 94
  Uniprot ID: Q12767
  ENSP ID: ENSP00000313885
MDLKEKHLGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQDALRDGREIQWPSAMYPDLHMPFAPSWSLHWAYRDGHLVNLPVSLLVEGDIIALRPGQESFASLRGIKDDEHIVLEPGDLFPPFSPPPSPRGEVERGPQSPQQHRLFRVLETPVIDNIRWCLDMALSRPVTALDNERFTVQSVMLHYAVPVVLAGFLITNALRFIFSAPGVTSWQYTLLQLQVNGVLPILPLLFPVLWVLATACGEARVLAQMSKASPSSLLAKFSEDTLSSYTEAVSSQEMLRCIWGHFLRVLGGTSPTLSHSSSLLHSLGSVTVLCCVDKQGILSWPNPSPETVLFFSGKVEPPHSSHEDLTDGLSTRSFCHPEPHERDALLAGSLNNTLHLSNEQERGDWPGEAPKPPEPYSHHKAHGRSKHPSGSNVSFSRDTEGGEEEPSKTQPGMESDPYEAEDFVCDYHLEMLSLSQDQQNPSCIQFDDSNWQLHLTSLKPLGLNVLLNLCDASVTERLCRFSDHLCNIALQESHSAVLPVHVPWGLCELARLIGFTPGAKELFKQENHLALYRLPSAETMKETSLGRLSCVTKRRPPLSHMISLFIKDTTTSTEQMLSHGTADVVLEACTDFWDGADIYPLSGSDRKKVLDFYQRACLSGYCSAFAYKPMNCALSSQLNGKCIELVQVPGQSSIFTMCELPSTIPIKQNARRSSWSSDEGIGEVLEKEDCMQALSGQIFMGMVSSQYQARLDIVRLIDGLVNACIRFVYFSLEDELKSKVFAEKMGLETGWNCHISLTPNGDMPGSEIPPSSPSHAGSLHDDLNQVSRDDAEGLLLMEEEGHSDLISFQPTDSDIPSFLEDSNRAKLPRGIHQVRPHLQNIDNVPLLVPLFTDCTPETMCEMIKIMQEYGEVTCCLGSSANLRNSCLFLQSDISIALDPLYPSRCSWETFGYATSISMAQASDGLSPLQLSGQLNSLPCSLTFRQEETISIIRLIEQARHATYGIRKCFLFLLQCQLTLVVIQFLSCLVQLPPLLSTTDILWLSCFCYPLLSISLLGKPPHSSIMSMATGKNLQSIPKKTQHYFLLCFLLKFSLTISSCLICFGFTLQSFCDSSRDRNLTNCSSVMLPSNDDRAPAWFEDFANGLLSAQKLTAALIVLHTVFISITHVHRTKPLWRKSPLTNLWWAVTVPVVLLGQVVQTAVDLQLWTHRDSHVHFGLEDVPLLTWLLGCLSLVLVVVTNEIVKLHEIRVRVRYQKRQKLQFETKLGMNSPF

SEQ ID NO: 91980 - protein, 1366 aa, Homo sapiens
  Payload ID: 18425
  Gene Name: transmembrane protein 94
  ENSP ID: ENSP00000364397
MLFKQAELWMPHQGKGNKGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQDALRDGREIQWPSAMYPDLHMPFAPSWSLHWAYRDGHLVNLPVSLLVEGDIIALRPGQESFASLRGIKDDEHIVLEPGDLFPPFSPPPSPRGEVERGPQSPQQHRLFRVLETPVIDNIRWCLDMALSRPVTALDNERFTVQSVMLHYAVPVVLAGFLITNALRFIFSAPGVTSWQYTLLQLQVNGVLPILPLLFPVLWVLATACGEARVLAQMSKASPSSLLAKFSEDTLSSYTEAVSSQEMLRCIWGHFLRVLGGTSPTLSHSSSLLHSLGSVTVLCCVDKQGILSWPNPSPETVLFFSGKVEPPHSSHEDLTDGLSTRSFCHPEPHERDALLAGSLNNTLHLSNEQERGDWPGEAPKPPEPYSHHKAHGRSKHPSGSNVSFSRDTEGGEEEPSKTQPGMESDPYEAEDFVCDYHLEMLSLSQDQQNPSCIQFDDSNWQLHLTSLKPLGLNVLLNLCDASVTERLCRFSDHLCNIALQESHSAVLPVHVPWGLCELARLIGFTPGAKELFKQENHLALYRLPSAETMKETSLGRLSCVTKRRPPLSHMISLFIKDTTTSTEQMLSHGTADVVLEACTDFWDGADIYPLSGSDRKKVLDFYQRACLSGYCSAFAYKPMNCALSSQLNGKCIELVQVPGQSSIFTMCELPSTIPIKQNARRSSWSSDEGIGEVLEKEDCMQALSGQIFMGMVSSQYQARLDIVRLIDGLVNACIRFVYFSLEDELKSKVFAEKMGLETGWNCHISLTPNGDMPGSEIPPSSPSHAGSLHDDLNQVSRDDAEGLLLMEEEGHSDLISFQPTDSDIPSFLEDSNRAKLPRGIHQVRPHLQNIDNVPLLVPLFTDCTPETMCEMIKIMQEYGEVTCCLGSSANLRNSCLFLQSDISIALDPLYPSRCSWETFGYATSISMAQASDGLSPLQLSGQLNSLPCSLTFRQEETISIIRLIEQARHATYGIRKCFLFLLQCQLTLVVIQFLSCLVQLPPLLSTTDILWLSCFCYPLLSISLLGKPPHSSIMSMATGKNLQSIPKKTQHYFLLCFLLKFSLTISSCLICFGFTLQSFCDSSRDRNLTNCSSVMLPSNDDRAPAWFEDFANGLLSAQKLTAALIVLHTVFISITHVHRTKPLWRKSPLTNLWWAVTVPVVLLGQVVQTAVDLQLWTHRDSHVHFGLEDVPLLTWLLGCLSLVLVVVTNEIVKLHEIRVRVRYQKRQKLQFETKLGMNSPF

SEQ ID NO: 91981 - protein, 128 aa, Homo sapiens
  Payload ID: 18425
  Gene Name: transmembrane protein 94
  ENSP ID: ENSP00000462084
PHSSIMSMATGKNLQSIPKKTQHYFLLCFLLKFSLTISSCLICFGFTLQSFCDSSRDRNLTNCSSVMLPRAPAWFEDFANGLLSAQKLTAALIVLHTVFISITHVHRTKPLWRKSPLTNLWWAVTVPV

SEQ ID NO: 91982 - protein, 57 aa, Homo sapiens
  Payload ID: 18425
  Gene Name: transmembrane protein 94
  ENSP ID: ENSP00000462170
MDLKEKHLGEPPSALGLSTRKALSVLKEQLEAVLEGHLRERKKCLTWKEVWRSSFLH

SEQ ID NO: 91983 - protein, 162 aa, Homo sapiens
  Payload ID: 18425
  Gene Name: transmembrane protein 94
  ENSP ID: ENSP00000462344
MLFKQAELWMPHQGKGNKGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQASSLPPHSDAETTHQS

SEQ ID NO: 91984 - protein, 35 aa, Homo sapiens
  Payload ID: 18425
  Gene Name: transmembrane protein 94
  ENSP ID: ENSP00000462821
MLLAVLLLLGCCGGQPAGSRGVGLVNASALFLLLL

SEQ ID NO: 91985 - protein, 176 aa, Homo sapiens
  Payload ID: 18425
  Gene Name: transmembrane protein 94
  ENSP ID: ENSP00000463046
  MOD_RES (1)..(1): Any amino acid
XWLSCFCYPLLSISLLGKPPHSSIMSMATGKNLQSIPKKSFCDSSRDRNLTNCSSVMLPSNDDRAPAWFEDFANGLLSAQKLTAALIVLHTVFISITHVHRTKPLWRKSPLTNLWWAVTVPVVLLGQVVQTAVDLQLWTHRDSHVHFGLEDVPLLTWLLGCLSLVLVVVTNEIVKL

SEQ ID NO: 91986 - protein, 302 aa, Homo sapiens
  Payload ID: 18425
  Gene Name: transmembrane protein 94
  ENSP ID: ENSP00000463487
  MOD_RES (1)..(1): Any amino acid
XGKVEPPHSSHEDLTDGLSTRSFCHPEPHERDALLAGSLNNTLHLSNEQERGDWPGEAPKPPEPYSHHKAHGRSKHPSGSNTQPGMESDPYEAEDFVCDYHLEMLSLSQDQQNPSCIQFDDSNWQLHLTSLKPLGLNVLLNLCDASVTERLCRFSDHLCNIALQESHSAVLPVHVPWGLCELARLIGFTPGAKELFKQENHLALYRLPSAETMKETSLGRLSCVTKRRPPLSHMISLFIKDTTTSTEQMLSHGTADVVLEACTDFWDGADIYPLSGSDRKKVLDFYQRACLSGYCSAFAYKP

SEQ ID NO: 91987 - protein, 125 aa, Homo sapiens
  Payload ID: 18425
  Gene Name: transmembrane protein 94
  ENSP ID: ENSP00000463620
MDLKEKHLGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVE

SEQ ID NO: 91988 - protein, 1007 aa, Homo sapiens [sequence omitted]

SEQ ID NO: 91989 - protein, 88 aa, Homo sapiens
  Payload ID: 18425
  Gene Name: transmembrane protein 94
  ENSP ID: ENSP00000464370
MSKASPSSLLAKFSEDTLSSYTEAVSSQEMLRCIWGHFLRVLGGTSPTLSHSSSLLHSLGSVTVLCCVDKQGILSWPNPSPETVLFFS

SEQ ID NO: 91990 - protein, 73 aa, Homo sapiens
  Payload ID: 18425
  Gene Name: transmembrane protein 94
  ENSP ID: ENSP00000464375
  MOD_RES (1)..(1): Any amino acid
XRDALLAGSLNNTLHLSNEQERGDWPGEAPKPPEPYSHHKAHGRSKHPSGSNVSFSRDTEGGEEEPSKLLPVS

SEQ ID NO: 91991 - protein, 295 aa, Homo sapiens
  Payload ID: 18425
  Gene Name: transmembrane protein 94
  ENSP ID: ENSP00000464437
YATSISMAQASDGLSPLQLSGQLNSLPCSLTFRQEETISIIRLIEQFLSCLVQLPPLLSTTDILWLSCFCYPLLSISLLGKPPHSSIMSMATGKNLQSIPKKTQHYFLLCFLLKFSLTISSCLICFGFTLQSFCDSSRDRNLTNCSSVMLPSNDDRAPAWFEDFANGLLSAQKLTAALIVLHTVFISITHVHRTKPLWRKSPLTNLWWAVTVPVVLLGQVVQTAVDLQLWTHRDSHVHFGLEDVPLLTWLLGCLSLVLVVVTNEIVKLHEIRVRVRYQKRQKLQFETKLGMNSPF

SEQ ID NO: 91992 - protein, 121 aa, Homo sapiens
  Payload ID: 18425
  Gene Name: transmembrane protein 94
  ENSP ID: ENSP00000464479
MDLKEKHLGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKR

SEQ ID NO: 91993 - protein, 56 aa, Homo sapiens
  Payload ID: 18425
  Gene Name: transmembrane protein 94
  ENSP ID: ENSP00000464491
  MOD_RES (1)..(1): Any amino acid
XLLLNLVLIGRQDRLKRREVERRLRGIIDQIQDGAWTWPCPDQSLPWTMSGSQCSR

SEQ ID NO: 91994 - protein, 256 aa, Homo sapiens
  Payload ID: 18425
  Gene Name: transmembrane protein 94
  ENSP ID: ENSP00000464679
EMLRCIWGHFLRVLGGTSPTLSHSSSLLHSLGSVTVLCCVDKQGILSWPNPSPETVLFFSGKVEPPHSSHEDLTDGLSTRSFCHPEVEEEPHERDALLAGSLNNTLHLSNEQERGDWPGEAPKPPEPYSHHKAHGRSKHPSGSNVSFSRDTEGGEEEPSKTQPGMESDPYEAEDFVCDYHLEMLSLSQDQQNPSCIQFDDSNWQLHLTSLKPLGLNVLLNLCDASVTERLCRFSDHLCNIALQESHSAVLPVHVPW

SEQ ID NO: 91995 - protein, 184 aa, Homo sapiens
  Payload ID: 18426
  Gene Name: transmembrane protein 95
  Uniprot ID: Q3KNT9
  ENSP ID: ENSP00000331466
MWRLALGGVFLAAAQACVFCRLPAHDLSGRLARLCSQMEARQKECGASPDFSAFALDEVSMNKVTEKTHRVLRVMEIKEAVSSLPSYWSWLRKTKLPEYTREALCPPACPLPLLSPAGGSTTLYNCSTCKGTEVSCWPRKRCFPGSQDLWEAKILLLSIFGAFLLLGVLSLLVESHHLQAKSGL

SEQ ID NO: 91996 - protein, 203 aa, Homo sapiens
  Payload ID: 18426
  Gene Name: transmembrane protein 95
  Uniprot ID: Q3KNT9
  ENSP ID: ENSP00000374632
MWRLALGGVFLAAAQACVFCRLPAHDLSGRLARLCSQMEARQKECGASPDFSAFALDEVSMNKVTEKTHRVLRVMEIKEAVSSLPSYWSWLRKTKLPEYTREALCPPACRGSTTLYNCSTCKGTEVSCWPRKRCFPGSLGSQDSAPLHLRSFPASGCSEPPGGVPPPPSKKWLVKTLKTSQPPALRGMHSQLPHPLEGNQSAP

SEQ ID NO: 91997 - protein, 176 aa, Homo sapiens
  Payload ID: 18426
  Gene Name: transmembrane protein 95
  Uniprot ID: Q3KNT9
  ENSP ID: ENSP00000460828
MWRLALGGVFLAAAQACVFCRLPAHDLSGRLARLCSQMEARQKECGASPDFSAFALDEVSMNKVTEKTHRVLRVMEIKEAVSSLPSYWSWLRKTKLPEYTREALCPPACRGSTTLYNCSTCKGTEVSCWPRKRCFPGSQDLWEAKILLLSIFGAFLLLGVLSLLVESHHLQAKSGL

SEQ ID NO: 91998 - protein, 176 aa, Homo sapiens
  Payload ID: 18427
  Gene Name: transmembrane protein 97
  Uniprot ID: Q5BJF2
  ENSP ID: ENSP00000226230
MGAPATRRCVEWLLGLYFLSHIPITLFMDLQAVLPRELYPVEFRNLLKWYAKEFKDPLLQEPPAWFKSFLFCELVFQLPFFPIATYAFLKGSCKWIRTPAIIYSVHTMTTLIPILSTFLFEDFSKASGFKGQRPETLHERLTLVSVYAPYLLIPFILLIFMLRSPYYKYEEKRKKK

SEQ ID NO: 91999 - protein, 92 aa, Homo sapiens
  Payload ID: 18427
  Gene Name: transmembrane protein 97
  ENSP ID: ENSP00000462827
MGAPATRRCVEWLLGLYFLSHIPITLFMDLQAVLPRELYPVEFRNLLKWYAKEFKDPLLQEPPAWFKSFLFCELVFQLPFFPIATYAFLKGW

SEQ ID NO: 92000 - protein, 118 aa, Homo sapiens
  Payload ID: 18427
  Gene Name: transmembrane protein 97
  ENSP ID: ENSP00000462924
GVAAGPLLPQPHPHHPVHGPAGGAAARALPSRGSCKWIRTPAIIYSVHTMTTLIPILSTFLFEDFSKASGFKGQRPETLHERLTLVSVYAPYLLIPFILLIFMLRSPYYKYEEKRKKK

SEQ ID NO: 92001 - protein, 69 aa, Homo sapiens
  Payload ID: 18427
  Gene Name: transmembrane protein 97
  ENSP ID: ENSP00000466211
MTTLIPILSTFLFEDFSKASGFKGQRPETLHERLTLVSVYAPYLLIPFILLIFMLRSPYYKYEEKRKKK

SEQ ID NO: 92002 - protein, 69 aa, Homo sapiens; identical to SEQ ID NO: 92001
  Payload ID: 18427
  Gene Name: transmembrane protein 97
  ENSP ID: ENSP00000466987

SEQ ID NO: 92003 - protein, 201 aa, Homo sapiens
  Payload ID: 18428
  Gene Name: transmembrane protein 98
  ENSP ID: ENSP00000261713
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPRTTALLLSVSHLVLVTRNACHLTGGLDWIDQSLSAAEEHLEVLREAALASEPDKGLPGPEGFLQ

SEQ ID NO: 92004 - protein, 226 aa, Homo sapiens
  Payload ID: 18428
  Gene Name: transmembrane protein 98
  Uniprot ID: Q9Y2Y6
  ENSP ID: ENSP00000378138
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPRVDDVVKSMYPPLDPKLLDARTTALLLSVSHLVLVTRNACHLTGGLDWIDQSLSAAEEHLEVLREAALASEPDKGLPGPEGFLQEQSAI

SEQ ID NO: 92005 - protein, 137 aa, Homo sapiens
  Payload ID: 18428
  Gene Name: transmembrane protein 98
  ENSP ID: ENSP00000398446
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISP

SEQ ID NO: 92006 - protein, 222 aa, Homo sapiens
  Payload ID: 18428
  Gene Name: transmembrane protein 98
  ENSP ID: ENSP00000406394
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPRVDDVVKSMYPPLDPKLLDARTTALLLSVSHLVLVTRNACHLTGGLDWIDQSLSAAEEHLEVLREAALASEPDKGLPGPEGFLQE

SEQ ID NO: 92007 - protein, 226 aa, Homo sapiens; identical to SEQ ID NO: 92004
  Payload ID: 18428
  Gene Name: transmembrane protein 98
  Uniprot ID: Q9Y2Y6
  ENSP ID: ENSP00000463245

SEQ ID NO: 92008 - protein, 93 aa, Homo sapiens
  Payload ID: 18428
  Gene Name: transmembrane protein 98
  ENSP ID: ENSP00000463539
METVVIVAIGVLATIFLASFAALVLVCRQRYCRPRDLLQRYDSKPIVDLIGAMETQSEPSELELDDVVITNPHIEAILENEDWIEDASGLMSH

SEQ ID NO: 92009 - protein, 138 aa, Homo sapiens
  Payload ID: 18428
  Gene Name: transmembrane protein 98
  ENSP ID: ENSP00000464537
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPR

SEQ ID NO: 92010 - protein, 258 aa, Homo sapiens
  Payload ID: 18429
  Gene Name: transmembrane protein 99
  Uniprot ID: Q8N816
  ENSP ID: ENSP00000301665
MVGILPLCCSGCVPSLCCSSYVPSVAPTAAHSVRVPHSAGHCGQRVLACSLPQVFLKPWIFVEHFSSWLSLELFSFLRYLGTLLCACGHRLREGLLLPCLLGVGSWLLFNNWTGGSWFSLHLQQVSLSQGSHVAAFLPEAIGPGVPVPVSGESTSAQQSHAGWQLSAEADACPSVLYSEVLEWNKNINTYTSFHDFCLILGIFLFCFVLAVIGLPYIKPGLSLSVALLWQSLILLSSLVQQDSQVHTWGCLFSTFTST

SEQ ID NO: 92011 - protein, 189 aa, Homo sapiens
  Payload ID: 18429
  Gene Name: transmembrane protein 99
  Uniprot ID: Q8N816
  ENSP ID: ENSP00000390036
MVGILPLCCSGCVPSLCCSSYVPSVAPTAAHSVRVPHSAGHCGQRVLACSLPQVFLKPWIFVEHFSSWLSLELFSFLRYLGTLLCACGHRLREGLLLPCLLGVGSWLLFNNWTGGSWFSLHLQQVSLSQGSHVAAFLPEAIGPGVPVPVSGESTSAQQSHAGWQLSAEADACPSVLYSEVLEWNKNINT

SEQ ID NO: 92012 - protein, 258 aa, Homo sapiens; identical to SEQ ID NO: 92010
  Payload ID: 18429
  Gene Name: transmembrane protein 99
  Uniprot ID: Q8N816
  ENSP ID: ENSP00000482364

SEQ ID NO: 92013 - protein, 380 aa, Homo sapiens
  Payload ID: 18430
  Gene Name: transmembrane protein with EGF-like and two follistatin-like domains 1
  Uniprot ID: Q8IYR6
  ENSP ID: ENSP00000364013
MGAAAAEAPLRLPAAPPLAFCCYTSVLLLFAFSLPGSRASNQPPGGGGGSGGDCPGGKGKSINCSELNVRESDVRVCDESSCKYGGVCKEDGDGLKCACQFQCHTNYIPVCGSNGDTYQNECFLRRAACKHQKEITVIARGPCYSDNGSGSGEGEEEGSGAEVHRKHSKCGPCKYKAECDEDAENVGCVCNIDCSGYSFNPVCASDGSSYNNPCFVREASCIKQEQIDIRHLGHCTDTDDTSLLGKKDDGLQYRPDVKDASDQREDVYIGNHMPCPENLNGYCIHGKCEFIYSTQKASCRCESGYTGQHCEKTDFSILYVVPSRQKLTHVLIAAIIGAVQIAIIVAIVMCITRKCPKNNRGRRQKQNLGHFTSDTSSRMV

SEQ ID NO: 92014 - protein, 374 aa, Homo sapiens
  Payload ID: 18431
  Gene Name: transmembrane protein with EGF-like and two follistatin-like domains 2
  Uniprot ID: Q9UIK5
  ENSP ID: ENSP00000272771
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRKCPRSNRIHRQKQNTGHYSSDNTTRASTRLI

SEQ ID NO: 92015 - protein, 346 aa, Homo sapiens
  Payload ID: 18431
  Gene Name: transmembrane protein with EGF-like and two follistatin-like domains 2
  Uniprot ID: Q9UIK5
  ENSP ID: ENSP00000376128
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRAKL

SEQ ID NO: 92016 - protein, 175 aa, Homo sapiens
  Payload ID: 18431
  Gene Name: transmembrane protein with EGF-like and two follistatin-like domains 2
  Uniprot ID: Q9UIK5
  ENSP ID: ENSP00000386871
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGGRSCLFTYLKIYWWILLCIFTYVCSISDI

SEQ ID NO: 92017 - protein, 453 aa, Homo sapiens
  Payload ID: 18432
  Gene Name: transmembrane protein with metallophosphoesterase domain
  Uniprot ID: Q6ZT21
  ENSP ID: ENSP00000343398
MAIFRQLSLGAKATLAAVTVFVSMIASRSYLAESLELRAWRWLLRLQLALFVNSLLLIGSLYIWRSTVSNLCHSPAAESTCFQLWKVVVLAFLALAHSSFFTMFFLVAEEPYLFSLAAYSCLGAYIIMLFFLFILSGMEQAYQLLAWRSGRVVGSLEKTRKLVLRPALAVGVTAVLSVAGILNAAQPPAVKTVEVPIHQLPASMNNLKIVLLSDIHLGPTVGRTKMEMFVRMVNVLEPDITVIVGDLSDSEASVLRTAVAPLGQLHSHLGAYFVTGNHEYYTSDVSNWFALLESLHVQPLHNENVKISATRAQRGGGGSGSGSEDEDWICLAGVDDIEADILHYSGHGMDLDKALEGCSPDHTIILLAHQPLAAKRALQARPDINLILSGHTHAGQIFPLNVAAYLLNPFFAGLYQVAQATFVYVSPGTAYYGIPMRLGSRAEITELILQRSP

SEQ ID NO: 92018 - protein, 316 aa, Homo sapiens
  Payload ID: 18432
  Gene Name: transmembrane protein with metallophosphoesterase domain
  Uniprot ID: Q6ZT21
  ENSP ID: ENSP00000400715
MEQAYQLLAWRSGRVVGSLEKTRKLVLRPALAVGVTAVLSVAGILNAAQPPAVKTVEVPIHQLPASMNNLKIVLLSDIHLGPTVGRTKMEMFVRMVNVLEPDITVIVGDLSDSEASVLRTAVAPLGQLHSHLGAYFVTGNHEYYTSDVSNWFALLESLHVQPLHNENVKISATRAQRGGGGSGSGSEDEDWICLAGVDDIEADILHYSGHGMDLDKALEGCSPDHTIILLAHQPLAAKRALQARPDINLILSGHTHAGQIFPLNVAAYLLNPFFAGLYQVAQATFVYVSPGTAYYGIPMRLGSRAEITELILQRSP

SEQ ID NO: 92019 - protein, 293 aa, Homo sapiens
  Payload ID: 18433
  Gene Name: transmembrane protein, adipocyte asscociated 1
  Uniprot ID: Q86W33
  ENSP ID: ENSP00000296210
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQGTLEILYPDAHLSAEDFNIYGHGGRQFWLVSSCFFFLLCRCHNLPVLQLLRSAHLRGFPPGLLRLGAQDPLLLQMPSGRDRGARCTPTPALRCGPAGGPGGCRGCWGLSCQLLEHAVRLCRRGGLPG

SEQ ID NO: 92020 - protein, 373 aa, Homo sapiens
  Payload ID: 18433
  Gene Name: transmembrane protein, adipocyte asscociated 1
  Uniprot ID: Q86W33
  ENSP ID: ENSP00000347748
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQGTLEILYPDAHLSAEDFNIYGHGGRQFWLVSSCFFFLVYSLVVILPKTPLKERISLPSRRSFYVYAGILALLNLLQGLGSVLLCFDIIEGLCCVDATTFLYFSFFAPLIYVAFLRGFFGSEPKILFSYKCQVDETEEPDVHLPQPYAVARREGLEAAGAAGASAASYSSTQFDSAGGVAYLDDIASMPCHTGSINSTDSERWKAINA

SEQ ID NO: 92021 - protein, 239 aa, Homo sapiens
  Payload ID: 18433
  Gene Name: transmembrane protein, adipocyte asscociated 1
  Uniprot ID: Q86W33
  ENSP ID: ENSP00000377056
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQGTLEILYPDAHLSAEDFNIYGHGGRQFWLVSSCFFFLLGGASTCMRASWHCSTYCRGWGVCCCASTSSRGSAV

SEQ ID NO: 92022 - protein, 373 aa, Homo sapiens; identical to SEQ ID NO: 92020
  Payload ID: 18433
  Gene Name: transmembrane protein, adipocyte asscociated 1
  Uniprot ID: Q86W33
  ENSP ID: ENSP00000413428

SEQ ID NO: 92023 - protein, 203 aa, Homo sapiens
  Payload ID: 18433
  Gene Name: transmembrane protein, adipocyte asscociated 1
  ENSP ID: ENSP00000417113
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQGTLEILYPDAHLSAEDFNIYGHGGRQFWLVSSCFFFL

SEQ ID NO: 92024 - protein, 373 aa, Homo sapiens; identical to SEQ ID NO: 92020
  Payload ID: 18433
  Gene Name: transmembrane protein, adipocyte asscociated 1
  Uniprot ID: Q86W33
  ENSP ID: ENSP00000418298

SEQ ID NO: 92025 - protein, 225 aa, Homo sapiens
  Payload ID: 18433
  Gene Name: transmembrane protein, adipocyte asscociated 1
  ENSP ID: ENSP00000418827
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQGTLEILYPDAHLSAEDFNIYGHGGRQFWLVSSCFFFLVYSLVVILPKTPLKERISLPSV

SEQ ID NO: 92026 - protein, 41 aa, Homo sapiens
  Payload ID: 18433
  Gene Name: transmembrane protein, adipocyte asscociated 1
  ENSP ID: ENSP00000419299
MDTLEEVTWANGSTALPPPLAPNISVPHRCLLLLYEDIGTS

SEQ ID NO: 92027 - protein, 203 aa, Homo sapiens; identical to SEQ ID NO: 92023
  Payload ID: 18433
  Gene Name: transmembrane protein, adipocyte asscociated 1
  ENSP ID: ENSP00000419533

SEQ ID NO: 92028 - protein, 166 aa, Homo sapiens
  Payload ID: 18433
  Gene Name: transmembrane protein, adipocyte asscociated 1
  ENSP ID: ENSP00000419822
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQ

SEQ ID NO: 92029 - protein, 276 aa, Homo sapiens
  Payload ID: 18434
  Gene Name: transport and golgi organization 2 homolog
  Uniprot ID: Q6ICL3
  ENSP ID: ENSP00000332721
MCIIFFKFDPRPVSKNAYRLILAANRDEFYSRPSKLADFWGNNNEILSGLDMEEGKEGGTWLGISTRGKLAALTNYLQPQLDWQARGRGELVTHFLTTDVDSLSYLKKVSMEGHLYNGFNLIAADLSTAKGDVICYYGNRGEPDPIVLTPGTYGLSNALLETPWRKLCFGKQLFLEAVERSQALPKDVLIASLLDVLNNEEAQLPDPAIEDQGGEYVQPMLSKYAAVCVRCPGYGTRTNTIILVDADGHVTFTERSMMDKDLSHWETRTYEFTLQS

SEQ ID NO: 92030 - protein, 214 aa, Homo sapiens
  Payload ID: 18434
  Gene Name: transport and golgi organization 2 homolog
  Uniprot ID: Q6ICL3
  ENSP ID: ENSP00000381122
MCIIFFKFDPRPVSKNAYRLILAANRDEFYSRPSKLADFWGNNNEILSGLDMEEGKEGGTWLGISTRGKLAALTNYLQPQLDWQARGRGTYGLSNALLETPWRKLCFGKQLFLEAVERSQALPKDVLIASLLDVLNNEEAQLPDPAIEDQGGEYVQPMLSKYAAVCVRCPGYGTRTNTIILVDADGHVTFTERSMMDKDLSHWETRTYEFTLQS

SEQ ID NO: 92031 - protein, 150 aa, Homo sapiens
  Payload ID: 18434
  Gene Name: transport and golgi organization 2 homolog
  ENSP ID: ENSP00000382706
MPPKLLCAGRCVGQDGAAQAWHCPPGQGHSVWDAVRMPLGAGTPVNVQRREDSATEGSHRLILAANRDEFYSRPSKLADFWGNNNEILSGLDMEEGKEGGTWLGISTRGKLAALTNYLQPQLDWQARGRAQQRETSFATMGTEGSLILSF

SEQ ID NO: 92032 - protein, 317 aa, Homo sapiens
  Payload ID: 18434
  Gene Name: transport and golgi organization 2 homolog
  Uniprot ID: Q6ICL3
  ENSP ID: ENSP00000384827
MPPKLLCAGRCVGQDGAAQAWHCPPGQGHSVWDAVRMPLGAGTPVNVQRREDSATEGSHRLILAANRDEFYSRPSKLADFWGNNNEILSGLDMEEGKEGGTWLGISTRGKLAALTNYLQPQLDWQARGRGELVTHFLTTDVDSLSYLKKVSMEGHLYNGFNLIAADLSTAKGDVICYYGNRGEPDPIVLTPGTYGLSNALLETPWRKLCFGKQLFLEAVERSQALPKDVLIASLLDVLNNEEAQLPDPAIEDQGGEYVQPMLSKYAAVCVRCPGYGTRTNTIILVDADGHVTFTERSMMDKDLSHWETRTYEFTLQS

SEQ ID NO: 92033 - protein, 214 aa, Homo sapiens; identical to SEQ ID NO: 92030
  Payload ID: 18434
  Gene Name: transport and golgi organization 2 homolog
  Uniprot ID: Q6ICL3
  ENSP ID: ENSP00000385662

SEQ ID NO: 92034 - protein, 201 aa, Homo sapiens
  Payload ID: 18434
  Gene Name: transport and golgi organization 2 homolog
  ENSP ID: ENSP00000389797
MCIIFFKFDPRPVSKNAYRLILAANRDEFYSRPSKLADFWGNNNEILSGLDMEEGKEGGTWLGISTRGKLAALTNYLQPQLDWQARGRGELVTHFLTTDVDSLSYLKKVSMEGHLYNGFNLIAADLRQLPDPAIEDQGGEYVQPMLSKYAAVCVRCPGYGTRTNTIILVDADGHVTFTERSMMDKDLSHWETRTYEFTLQS

SEQ ID NO: 92035 - protein, 198 aa, Homo sapiens
  Payload ID: 18434
  Gene Name: transport and golgi organization 2 homolog
  Uniprot ID: Q6ICL3
  ENSP ID: ENSP00000391262
MPPKLLCAGRCVGQDGAAQAWHCPPGQGHSVWDAVRMPLGAGTPVNVQRREDSATEGSHRLILAANRDEFYSRPSKLADFWGNNNEILSGLDMEEGKEGGTWLGISTRGKLAALTNYLQPQLDWQARGRGELVTHFLTTDVDSLSYLKKVSMEGHLYNGFNLIAADLSTAKGDVICYYGNRGEPDPIVLTPEPTLSSW

SEQ ID NO: 92036 - protein, 109 aa, Homo sapiens
  Payload ID: 18434
  Gene Name: transport and golgi organization 2 homolog
  ENSP ID: ENSP00000395816
MCIIFFKFDPRPVSKNAYRLILAANRDEFYSRPSKLADFWGNNNEILSGLDMEEGKEGGTWLGISTRGKLAALTNYLQPQLDWQARGRAQQRETSFATMGTEGSLILSF

SEQ ID NO: 92037 - protein, 107 aa, Homo sapiens
  Payload ID: 18434
  Gene Name: transport and golgi organization 2 homolog
  ENSP ID: ENSP00000396182
MCIIFFKFDPRPVSKNAYRLILAANRDEFYSRPSKLADFWGNNNEILSGLDMEEGKEGGTWLGISTRGKLAALTNYLQPQLDWQARGRGSCQTRPSRTRVGSTCSPC

SEQ ID NO: 92038 - protein, 178 aa, Homo sapiens
  Payload ID: 18434
  Gene Name: transport and golgi organization 2 homolog
  Uniprot ID: Q6ICL3
  ENSP ID: ENSP00000402926
MAGHQHTWQAGSTHQLPAAAAGLAGPRASTAKGDVICYYGNRGEPDPIVLTPGTYGLSNALLETPWRKLCFGKQLFLEAVERSQALPKDVLIASLLDVLNNEEAQLPDPAIEDQGGEYVQPMLSKYAAVCVRCPGYGTRTNTIILVDADGHVTFTERSMMDKDLSHWETRTYEFTLQS

SEQ ID NO: 92039 - protein, 121 aa, Homo sapiens
  Payload ID: 18434
  Gene Name: transport and golgi organization 2 homolog
  ENSP ID: ENSP00000402966
MCIIFFKFDPRPVSKNAYRLILAANRDEFYSRPSKLADFWGNNNEILSGLDMEEGKEGGTWLGISTRGKLAALTNYLQPQLDWQARGRGGPISVFLGEEHMPAAVDTASVPCLQVNLSPTF

SEQ ID NO: 92040 - protein, 109 aa, Homo sapiens; identical to SEQ ID NO: 92036
  Payload ID: 18434
  Gene Name: transport and golgi organization 2 homolog
  ENSP ID: ENSP00000403432

SEQ ID NO: 92041 - protein, 317 aa, Homo sapiens; identical to SEQ ID NO: 92032
  Payload ID: 18434
  Gene Name: transport and golgi organization 2 homolog
  Uniprot ID: Q6ICL3
  ENSP ID: ENSP00000403645

SEQ ID NO: 92042 - protein, 226 aa, Homo sapiens
  Payload ID: 18434
  Gene Name: transport and golgi organization 2 homolog
  ENSP ID: ENSP00000411602
MCIIFFKFDPRPVSKNAYRLILAANRDEFYSRPSKLADFWGNNNEILSGLDMEEGKEGGTWLGISTRGKLAALTNYLQPQLDWQARGRGELVTHFLTTDVDSLSYLKKVSMEGHLYNGFNLIAADLSTAKGDVICYYGNRGEPDPIVLTPGTYGLSNALLETPWRKLCFGKQLFLEAVERSQALPKDVLIASLLDVLNNEEAQLPDPAIEDQGGEYVQPMLSKYAA

SEQ ID NO: 92043 - protein, 88 aa, Homo sapiens
  Payload ID: 18434
  Gene Name: transport and golgi organization 2 homolog
  ENSP ID: ENSP00000413850
MCIIFFKFDPRPVSKNAYRLILAANRDEFYSRPSKLADFWGNNNEILSGLDMEEGKEGGTWLGISTRGKLAALTNYLQPQLDWQARGR

SEQ ID NO: 92044 - protein, 165 aa, Homo sapiens
  Payload ID: 18434
  Gene Name: transport and golgi organization 2 homolog
  ENSP ID: ENSP00000415450
MCIIFFKFDPRPVSKNAYRLILAANRDEFYSRPSKLADFWGNNNEILSGLDMEEGKEGGTWLGISTRGKLAALTNYLQPQLDWQARGRGELVTHFLTTDVDSLSYLKKVSMEGHLYNGFNLIAADLSTAKGDVICYYGNRGEPDPIVLTPGTYGLSNALLETPWR

SEQ ID NO: 92045 - protein, 1094 aa, Homo sapiens
  Payload ID: 18435
  Gene Name: transport and golgi organization 6 homolog
  Uniprot ID: Q9C0B7
  ENSP ID: ENSP00000261778
MAARQAVGSGAQETCGLDRILEALKLLLSPGGSGSSSLQVTKHDVLLATLKSNLSALEDKFLKDPQWKNLKLLRDEIADKAEWPQNSVDVTWSFTSQTLLLLLCLKETMIRLAANFNPGKPNPRTPEVAPALSPDALSISQQKTVQFVLQFVVTLGICPYLMPGVGVPLRYRTEFGAVVQDVVCFDAAPDATRRLYTSCKALLNVAQHTSLGSLIFCHHFGDIAAGLCQLGFCPTKRKLLTPAEEVLTEEERTLSRGALRDMLDQVYQPLAVRELLILQGGPPQSCTDVKTQMRCRAPAWLRRLCGQLLSERLMRPNGVQAVVRGILEGAGAGAAGGSDAEVTAADWKKCDLIAKILASCPQQSLSPENYYRDICPQVLDLFHFQDKLTARQFQRVATTTFITLSRERPHLAAKYLLQPVLAPLHRCLNTAELSESDMVPGTILVTEEELSRCIEDVFKVYVVGNEPLTVLMDSLLPVLGVLFLLYCFTKQSVSHIRSLCQEILLWILGKLERKKAIASLKGFAGLDKAVPSLHSLCQFRVATQGGIMITIKEAISDEDEDEALYQKVSSEQGRVEHLGDLLSHCQECGLAGDFFIFCLKELTHVASENETELKTEPFSSKSLLELEQHQTLLVEGQERKLLVLQLMAVLCERMSEQIFTNVTQVVDFVAATLQRACASLAHQAESTVESQTLSMSMGLVAVMLGGAVQLKSSDFAVLKQLLPLLEKVSNTYPDPVIQELAVDLRITISTHGAFATEAVSMAAQSTLNRKDLEGKIEEQQQTSHERPTDVAHSHLEQQQSHETAPQTGLQSNAPIIPQGVNEPSTTTSQKSGSVTTEQLQEVLLSAYDPQIPTRAAALRTLSHWIEQREAKALEMQEKLLKIFLENLEHEDTFVYLSAIQGVALLSDVYPEKILPDLLAQYDSSKDKHTPETRMKVGEVLMRIVRALGDMVSKYREPLIHTFLRGVRDPDGAHRASSLANLGELCQRLDFLLGSVVHEVTACLIAVAKTDGEVQVRRAAIHVVVLLLRGLSQKATEVLSAVLKDLYHLLKHVVCLEPDDVAKLHAQLALEELDDIMKNFLFPPQKLEKKIMVLP

SEQ ID NO: 92046 - protein, 37 aa, Homo sapiens
  Payload ID: 18435
  Gene Name: transport and golgi organization 6 homolog
  ENSP ID: ENSP00000462846
  MOD_RES (1)..(1): Any amino acid
XILASCPQQSLSPENYYRDICPQFFCRFWIYFTFKIN

SEQ ID NO: 92047 - protein, 27 aa, Homo sapiens
  Payload ID: 18435
  Gene Name: transport and golgi organization 6 homolog
  ENSP ID: ENSP00000463426
  MOD_RES (1)..(1): Any amino acid
XIFTNVTQVSSCHILDRSLFFFPKNKV

SEQ ID NO: 92048 - protein, 808 aa, Homo sapiens
  Payload ID: 18436
  Gene Name: transporter 1, ATP-binding cassette, sub-family B (MDR/TAP)
  Uniprot ID: Q03518
  ENSP ID: ENSP00000346206
MAELLASAGSACSWDFPRAPPSFPPPAASRGGLGGTRSFRPHRGAESPRPGRDRDGVRVPMASSRCPAPRGCRCLPGASLAWLGTVLLLLADWVLLRTALPRIFSLLVPTALPLLRVWAVGLSRWAVLWLGACGVLRATVGSKSENAGAQGWLAALKPLAAALGLALPGLALFRELISWGAPGSADSTRLLHWGSHPTAFVVSYAAALPAAALWHKLGSLWVPGGQGGSGNPVRRLLGCLGSETRRLSLFLVLVVLSSLGEMAIPFFTGRLTDWILQDGSADTFTRNLTLMSILTIASAVLEFVGDGIYNNTMGHVHSHLQGEVFGAVLRQETEFFQQNQTGNIMSRVTEDTSTLSDSLSENLSLFLWYLVRGLCLLGIMLWGSVSLTMVTLITLPLLFLLPKKVGKWYQLLEVQVRESLAKSSQVAIEALSAMPTVRSFANEEGEAQKFREKLQEIKTLNQKEAVAYAVNSWTTSISGMLLKVGILYIGGQLVTSGAVSSGNLVTFVLYQMQFTQAVEVLLSIYPRVQKAVGSSEKIFEYLDRTPRCPPSGLLTPLHLEGLVQFQDVSFAYPNRPDVLVLQGLTFTLRPGEVTALVGPNGSGKSTVAALLQNLYQPTGGQLLLDGKPLPQYEHRYLHRQVAAVGQEPQVFGRSLQENIAYGLTQKPTMEEITAAAVKSGAHSFISGLPQGYDTEVDEAGSQLSGGQRQAVALARALIRKPCVLILDDATSALDANSQLQVEQLLYESPERYSRSVLLITQHLSLVEQADHILFLEGGAIREGGTHQQLMEKKGCYWAMVQAPADAPE

SEQ ID NO: 92049 - protein, 808 aa, Homo sapiens; identical to SEQ ID NO: 92048
  Payload ID: 18436
  Gene Name: transporter 1, ATP-binding cassette, sub-family B (MDR/TAP)
  Uniprot ID: Q03518
  ENSP ID: ENSP00000372722

SEQ ID NO: 92050 - protein, 808 aa, Homo sapiens; identical to SEQ ID NO: 92048
  Payload ID: 18436
  Gene Name: transporter 1, ATP-binding cassette, sub-family B (MDR/TAP)
  Uniprot ID: Q03518
  ENSP ID: ENSP00000401149

SEQ ID NO: 92051 - protein, 808 aa, Homo sapiens; identical to SEQ ID NO: 92048
  Payload ID: 18436
  Gene Name: transporter 1, ATP-binding cassette, sub-family B (MDR/TAP)
  Uniprot ID: Q03518
  ENSP ID: ENSP00000402316

SEQ ID NO: 92052 - protein, 808 aa, Homo sapiens; identical to SEQ ID NO: 92048
  Payload ID: 18436
  Gene Name: transporter 1, ATP-binding cassette, sub-family B (MDR/TAP)
  Uniprot ID: Q03518
  ENSP ID: ENSP00000405356

SEQ ID NO: 92053 - protein, 808 aa, Homo sapiens
  Payload ID: 18436
  Gene Name: transporter 1, ATP-binding cassette, sub-family B (MDR/TAP)
  ENSP ID: ENSP00000412933
MAELLASAGSACSWDFPRAPPSFPPPAASRGGLGGTRSFRPHRGAESPRPGRDRDGVRVPMASSRCPAPRGCRCLPGASLAWLGTVLLLLADWVLLRTALPRIFSLLVPTALPLLRVWAVGLSRWAVLWLGACGVLRATGGSKSENAGAQGWLAALKPLAAALGLALPGLALFRELISWGAPGSADSTRLLHWGSHPTAFVVSYAAALPAAALWHKLGSLWVPGGQGGSGNPVRRLLGCLGSETRRLSLFLVLVVLSSLGEMAIPFFTGRLTDWILQDGSADTFTRNLTLMSILTIASAVLEFVGDGIYNNTMGHVHSHLQGEVFGAVLRQETEFFQQNQTGNIMSRVTEDTSTLSDSLSENLSLFLWYLVRGLCLLGIMLWGSVSLTMVTLITLPLLFLLPKKVGKWYQLLEVQVRESLAKSSQVAIEALSAMPTVRSFANEEGEAQKFREKLQEIKTLNQKEAVAYAVNSWTTSISGMLLKVGILYIGGQLVTSGAVSSGNLVTFVLYQMQFTQAVEVLLSIYPRVQKAVGSSEKIFEYLDRTPRCPPSGLLTPLHLEGLVQFQDVSFAYPNRPDVLVLQGLTFTLRPGEVTALVGPNGSGKSTVAALLQNLYQPTGGQLLLDGKPLPQYEHRYLHRQVAAVGQEPQVFGRSLQENIAYGLTQKPTMEEITAAAVKSGAHSFISGLPQGYDTEVDEAGSQLSGGQRQAVALARALIRKPCVLILDDATSALDANSQLQVEQLLYESPERYSRSVLLITQHLSLVEQADHILFLEGGAIREGGTHQQLMEKKGCYWAMVQAPADAPE

SEQ ID NO: 92054 - protein, 808 aa, Homo sapiens; identical to SEQ ID NO: 92048
  Payload ID: 18436
  Gene Name: transporter 1, ATP-binding cassette, sub-family B (MDR/TAP)
  Uniprot ID: Q03518
  ENSP ID: ENSP00000413080

SEQ ID NO: 92055 - protein, 808 aa, Homo sapiens; identical to SEQ ID NO: 92048
  Payload ID: 18436
  Gene Name: transporter 1, ATP-binding cassette, sub-family B (MDR/TAP)
  Uniprot ID: Q03518
  ENSP ID: ENSP00000415660

SEQ ID NO: 92056 - protein, 686 aa, Homo sapiens
  Payload ID: 18437
  Gene Name: transporter 2, ATP-binding cassette, sub-family B (MDR/TAP)
  Uniprot ID: Q03519
  ENSP ID: ENSP00000364032
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLVRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNIAYGLQSCEDDKVMAAAQAAHADDFIQEMEHGIYTDVGEKGSQLAAGQKQRLAIARALVRDPRVLILDEATSALDVQCEQALQDWNSRGDRTVLVIAHRLQTVQRAHQILVLQEGKLQKLAQL

SEQ ID NO: 92057 - protein, 653 aa, Homo sapiens
  Payload ID: 18437
  Gene Name: transporter 2, ATP-binding cassette, sub-family B (MDR/TAP)
  Uniprot ID: Q03519
  ENSP ID: ENSP00000364034
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLVRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNIAYGLQSCEDDKVMAAAQAAHADDFIQEMEHGIYTDVGEKGSQLAAGQKQRLAIARALVRDPRVLILDEATSALDVQCEQAKTLWKFMIF

SEQ ID NO: 92058 - protein, 686 aa, Homo sapiens; identical to SEQ ID NO: 92056
  Payload ID: 18437
  Gene Name: transporter 2, ATP-binding cassette, sub-family B (MDR/TAP)
  Uniprot ID: Q03519
  ENSP ID: ENSP00000372599

SEQ ID NO: 92059 - protein, 653 aa, Homo sapiens; identical to SEQ ID NO: 92057
  Payload ID: 18437
  Gene Name: transporter 2, ATP-binding cassette, sub-family B (MDR/TAP)
  Uniprot ID: Q03519
  ENSP ID: ENSP00000372600

SEQ ID NO: 92060 - protein, 686 aa, Homo sapiens; identical to SEQ ID NO: 92056
  Payload ID: 18437
  Gene Name: transporter 2, ATP-binding cassette, sub-family B (MDR/TAP)
  Uniprot ID: Q03519
  ENSP ID: ENSP00000372726

SEQ ID NO: 92061 - protein, 653 aa, Homo sapiens; identical to SEQ ID NO: 92057
  Payload ID: 18437
  Gene Name: transporter 2, ATP-binding cassette, sub-family B (MDR/TAP)
  Uniprot ID: Q03519
  ENSP ID: ENSP00000372727

SEQ ID NO: 92062 - protein, 653 aa, Homo sapiens; identical to SEQ ID NO: 92057
  Payload ID: 18437
  Gene Name: transporter 2, ATP-binding cassette, sub-family B (MDR/TAP)
  Uniprot ID: Q03519
  ENSP ID: ENSP00000387553

SEQ ID NO: 92063 - protein, 686 aa, Homo sapiens
  Payload ID: 18437
  Gene Name: transporter 2, ATP-binding cassette, sub-family B (MDR/TAP)
  Uniprot ID: Q03519
  ENSP ID: ENSP00000390013
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLIRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNITYGLQSCEDDKVMAAAQAAHADDFIQEMEHGIYTDVGEKGSQLAAGQKQRLAIARALVRDPRVLILDEATSALDVQCEQALQDWNSRGDRTVLVIAHRLQTVQRAHQILVLQEGKLQKLAQL

SEQ ID NO: 92064 - protein, 653 aa, Homo sapiens; identical to SEQ ID NO: 92057
  Payload ID: 18437
  Gene Name: transporter 2, ATP-binding cassette, sub-family B (MDR/TAP)
  Uniprot ID: Q03519
  ENSP ID: ENSP00000392172

SEQ ID NO: 92065 - protein, 703 aa, Homo sapiens
  Payload ID: 18437
  Gene Name: transporter 2, ATP-binding cassette, sub-family B (MDR/TAP)
  ENSP ID: ENSP00000393580
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLVRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNIAYGLQSCEDDKVMAAAQAAHADDFIQEMEHGIYTDVGEKGSQLAAGQKQRLAIARALVRDPRVLILDEATSALDVQCEQALQDWNSRGDRTVLVIAHRLQAVQRAHQILVLQEGKLQKLAQLQEGQDLYSRLVQQRLMD

SEQ ID NO: 92066 - protein, 686 aa, Homo sapiens; identical to SEQ ID NO: 92056
  Payload ID: 18437
  Gene Name: transporter 2, ATP-binding cassette, sub-family B (MDR/TAP)
  Uniprot ID: Q03519
  ENSP ID: ENSP00000394101

SEQ ID NO: 92067 - protein, 653 aa, Homo sapiens; identical to SEQ ID NO: 92057
  Payload ID: 18437
  Gene Name: transporter 2, ATP-binding cassette, sub-family B (MDR/TAP)
  Uniprot ID: Q03519
  ENSP ID: ENSP00000396156

SEQ ID NO: 92068 - protein, 653 aa, Homo sapiens; identical to SEQ ID NO: 92057
  Payload ID: 18437
  Gene Name: transporter 2, ATP-binding cassette, sub-family B (MDR/TAP)
  Uniprot ID: Q03519
  ENSP ID: ENSP00000401377

SEQ ID NO: 92069 - protein, 703 aa, Homo sapiens; identical to SEQ ID NO: 92065
  Payload ID: 18437
  Gene Name: transporter 2, ATP-binding cassette, sub-family B (MDR/TAP)
  ENSP ID: ENSP00000406540

SEQ ID NO: 92070 - protein, 653 aa, Homo sapiens
  Payload ID: 18437
  Gene Name: transporter 2, ATP-binding cassette, sub-family B (MDR/TAP)
  ENSP ID: ENSP00000411622
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLIRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNITYGLQSCEDDKVMAAAQAAHADDFIQEMEHGIYTDVGEKGSQLAAGQKQRLAIARALVRDPRVLILDEATSALDVQCEQAKTLWKFMIF

SEQ ID NO: 92071 - protein, 703 aa, Homo sapiens; identical to SEQ ID NO: 92065
  Payload ID: 18437
  Gene Name: transporter 2, ATP-binding cassette, sub-family B (MDR/TAP)
  ENSP ID: ENSP00000416471

SEQ ID NO: 92072 - protein, 702 aa, Homo sapiens
  Payload ID: 18437
  Gene Name: transporter 2, ATP-binding cassette, sub-family B (MDR/TAP)
  ENSP ID: ENSP00000478007
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLIRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNITYGLQSCEDDKVMAAAQAAHADDFIQEMEHGIYTDVGEKGSQLAAGQKQRLAIARALVRDPRVLILDEATSALDVQCEQALQDWNSRGDRTVLVIAHRLQTVQRAHQILVLQEGKLQKLAQLEGQDLYSRLVQQRLMD

SEQ ID NO: 92073 - protein, 702 aa, Homo sapiens
  Payload ID: 18437
  Gene Name: transporter 2, ATP-binding cassette, sub-family B (MDR/TAP)
  ENSP ID: ENSP00000479290
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLVRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNIAYGLQSCEDDKVMAAAQAAHADDFIQEMEHGIYTDVGEKGSQLAAGQKQRLAIARALVRDPRVLILDEATSALDVQCEQALQDWNSRGDRTVLVIAHRLQTVQRAHQILVLQEGKLQKLAQLEGQDLYSRLVQQRLMD

SEQ ID NO: 92074 - protein, 702 aa, Homo sapiens; identical to SEQ ID NO: 92073
  Payload ID: 18437
  Gene Name: transporter 2, ATP-binding cassette, sub-family B (MDR/TAP)
  ENSP ID: ENSP00000479683

SEQ ID NO: 92075 - protein, 702 aa, Homo sapiens; identical to SEQ ID NO: 92073
  Payload ID: 18437
  Gene Name: transporter 2, ATP-binding cassette, sub-family B (MDR/TAP)
  ENSP ID: ENSP00000480952

SEQ ID NO: 92076 - protein, 702 aa, Homo sapiens; identical to SEQ ID NO: 92073
  Payload ID: 18437
  Gene Name: transporter 2, ATP-binding cassette, sub-family B (MDR/TAP)
  ENSP ID: ENSP00000481712

SEQ ID NO: 92077 - protein, 898 aa, Homo sapiens
  Payload ID: 18438
  Gene Name: transportin 1
  Uniprot ID: Q92973
  ENSP ID: ENSP00000336712
MVWDRQTKMEYEWKPDEQGLQQILQLLKESQSPDTTIQRTVQQKLEQLNQYPDFNNYLIFVLTKLKSEDEPTRSLSGLILKNNVKAHFQNFPNGVTDFIKSECLNNIGDSSPLIRATVGILITTIASKGELQNWPDLLPKLCSLLDSEDYNTCEGAFGALQKICEDSAEILDSDVLDRPLNIMIPKFLQFFKHSSPKIRSHAVACVNQFIISRTQALMLHIDSFIENLFALAGDEEPEVRKNVCRALVMLLEVRMDRLLPHMHNIVEYMLQRTQDQDENVALEACEFWLTLAEQPICKDVLVRHLPKLIPVLVNGMKYSDIDIILLKGDVEEDETIPDSEQDIRPRFHRSRTVAQQHDEDGIEEEDDDDDEIDDDDTISDWNLRKCSAAALDVLANVYRDELLPHILPLLKELLFHHEWVVKESGILVLGAIAEGCMQGMIPYLPELIPHLIQCLSDKKALVRSITCWTLSRYAHWVVSQPPDTYLKPLMTELLKRILDSNKRVQEAACSAFATLEEEACTELVPYLAYILDTLVFAFSKYQHKNLLILYDAIGTLADSVGHHLNKPEYIQMLMPPLIQKWNMLKDEDKDLFPLLECLSSVATALQSGFLPYCEPVYQRCVNLVQKTLAQAMLNNAQPDQYEAPDKDFMIVALDLLSGLAEGLGGNIEQLVARSNILTLMYQCMQDKMPEVRQSSFALLGDLTKACFQHVKPCIADFMPILGTNLNPEFISVCNNATWAIGEISIQMGIEMQPYIPMVLHQLVEIINRPNTPKTLLENTAITIGRLGYVCPQEVAPMLQQFIRPWCTSLRNIRDNEEKDSAFRGICTMISVNPSGVIQDFIFFCDAVASWINPKDDLRDMFCKILHGFKNQVGDENWRRFSDQFPLPLKERLAAFYGV

SEQ ID NO: 92078 - protein, 890 aa, Homo sapiens
  Payload ID: 18438
  Gene Name: transportin 1
  Uniprot ID: Q92973
  ENSP ID: ENSP00000425118
MEYEWKPDEQGLQQILQLLKESQSPDTTIQRTVQQKLEQLNQYPDFNNYLIFVLTKLKSEDEPTRSLSGLILKNNVKAHFQNFPNGVTDFIKSECLNNIGDSSPLIRATVGILITTIASKGELQNWPDLLPKLCSLLDSEDYNTCEGAFGALQKICEDSAEILDSDVLDRPLNIMIPKFLQFFKHSSPKIRSHAVACVNQFIISRTQALMLHIDSFIENLFALAGDEEPEVRKNVCRALVMLLEVRMDRLLPHMHNIVEYMLQRTQDQDENVALEACEFWLTLAEQPICKDVLVRHLPKLIPVLVNGMKYSDIDIILLKGDVEEDETIPDSEQDIRPRFHRSRTVAQQHDEDGIEEEDDDDDEIDDDDTISDWNLRKCSAAALDVLANVYRDELLPHILPLLKELLFHHEWVVKESGILVLGAIAEGCMQGMIPYLPELIPHLIQCLSDKKALVRSITCWTLSRYAHWVVSQPPDTYLKPLMTELLKRILDSNKRVQEAACSAFATLEEEACTELVPYLAYILDTLVFAFSKYQHKNLLILYDAIGTLADSVGHHLNKPEYIQMLMPPLIQKWNMLKDEDKDLFPLLECLSSVATALQSGFLPYCEPVYQRCVNLVQKTLAQAMLNNAQPDQYEAPDKDFMIVALDLLSGLAEGLGGNIEQLVARSNILTLMYQCMQDKMPEVRQSSFALLGDLTKACFQHVKPCIADFMPILGTNLNPEFISVCNNATWAIGEISIQMGIEMQPYIPMVLHQLVEIINRPNTPKTLLENTAITIGRLGYVCPQEVAPMLQQFIRPWCTSLRNIRDNEEKDSAFRGICTMISVNPSGVIQDFIFFCDAVASWINPKDDLRDMFCKILHGFKNQVGDENWRRFSDQFPLPLKERLAAFYGV

SEQ ID NO: 92079 - protein, 848 aa, Homo sapiens
  Payload ID: 18438
  Gene Name: transportin 1
  Uniprot ID: Q92973
  ENSP ID: ENSP00000428899
MVWDRQTKMEYEWKPDEQGLQQILQLLKESQSPDTTIQRTVQQKLEQLNQYPDFNNYLIFVLTKLKSEGILITTIASKGELQNWPDLLPKLCSLLDSEDYNTCEGAFGALQKICEDSAEILDSDVLDRPLNIMIPKFLQFFKHSSPKIRSHAVACVNQFIISRTQALMLHIDSFIENLFALAGDEEPEVRKNVCRALVMLLEVRMDRLLPHMHNIVEYMLQRTQDQDENVALEACEFWLTLAEQPICKDVLVRHLPKLIPVLVNGMKYSDIDIILLKGDVEEDETIPDSEQDIRPRFHRSRTVAQQHDEDGIEEEDDDDDEIDDDDTISDWNLRKCSAAALDVLANVYRDELLPHILPLLKELLFHHEWVVKESGILVLGAIAEGCMQGMIPYLPELIPHLIQCLSDKKALVRSITCWTLSRYAHWVVSQPPDTYLKPLMTELLKRILDSNKRVQEAACSAFATLEEEACTELVPYLAYILDTLVFAFSKYQHKNLLILYDAIGTLADSVGHHLNKPEYIQMLMPPLIQKWNMLKDEDKDLFPLLECLSSVATALQSGFLPYCEPVYQRCVNLVQKTLAQAMLNNAQPDQYEAPDKDFMIVALDLLSGLAEGLGGNIEQLVARSNILTLMYQCMQDKMPEVRQSSFALLGDLTKACFQHVKPCIADFMPILGTNLNPEFISVCNNATWAIGEISIQMGIEMQPYIPMVLHQLVEIINRPNTPKTLLENTAITIGRLGYVCPQEVAPMLQQFIRPWCTSLRNIRDNEEKDSAFRGICTMISVNPSGVIQDFIFFCDAVASWINPKDDLRDMFCKILHGFKNQVGDENWRRFSDQFPLPLKERLAAFYGV

SEQ ID NO: 92080 - protein, 136 aa, Homo sapiens
  Payload ID: 18438
  Gene Name: transportin 1
  ENSP ID: ENSP00000430312
MVWDRQTKMEYEWKPDEQGLQQILQLLKESQSPDTTIQRTVQQKLEQLNQYPDFNNYLIFVLTKLKSEDEPTRSLSGLILKNNVKAHFQNFPNGVTDFIKSECLNNIGDSSPLIRATVGLTLLHVSISLSSVGLKL

SEQ ID NO: 92081 - protein, 193 aa, Homo sapiens
  Payload ID: 18438
  Gene Name: transportin 1
  ENSP ID: ENSP00000474059
CFQHVKPCIADFMPILGTNLNPEFISVCNNATWAIGEISIQMGIEMQPYIPMVLHQLVEIINRPNTPKTLLENTAITIGRLGYVCPQEVAPMLQQFIRPWCTSLRNIRDNEEKDSAFRGICTMISVNPSGVIQDFIFFCDAVASWINPKDDLRDMFCKILHGFKNQVGDENWRRFSDQFPLPLKERLAAFYGV

SEQ ID NO: 92082 - protein, 887 aa, Homo sapiens
  Payload ID: 18439
  Gene Name: transportin 2
  Uniprot ID: O14787
  ENSP ID: ENSP00000349321
MDWQPDEQGLQQVLQLLKDSQSPNTATQRIVQDKLKQLNQFPDFNNYLIFVLTRLKSEDEPTRSLSGLILKNNVKAHYQSFPPPVADFIKQECLNNIGDASSLIRATIGILITTIASKGELQMWPELLPQLCNLLNSEDYNTCEGAFGALQKICEDSSELLDSDALNRPLNIMIPKFLQFFKHCSPKIRSHAIACVNQFIMDRAQALMDNIDTFIEHLFALAVDDDPEVRKNVCRALVMLLEVRIDRLIPHMHSIIQYMLQRTQDHDENVALEACEFWLTLAEQPICKEVLASHLVQLIPILVNGMKYSEIDIILLKGDVEEDEAVPDSEQDIKPRFHKSRTVTLPHEAERPDGSEDAEDDDDDDALSDWNLRKCSAAALDVLANVFREELLPHLLPLLKGLLFHPEWVVKESGILVLGAIAEGCMQGMVPYLPELIPHLIQCLSDKKALVRSIACWTLSRYAHWVVSQPPDMHLKPLMTELLKRILDGNKRVQEAACSAFATLEEEACTELVPYLSYILDTLVFAFGKYQHKNLLILYDAIGTLADSVGHHLNQPEYIQKLMPPLIQKWNELKDEDKDLFPLLECLSSVATALQSGFLPYCEPVYQRCVTLVQKTLAQAMMYTQHPEQYEAPDKDFMIVALDLLSGLAEGLGGHVEQLVARSNIMTLLFQCMQDSMPEVRQSSFALLGDLTKACFIHVKPCIAEFMPILGTNLNPEFISVCNNATWAIGEICMQMGAEMQPYVQMVLNNLVEIINRPNTPKTLLENTAITIGRLGYVCPQEVAPMLQQFIRPWCTSLRNIRDNEEKDSAFRGICMMIGVNPGGVVQDFIFFCDAVASWVSPKDDLRDMFYKILHGFKDQVGEDNWQQFSEQFPPLLKERLAAFYGV

SEQ ID NO: 92083 - protein, 887 aa, Homo sapiens; identical to SEQ ID NO: 92082
  Payload ID: 18439
  Gene Name: transportin 2
  Uniprot ID: O14787
  ENSP ID: ENSP00000397379

SEQ ID NO: 92084 - protein, 897 aa, Homo sapiens
  Payload ID: 18439
  Gene Name: transportin 2
  Uniprot ID: O14787
  ENSP ID: ENSP00000407182
MDWQPDEQGLQQVLQLLKDSQSPNTATQRIVQDKLKQLNQFPDFNNYLIFVLTRLKSEDEPTRSLSGLILKNNVKAHYQSFPPPVADFIKQECLNNIGDASSLIRATIGILITTIASKGELQMWPELLPQLCNLLNSEDYNTCEGAFGALQKICEDSSELLDSDALNRPLNIMIPKFLQFFKHCSPKIRSHAIACVNQFIMDRAQALMDNIDTFIEHLFALAVDDDPEVRKNVCRALVMLLEVRIDRLIPHMHSIIQYMLQRTQDHDENVALEACEFWLTLAEQPICKEVLASHLVQLIPILVNGMKYSEIDIILLKGDVEEDEAVPDSEQDIKPRFHKSRTVTLPHEAERPDGSEDAEDDDDDDALSDWNLRKCSAAALDVLANVFREELLPHLLPLLKGLLFHPEWVVKESGILVLGAIAEGCMQGMVPYLPELIPHLIQCLSDKKALVRSIACWTLSRYAHWVVSQPPDMHLKPLMTELLKRILDGNKRVQEAACSAFATLEEEACTELVPYLSYILDTLVFAFGKYQHKNLLILYDAIGTLADSVGHHLNQPEYIQKLMPPLIQKWNELKDEDKDLFPLLECLSSVATALQSGFLPYCEPVYQRCVTLVQKTLAQAMMYTQHPEQYEAPDKDFMIVALDLLSGLAEGLGGHVEQLVARSNIMTLLFQCMQDSMPEVRQSSFALLGDLTKACFIHVKPCIAEFMPILGTNLNPEFISVCNNATWAIGEICMQMGAEMQPYVQMVLNNLVEIINRPNTPKTLLENTGRLTSPSAIPAITIGRLGYVCPQEVAPMLQQFIRPWCTSLRNIRDNEEKDSAFRGICMMIGVNPGGVVQDFIFFCDAVASWVSPKDDLRDMFYKILHGFKDQVGEDNWQQFSEQFPPLLKERLAAFYGV

SEQ ID NO: 92085 - protein, 887 aa, Homo sapiens; identical to SEQ ID NO: 92082
  Payload ID: 18439
  Gene Name: transportin 2
  Uniprot ID: O14787
  ENSP ID: ENSP00000465625

SEQ ID NO: 92086 - protein, 119 aa, Homo sapiens
  Payload ID: 18439
  Gene Name: transportin 2
  ENSP ID: ENSP00000466011
  MOD_RES (1)..(1): Any amino acid
XWVVSQPPDMHLKPLMTELLKRILDGNKRVQEAACSAFATLEEEACTELVPYLSYILDTLVFAFGKYQHKNLLILYDAIGTLADSVGHHLNQPVPESQSATPTQGAPISCSLSRNTSRS

SEQ ID NO: 92087 - protein, 56 aa, Homo sapiens
  Payload ID: 18439
  Gene Name: transportin 2
  ENSP ID: ENSP00000466421
MDWQPDEQGLQQVLQLLKDSQSPNTATQRIVQDKLKQLNQFPDFNNYLIFVLTRLK

SEQ ID NO: 92088 - protein, 109 aa, Homo sapiens
  Payload ID: 18439
  Gene Name: transportin 2
  ENSP ID: ENSP00000466446
MDWQPDEQGLQQVLQLLKDSQSPNTATQRIVQDKLKQLNQFPDFNNYLIFVLTRLKSEDEPTRSLSGLILKNNVKAHYQSFPPPVADFIKQECLNNIGDASSLIRATIG

SEQ ID NO: 92089 - protein, 85 aa, Homo sapiens
  Payload ID: 18439
  Gene Name: transportin 2
  ENSP ID: ENSP00000467115
MDWQPDEQGLQQVLQLLKDSQSPNTATQRIVQDKLKQLNQFPDFNNYLIFVLTRLKSEDEPTRSLSGLILKNNVKAHYQSFPPPV

SEQ ID NO: 92090 - protein, 766 aa, Homo sapiens
  Payload ID: 18439
  Gene Name: transportin 2
  ENSP ID: ENSP00000468101
MDWQPDEQGLQQVLQLLKDSQSPNTATQRIVQDKLKQLNQFPDFNNYLIFVLTRLKSEDEPTRSLSGLILKNNVKAHYQSFPPPVADFIKQECLNNIGDASSLIRATIGILITTIASKGELQMWPELLPQLCNLLNSEDYNTCEGAFGALQKICEDSSELLDSDALNRPLNIMIPKFLQFFKHCSPKIRSHAIACVNQFIMDRAQALMDNIDTFIEHLFALAVDDDPEVRKNVCRALVMLLEVRIDRLIPHMHSIIQYMLQRTQDHDENVALEACEFWLTLAEQPICKEVLASHLVQLIPILVNGMKYSEIDIILLKGDVEEDEAVPDSEQDIKPRFHKSRTVTLPHEAERPDGSEDAEDDDDDDALSDWNLRKCSAAALDVLANVFREELLPHLLPLLKGLLFHPEWVVKESGILVLGAIAEGCMQGMVPYLPELIPHLIQCLSDKKALVRSIACWTLSRYAHWVVSQPPDMHLKPLMTELLKRILDGNKRVQEAACSAFATLEEEACTELVPYLSYILDTLVFAFGKYQHKNLLILYDAIGTLADSVGHHLNQPEYIQKLMPPLIQKWNELKDEDKDLFPLLECLSSVATALQSGFLPYCEPVYQRCVTLVQKTLAQAMMYTQHPEQYEAPDKDFMIVALDLLSGLAEGLGGHVEQLVARSNIMTLLFQCMQDSMPEVRQSSFALLGDLTKACFIHVKPCIAEFMPILGTNLNPEFISVCNNATWAIGEICMQMGAEMQPYVQMVLNNLVEIINRPNTPKTLLE

SEQ ID NO: 92091 - protein, 897 aa, Homo sapiens; identical to SEQ ID NO: 92084
  Payload ID: 18439
  Gene Name: transportin 2
  Uniprot ID: O14787
  ENSP ID: ENSP00000468434

SEQ ID NO: 92092 - protein, 109 aa, Homo sapiens; identical to SEQ ID NO: 92088
  Payload ID: 18439
  Gene Name: transportin 2
  ENSP ID: ENSP00000468642

SEQ ID NO: 92093 - protein, 117 aa, Homo sapiens
  Payload ID: 18439
  Gene Name: transportin 2
  ENSP ID: ENSP00000468698
QDTAGKHSHHHRPLGLRVPPGGGTHAAAVHPALVHVPQEHQGQRGEGLSLPRHLHDDRCQPGGRCAASWVSPKDDLRDMFYKILHGFKDQVGEDNWQQFSEQFPPLLKERLAAFYGV

SEQ ID NO: 92094 - protein, 51 aa, Homo sapiens
  Payload ID: 18439
  Gene Name: transportin 2
  ENSP ID: ENSP00000468739
GKYQHKNLLILYDAIGTLADSVGHHLNQPGRGRDLDRQTDRPGPALALLPV

SEQ ID NO: 92095 - protein, 923 aa, Homo sapiens
  Payload ID: 18440
  Gene Name: transportin 3
  Uniprot ID: Q9Y5L0
  ENSP ID: ENSP00000265388
MEGAKPTLQLVYQAVQALYHDPDPSGKERASFWLGELQRSVHAWEISDQLLQIRQDVESCYFAAQTMKMKIQTSFYELPTDSHASLRDSLLTHIQNLKDLSPVIVTQLALAIADLALQMPSWKGCVQTLVEKYSNDVTSLPFLLEILTVLPEEVHSRSLRIGANRRTEIIEDLAFYSSTVVSLLMTCVEKAGTDEKMLMKVFRCLGSWFNLGVLDSNFMANNKLLALLFEVLQQDKTSSNLHEAASDCVCSALYAIENVETNLPLAMQLFQGVLTLETAYHMAVAREDLDKVLNYCRIFTELCETFLEKIVCTPGQGLGDLRTLELLLICAGHPQYEVVEISFNFWYRLGEHLYKTNDEVIHGIFKAYIQRLLHALARHCQLEPDHEGVPEETDDFGEFRMRVSDLVKDLIFLIGSMECFAQLYSTLKEGNPPWEVTEAVLFIMAAIAKSVDPENNPTLVEVLEGVVRLPETVHTAVRYTSIELVGEMSEVVDRNPQFLDPVLGYLMKGLCEKPLASAAAKAIHNICSVCRDHMAQHFNGLLEIARSLDSFLLSPEAAVGLLKGTALVLARLPLDKITECLSELCSVQVMALKKLLSQEPSNGISSDPTVFLDRLAVIFRHTNPIVENGQTHPCQKVIQEIWPVLSETLNKHRADNRIVERCCRCLRFAVRCVGKGSAALLQPLVTQMVNVYHVHQHSCFLYLGSILVDEYGMEEGCRQGLLDMLQALCIPTFQLLEQQNGLQNHPDTVDDLFRLATRFIQRSPVTLLRSQVVIPILQWAIASTTLDHRDANCSVMRFLRDLIHTGVANDHEEDFELRKELIGQVMNQLGQQLVSQLLHTCCFCLPPYTLPDVAEVLWEIMQVDRPTFCRWLENSLKGLPKETTVGAVTVTHKQLTDFHKQVTSAEECKQVCWALRDFTRLFR

SEQ ID NO: 92096 - protein, 957 aa, Homo sapiens
  Payload ID: 18440
  Gene Name: transportin 3
  ENSP ID: ENSP00000418267
MEGAKPTLQLVYQAVQALYHDPDPSGKERASFWLGELQRSVHAWEISDQLLQIRQDVESCYFAAQTMKMKIQTSFYELPTDSHASLRDSLLTHIQNLKDLSPVIVTQLALAIADLALQMPSWKGCVQTLVEKYSNDVTSLPFLLEILTVLPEEVHSRSLRIGANRRTEIIEDLAFYSSTVVSLLMTCVEKAGTDEKMLMKVFRCLGSWFNLGVLDSNFMANNKLLALLFEVLQQDKTSSNLHEAASDCVCSALYAIENVETNLPLAMQLFQGVLTLETAYHMAVAREDLDKVLNYCRIFTELCETFLEKIVCTPGQGLGDLRTLELLLICAGHPQYEVVEISFNFWYRLGEHLYKTNDEVIHGIFKAYIQRLLHALARHCQLEPDHEGVPEETDDFGEFRMRVSDLVKDLIFLIGSMECFAQLYSTLKEGNPPWEVTEAVLFIMAAIAKSVDPKKPFSNAVCRHSLLFGQNITSEISNCEYLPPVLRENNPTLVEVLEGVVRLPETVHTAVRYTSIELVGEMSEVVDRNPQFLDPVLGYLMKGLCEKPLASAAAKAIHNICSVCRDHMAQHFNGLLEIARSLDSFLLSPEAAVGLLKGTALVLARLPLDKITECLSELCSVQVMALKKLLSQEPSNGISSDPTVFLDRLAVIFRHTNPIVENGQTHPCQKVIQEIWPVLSETLNKHRADNRIVERCCRCLRFAVRCVGKGSAALLQPLVTQMVNVYHVHQHSCFLYLGSILVDEYGMEEGCRQGLLDMLQALCIPTFQLLEQQNGLQNHPDTVDDLFRLATRFIQRSPVTLLRSQVVIPILQWAIASTTLDHRDANCSVMRFLRDLIHTGVANDHEEDFELRKELIGQVMNQLGQQLVSQLLHTCCFCLPPYTLPDVAEVLWEIMQVDRPTFCRWLENSLKGLPKETTVGAVTVTHKQLTDFHKQVTSAEECKQVCWALRDFTRLFR

SEQ ID NO: 92097 - protein, 859 aa, Homo sapiens
  Payload ID: 18440
  Gene Name: transportin 3
  Uniprot ID: Q9Y5L0
  ENSP ID: ENSP00000418646
MEGAKPTLQLVYQAVQALYHDPDPSGKERASFWLGELQRSVHAWEISDQLLQIRQDVESCYFAAQTMKMKIQTSFYELPTDSHASLRDSLLTHIQNLKDLSPVIVTQLALAIADLALQMPSWKGCVQTLVEKYSNDVTSLPFLLEILTVLPEEVHSRSLRIGANRRTEIIEDLAFYSSTVVSLLMTCVEKAGTDEKMLMKVFRCLGSWFNLGVLDSNFMANNKLLALLFEVLQQDKTSSNLHEAASDCVCSALYAIENVETNLPLAMQLFQGVLTLETAYHMAVAREDLDKVLNYCRIFTELCETFLEKIVCTPGQGLGDLRTLELLLICAGHPQYEVVEISFNFWYRLGEHLYKTNDEVIHGIFKAYIQRLLHALARHCQLEPDHEGVPEETDDFGEFRMRVSDLVKDLIFLIGSMECFAQLYSTLKEGNPPWEVTEAVLFIMAAIAKSVDPENNPTLVEVLEGVVRLPETVHTAVRYTSIELVGEMSEVVDRNPQFLGTALVLARLPLDKITECLSELCSVQVMALKKLLSQEPSNGISSDPTVFLDRLAVIFRHTNPIVENGQTHPCQKVIQEIWPVLSETLNKHRADNRIVERCCRCLRFAVRCVGKGSAALLQPLVTQMVNVYHVHQHSCFLYLGSILVDEYGMEEGCRQGLLDMLQALCIPTFQLLEQQNGLQNHPDTVDDLFRLATRFIQRSPVTLLRSQVVIPILQWAIASTTLDHRDANCSVMRFLRDLIHTGVANDHEEDFELRKELIGQVMNQLGQQLVSQLLHTCCFCLPPYTLPDVAEVLWEIMQVDRPTFCRWLENSLKGLPKETTVGAVTVTHKQLTDFHKQVTSAEECKQVCWALRDFTRLFR

SEQ ID NO: 92098 - protein, 857 aa, Homo sapiens
  Payload ID: 18440
  Gene Name: transportin 3
  ENSP ID: ENSP00000420089
MKMKIQTSFYELPTDSHASLRDSLLTHIQNLKDLSPVIVTQLALAIADLALQMPSWKGCVQTLVEKYSNDVTSLPFLLEILTVLPEEVHSRSLRIGANRRTEIIEDLAFYSSTVVSLLMTCVEKAGTDEKMLMKVFRCLGSWFNLGVLDSNFMANNKLLALLFEVLQQDKTSSNLHEAASDCVCSALYAIENVETNLPLAMQLFQGVLTLETAYHMAVAREDLDKVLNYCRIFTELCETFLEKIVCTPGQGLGDLRTLELLLICAGHPQYEVVEISFNFWYRLGEHLYKTNDEVIHGIFKAYIQRLLHALARHCQLEPDHEGVPEETDDFGEFRMRVSDLVKDLIFLIGSMECFAQLYSTLKEGNPPWEVTEAVLFIMAAIAKSVDPENNPTLVEVLEGVVRLPETVHTAVRYTSIELVGEMSEVVDRNPQFLDPVLGYLMKGLCEKPLASAAAKAIHNICSVCRDHMAQHFNGLLEIARSLDSFLLSPEAAVGLLKGTALVLARLPLDKITECLSELCSVQVMALKKLLSQEPSNGISSDPTVFLDRLAVIFRHTNPIVENGQTHPCQKVIQEIWPVLSETLNKHRADNRIVERCCRCLRFAVRCVGKGSAALLQPLVTQMVNVYHVHQHSCFLYLGSILVDEYGMEEGCRQGLLDMLQALCIPTFQLLEQQNGLQNHPDTVDDLFRLATRFIQRSPVTLLRSQVVIPILQWAIASTTLDHRDANCSVMRFLRDLIHTGVANDHEEDFELRKELIGQVMNQLGQQLVSQLLHTCCFCLPPYTLPDVAEVLWEIMQVDRPTFCRWLENSLKGLPKETTVGAVTVTHKQLTDFHKQVTSAEECKQVCWALRDFTRLFR

SEQ ID NO: 92099 - protein, 957 aa, Homo sapiens; identical to SEQ ID NO: 92096
  Payload ID: 18440
  Gene Name: transportin 3
  ENSP ID: ENSP00000487231

SEQ ID NO: 92100 - protein, 147 aa, Homo sapiens
  Payload ID: 18441
  Gene Name: transthyretin
  Uniprot ID: P02766
  ENSP ID: ENSP00000237014
MASHRLLLLCLAGLVFVSEAGPTGTGESKCPLMVKVLDAVRGSPAINVAVHVFRKAADDTWEPFASGKTSESGELHGLTTEEEFVEGIYKVEIDTKSYWKALGISPFHEHAEVVFTANDSGPRRYTIAALLSPYSYSTTAVVTNPKE

SEQ ID NO: 92101 - protein, 185 aa, Homo sapiens
  Payload ID: 18441
  Gene Name: transthyretin
  ENSP ID: ENSP00000477599
MASHRLLLLCLAGLVFVSEAGPTGTGESKCPLMVKVLDAVRGSPAINVAVHVFRKAADDTWEPFASGKTSESGELHGLTTEEEFVEGIYKVEIDTKSYWKALGISPFHEHAEVSIQTFESFETDGCHGNRIQTCSSWSELQTSGFHQNVDVVFTANDSGPRRYTIAALLSPYSYSTTAVVTNPKE

SEQ ID NO: 92102 - protein, 139 aa, Homo sapiens
  Payload ID: 18441
  Gene Name: transthyretin
  ENSP ID: ENSP00000479174
MASHRLLLLCLAGLVFVSEAGPTGTGESKCPLMVKVLDAVRGSPAINVAVHVFRKAADDTWEPFASGKTSESGELHGLTTEEEFVEGIYKVEIDTKSYWKALGISPFHEHAEVVFTANDSGPRRYYSYSTTAVVTNPKE

SEQ ID NO: 92103 - protein, 1411 aa, Homo sapiens
  Payload ID: 18442
  Gene Name: Treacher Collins-Franceschetti syndrome 1
  Uniprot ID: Q13428
  ENSP ID: ENSP00000325223
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEELQKGMGTVEGGDQSNPKSKKEKKKSDKRKKDKEKKEKKKKAKKASTKDSESPSQKKKKKKKKTAEQTV

SEQ ID NO: 92104 - protein, 1488 aa, Homo sapiens
  Payload ID: 18442
  Gene Name: Treacher Collins-Franceschetti syndrome 1
  Uniprot ID: Q13428
  ENSP ID: ENSP00000367028
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEELQKGMGTVEGGDQSNPKSKKEKKKSDKRKKDKEKKEKKKKAKKASTKDSESPSQKKKKKKKKTAEQTV

SEQ ID NO: 92105 - protein, 958 aa, Homo sapiens
  Payload ID: 18442
  Gene Name: Treacher Collins-Franceschetti syndrome 1
  Uniprot ID: Q13428
  ENSP ID: ENSP00000377811
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQDQESS

SEQ ID NO: 92106 - protein, 1414 aa, Homo sapiens
  Payload ID: 18442
  Gene Name: Treacher Collins-Franceschetti syndrome 1
  ENSP ID: ENSP00000390717
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVDSAVGTLPATSPQSTSVQAKGTNKLRKPKLPEVQQATKAPESSDDSEDSSDSSSGSEEDGEGPQGAKSAHTLGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEELQKGMGTVEGGDQSNPKSKKEKKKSDKRKKDK

SEQ ID NO: 92107 - protein, 1451 aa, Homo sapiens
  Payload ID: 18442
  Gene Name: Treacher Collins-Franceschetti syndrome 1
  Uniprot ID: Q13428
  ENSP ID: ENSP00000406888
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVDSAVGTLPATSPQSTSVQAKGTNKLRKPKLPEVQQATKAPESSDDSEDSSDSSSGSEEDGEGPQGAKSAHTLVGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEELQKGMGTVEGGDQSNPKSKKEKKKSDKRKKDKEKKEKKKKAKKASTKDSESPSQKKKKKKKKTAEQTV

SEQ ID NO: 92108 - protein, 1412 aa, Homo sapiens
  Payload ID: 18442
  Gene Name: Treacher Collins-Franceschetti syndrome 1
  Uniprot ID: Q13428
  ENSP ID: ENSP00000409944
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLVGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEELQKGMGTVEGGDQSNPKSKKEKKKSDKRKKDKEKKEKKKKAKKASTKDSESPSQKKKKKKKKTAEQTV

SEQ ID NO: 92109 - protein, 1488 aa, Homo sapiens; identical to SEQ ID NO: 92104
  Payload ID: 18442
  Gene Name: Treacher Collins-Franceschetti syndrome 1
  Uniprot ID: Q13428
  ENSP ID: ENSP00000421655

SEQ ID NO: 92110 - protein, 67 aa, Homo sapiens
  Payload ID: 18442
  Gene Name: Treacher Collins-Franceschetti syndrome 1
  ENSP ID: ENSP00000422567
  MOD_RES (1)..(1): Any amino acid
XQDDSGSSSEESDSDGEAPAAVTSAQDSNSKPARSKTLAPAPPERNTEGSSESSEEELPLTQDQESS

SEQ ID NO: 92111 - protein, 188 aa, Homo sapiens
  Payload ID: 18442
  Gene Name: Treacher Collins-Franceschetti syndrome 1
  ENSP ID: ENSP00000426471
LIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKDEPEEELQKGMGTVEGGDQSNPKSKKEKKKSDKRKKDKEKKEKKKKAKKASTKDSESPSQKKKKKKKKTAEQTV

SEQ ID NO: 92112 - protein, 148 aa, Homo sapiens
  Payload ID: 18442
  Gene Name: Treacher Collins-Franceschetti syndrome 1
  ENSP ID: ENSP00000426587
  MOD_RES (1)..(1): Any amino acid
XGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQSSWPSCYTRTSPGCKHPEEGPSLGEHSQELLLRERG

SEQ ID NO: 92113 - protein, 1488 aa, Homo sapiens
  Payload ID: 18442
  Gene Name: Treacher Collins-Franceschetti syndrome 1
  ENSP ID: ENSP00000427484
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQKDSNSKPARSKTLAPAPPERNTEGSSESSEEELPLTQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVDSAVGTLPATSPQSTSVQAKGTNKLRKPKLPEVQQATKAPESSDDSEDSSDSSSGSEEDGEGPQGAKSAHTLVGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEELQKGMGTVEGGDQSNPKSKKEKKKSDKRKKDKEKKEKKKKAKKASTKDSESPSQKKKKKKKKTAEQTV

SEQ ID NO: 92114 - protein, 84 aa, Homo sapiens
  Payload ID: 18443
  Gene Name: trefoil factor 1
  Uniprot ID: P04155
  ENSP ID: ENSP00000291527
MATMENKVICALVLVSMLALGTLAEAQTETCTVAPRERQNCGFPGVTPSQCANKGCCFDDTVRGVPWCFYPNTIDVPPEEECEF

SEQ ID NO: 92115 - protein, 129 aa, Homo sapiens
  Payload ID: 18444
  Gene Name: trefoil factor 2
  Uniprot ID: Q03403
  ENSP ID: ENSP00000291526
MGRRDAQLLAALLVLGLCALAGSEKPSPCQCSRLSPHNRTNCGFPGITSDQCFDNGCCFDSSVTGVPWCFHPLPKQESDQCVMEVSDRRNCGYPGISPEECASRKCCFSNFIFEVPWCFFPKSVEDCHY

SEQ ID NO: 92116 - protein, 74 aa, Homo sapiens [sequence omitted]

SEQ ID NO: 92117 - protein, 125 aa, Homo sapiens
  Payload ID: 18445
  Gene Name: trefoil factor 3 (intestinal)
  ENSP ID: ENSP00000381462
  MOD_RES (1)..(1): Any amino acid
XALLSSSSAEEYVGLSQQGLWQLTGLCLGQLQTSVPCQPRTGWTAATPMSPPRSATTGAAALTPGSLECLGVSSPCRKQNAPSEAPPAAPGRGMRGSEHPCPAVIAARHCSSQLFCPFAPGKRFC

SEQ ID NO: 92118 - protein, 94 aa, Homo sapiens
  Payload ID: 18445
  Gene Name: trefoil factor 3 (intestinal)
  ENSP ID: ENSP00000430690
MKRVLSCVPEPTVVMAARALCMLGLVLALLSSSSAEEYVGLSANQCAVPAKDRVDCGYPHVTPKECNNRGCCFDSRIPGVPWCFKPLQEAECTF

SEQ ID NO: 92119 - protein, 583 aa, Homo sapiens
  Payload ID: 18446
  Gene Name: trehalase (brush-border membrane glycoprotein)
  Uniprot ID: O43280
  ENSP ID: ENSP00000264029
MPGRTWELCLLLLLGLGLGSQEALPPPCESEIYCHGELLNQVQMAKLYQDDKQFVDMPLSIAPEQVLQTFTELSRDHNHSIPREQLQAFVHEHFQAKGQELQPWTPADWKDSPQFLQKISDAKLRAWAGQLHQLWKKLGKKMKPEVLSHPERFSLIYSEHPFIVPGGRFVEFYYWDSYWVMEGLLLSEMAETVKGMLQNFLDLVKTYGHVPNGGRVYYLQRSQPPLLTLMMDCYLTHTNDTAFLQENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWTNGVVLMLLDRYGDRLTSGAKLAFLEPHCLAATLLPSLLLSLLPW

SEQ ID NO: 92120 - protein, 552 aa, Homo sapiens
  Payload ID: 18446
  Gene Name: trehalase (brush-border membrane glycoprotein)
  Uniprot ID: O43280
  ENSP ID: ENSP00000381020
MPGRTWELCLLLLLGLGLGSQEALPPPCESEIYCHGELLNQVQMAKLYQDDKQFVDMPLSIAPEQVLQTFTELSRDHNHSIPREQLQAFVHEHFQAKGQELQPWTPADWKDSPQFLQKISDAKLRAWAGQLHQLWKKLGKKMKPEVLSHPERFSLIYSEHPFIVPGGRFVEFYYCYGHVPNGGRVYYLQRSQPPLLTLMMDCYLTHTNDTAFLQENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWTNGVVLMLLDRYGDRLTSGAKLAFLEPHCLAATLLPSLLLSLLPW

SEQ ID NO: 92121 - protein, 37 aa, Homo sapiens
  Payload ID: 18446
  Gene Name: trehalase (brush-border membrane glycoprotein)
  ENSP ID: ENSP00000477923
MPGRTWELCLLLLLGLGLGSQEALPPPCERTSPADLH

SEQ ID NO: 92122 - protein, 729 aa, Homo sapiens
  Payload ID: 18447
  Gene Name: triadin
  Uniprot ID: Q13061
  ENSP ID: ENSP00000333984
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKDQYAFCRYMIDIFVHGDLKPGQSPAIPPPLPTEQASRPTPASPALEEKEGEKKKAEKKVTSETKKKEKEDIKKKSEKETAIDVEKKEPGKASETKQGTVKIAAQAAAKKDEKKEDSKKTKKPAEVEQPKGKKQEKKEKHVEPAKSPKKEHSVPSDKQVKAKTERAKEEIGAVSIKKAVPGKKEEKTTKTVEQEIRKEKSGKTSSILKDKEPIKGKEEKVPASLKEKEPETKKDEKMSKAGKEVKPKPPQLQGKKEEKPEPQIKKEAKPAISEKVQIHKQDIVKPEKTVSHGKPEEKVLKQVKAVTIEKTAKPKPTKKAEHREREPPSIKTDKPKPTPKGTSEVTESGKKKTEISEKESKEKADMKHLREEKVSTRKESLQLHNVTKAEKPARVSKDVEDVPASKKAKEGTEDVSPTKQKSPISFFQCVYLDGYNGYGFQFPFTPADRPGESSGQANSPGQKQQGQ

SEQ ID NO: 92123 - protein, 151 aa, Homo sapiens
  Payload ID: 18447
  Gene Name: triadin
  ENSP ID: ENSP00000354307
  MOD_RES (1)..(1): Any amino acid
XTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKGFPGPGIRNSSYYCQYIKGQINAWNDLRTSLLPIPYLSCGKMCSNFNN

SEQ ID NO: 92124 - protein, 44 aa, Homo sapiens
  Payload ID: 18447
  Gene Name: triadin
  ENSP ID: ENSP00000406768
  MOD_RES (1)..(1): Any amino acid
XIHKDKTEKQEKPERKIQTKDWSANSSTIRTLKLTQLKPIYICT

SEQ ID NO: 92125 - protein, 167 aa, Homo sapiens
  Payload ID: 18447
  Gene Name: triadin
  Uniprot ID: Q13061
  ENSP ID: ENSP00000437684
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKEVGHSS

SEQ ID NO: 92126 - protein, 286 aa, Homo sapiens
  Payload ID: 18447
  Gene Name: triadin
  ENSP ID: ENSP00000439281
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKGKHSEQEAAGGSKRILGKKHMQ

SEQ ID NO: 92127 - protein, 297 aa, Homo sapiens
  Payload ID: 18447
  Gene Name: triadin
  Uniprot ID: Q13061
  ENSP ID: ENSP00000486095
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKGQSPAIPPPLPTEQASRPTPASPALEGKYFFFS

SEQ ID NO: 92128 - protein, 372 aa, Homo sapiens
  Payload ID: 18448
  Gene Name: tribbles pseudokinase 1
  Uniprot ID: Q96RU8
  ENSP ID: ENSP00000312150
MRVGPVRSAMSGASQPRGPALLFPATRGVPAKRLLDADDAAAVAAKCPRLSECSSPPDYLSPPGSPCSPQPPPAAPGAGGGSGSAPGPSRIADYLLLPLAEREHVSRALCIHTGRELRCKVFPIKHYQDKIRPYIQLPSHSNITGIVEVILGETKAYVFFEKDFGDMHSYVRSRKRLREEEAARLFKQIVSAVAHCHQSAIVLGDLKLRKFVFSTEERTQLRLESLEDTHIMKGEDDALSDKHGCPAYVSPEILNTTGTYSGKAADVWSLGVMLYTLLVGRYPFHDSDPSALFSKIRRGQFCIPEHISPKARCLIRSLLRREPSERLTAPEILLHPWFESVLEPGYIDSEIGTSDQIVPEYQEDSDISSFFC

SEQ ID NO: 92129 - protein, 141 aa, Homo sapiens
  Payload ID: 18448
  Gene Name: tribbles pseudokinase 1
  ENSP ID: ENSP00000428879
MKGEDDALSDKHGCPAYVSPEILNTTGTYSGKAADVWSLGVMLYTLLVGRYPFHDSDPSALFSKIRRGQFCIPEHISPKARCLIRSLLRREPSERLTAPEILLHPWFESVLEPGYIDSEIGTSDQIVPEYQEDSDISSFFC

SEQ ID NO: 92130 - protein, 206 aa, Homo sapiens
  Payload ID: 18448
  Gene Name: tribbles pseudokinase 1
  Uniprot ID: Q96RU8
  ENSP ID: ENSP00000429063
MHSYVRSRKRLREEEAARLFKQIVSAVAHCHQSAIVLGDLKLRKFVFSTEERTQLRLESLEDTHIMKGEDDALSDKHGCPAYVSPEILNTTGTYSGKAADVWSLGVMLYTLLVGRYPFHDSDPSALFSKIRRGQFCIPEHISPKARCLIRSLLRREPSERLTAPEILLHPWFESVLEPGYIDSEIGTSDQIVPEYQEDSDISSFFC

SEQ ID NO: 92131 - protein, 343 aa, Homo sapiens
  Payload ID: 18449
  Gene Name: tribbles pseudokinase 2
  Uniprot ID: Q92519
  ENSP ID: ENSP00000155926
MNIHRSTPITIARYGRSRNKTQDFEELSSIRSAEPSQSFSPNLGSPSPPETPNLSHCVSCIGKYLLLEPLEGDHVFRAVHLHSGEELVCKVFDISCYQESLAPCFCLSAHSNINQITEIILGETKAYVFFERSYGDMHSFVRTCKKLREEEAARLFYQIASAVAHCHDGGLVLRDLKLRKFIFKDEERTRVKLESLEDAYILRGDDDSLSDKHGCPAYVSPEILNTSGSYSGKAADVWSLGVMLYTMLVGRYPFHDIEPSSLFSKIRRGQFNIPETLSPKAKCLIRSILRREPSERLTSQEILDHPWFSTDFSVSNSAYGAKEVSDQLVPDVNMEENLDPFFN

SEQ ID NO: 92132 - protein, 207 aa, Homo sapiens
  Payload ID: 18449
  Gene Name: tribbles pseudokinase 2
  ENSP ID: ENSP00000370874
MHSFVRTCKKLREEEAARLFYQIASAVAHCHDGGLVLRDLKLRKFIFKDEERTRVKLESLEDAYILRGDDDSLSDKHGCPAYVSPEILNTSGSYSGKAADVWSLGVMLYTMLVGRYPFHDIEPSSLFSKIRRGQFNIPETLSPKAKCLIRSILRREPSERLTSQEILDHPWFSTDFSVSNSAYGAKEVSDQLVPDVNMEENLDPFFN

SEQ ID NO: 92133 - protein, 252 aa, Homo sapiens
  Payload ID: 18449
  Gene Name: tribbles pseudokinase 2
  ENSP ID: ENSP00000384260
MNIHRSTPITIARYGRSRNKTQDFEELSSIRSAEPSQSFSPNLGSPSPPETPNLSHCVSCIGKYLLLEPLEGDHVFRAVHLHSGEELVCKVFDISCYQESLAPCFCLSAHSNINQITEIILGETKAYVFFERSYGDMHSFVRTCKKLREEEAARLFYQIASAVAHCHDGGLVLRDLKLRKFIFKDEERCLCPWSLEMFPLVLPSIPSVILDWSFVCFHPPPTSLIFLLLLPSVCCIGSKVFSINNKLVYVLL

SEQ ID NO: 92134 - protein, 358 aa, Homo sapiens
  Payload ID: 18450
  Gene Name: tribbles pseudokinase 3
  Uniprot ID: Q96RU7
  ENSP ID: ENSP00000217233
MRATPLAAPAGSLSRKKRLELDDNLDTERPVQKRARSGPQPRLPPCLLPLSPPTAPDRATAVATASRLGPYVLLEPEEGGRAYQALHCPTGTEYTCKVYPVQEALAVLEPYARLPPHKHVARPTEVLAGTQLLYAFFTRTHGDMHSLVRSRHRIPEPEAAVLFRQMATALAHCHQHGLVLRDLKLCRFVFADRERKKLVLENLEDSCVLTGPDDSLWDKHACPAYVGPEILSSRASYSGKAADVWSLGVALFTMLAGHYPFQDSEPVLLFGKIRRGAYALPAGLSAPARCLVRCLLRREPAERLTATGILLHPWLRQDPMPLAPTRSHLWEAAQVVPDGLGLDEAREEEGDREVVLYG

SEQ ID NO: 92135 - protein, 271 aa, Homo sapiens
  Payload ID: 18450
  Gene Name: tribbles pseudokinase 3
  ENSP ID: ENSP00000391873
MRATPLAAPAGSLSRKKRLELDDNLDTERPVQKRARSGPQPRLPPCLLPLSPPTAPDRATAVATASRLGPYVLLEPEEGGRAYQALHCPTGTEYTCKVYPVQEALAVLEPYARLPPHKHVARPTEVLAGTQLLYAFFTRTHGDMHSLVRSRHRIPEPEAAVLFRQMATALAHCHQHGLVLRDLKLCRFVFADRERKKLVLENLEDSCVLTGPDDSLWDKHACPAYVGPEILSSRASYSGKAADVWSLGVALFTMLAGHYPFQDSEPVLLFG

SEQ ID NO: 92136 - protein, 385 aa, Homo sapiens
  Payload ID: 18450
  Gene Name: tribbles pseudokinase 3
  ENSP ID: ENSP00000415416
MVLMHLAVKNNRMSANNDHFLTPTWQQMRATPLAAPAGSLSRKKRLELDDNLDTERPVQKRARSGPQPRLPPCLLPLSPPTAPDRATAVATASRLGPYVLLEPEEGGRAYQALHCPTGTEYTCKVYPVQEALAVLEPYARLPPHKHVARPTEVLAGTQLLYAFFTRTHGDMHSLVRSRHRIPEPEAAVLFRQMATALAHCHQHGLVLRDLKLCRFVFADRERKKLVLENLEDSCVLTGPDDSLWDKHACPAYVGPEILSSRASYSGKAADVWSLGVALFTMLAGHYPFQDSEPVLLFGKIRRGAYALPAGLSAPARCLVRCLLRREPAERLTATGILLHPWLRQDPMPLAPTRSHLWEAAQVVPDGLGLDEAREEEGDREVVLYG

SEQ ID NO: 92137 - protein, 130 aa, Homo sapiens
  Payload ID: 18450
  Gene Name: tribbles pseudokinase 3
  ENSP ID: ENSP00000478194
MRATPLAAPAGSLSRKKRLELDDNLDTERPVQKRARSGPQPRLPPCLLPLSPPTAPDRATAVATASRLGPYVLLEPEEGGRAYQALHCPTGTEYTCKVYPVQEALAVLEPYARLPPHKHVARPTEVLAGT

SEQ ID NO: 92138 - protein, 1943 aa, Homo sapiens
  Payload ID: 18451
  Gene Name: trichohyalin
  Uniprot ID: Q07283
  ENSP ID: ENSP00000357794
MSPLLRSICDITEIFNQYVSHDCDGAALTKKDLKNLLEREFGAVLRRPHDPKTVDLILELLDLDSNGRVDFNEFLLFIFKVAQACYYALGQATGLDEEKRARCDGKESLLQDRRQEEDQRRFEPRDRQLEEEPGQRRRQKRQEQERELAEGEEQSEKQERLEQRDRQRRDEELWRQRQEWQEREERRAEEEQLQSCKGHETEEFPDEEQLRRRELLELRRKGREEKQQQRRERQDRVFQEEEEKEWRKRETVLRKEEEKLQEEEPQRQRELQEEEEQLRKLERQELRRERQEEEQQQQRLRREQQLRRKQEEERREQQEERREQQERREQQEERREQQLRREQEERREQQLRREQEEERREQQLRREQEEERREQQLRREQQLRREQQLRREQQLRREQQLRREQQLRREQQLRREQQLRREQQLRREQEEERHEQKHEQERREQRLKREQEERRDWLKREEETERHEQERRKQQLKRDQEEERRERWLKLEEEERREQQERREQQLRREQEERREQRLKRQEEEERLQQRLRSEQQLRREQEERREQLLKREEEKRLEQERREQRLKREQEERRDQLLKREEERRQQRLKREQEERLEQRLKREEVERLEQEERREQRLKREEPEEERRQQLLKSEEQEERRQQQLRREQQERREQRLKREEEEERLEQRLKREHEEERREQELAEEEQEQARERIKSRIPKWQWQLESEADARQSKVYSRPRKQEGQRRRQEQEEKRRRRESELQWQEEERAHRQQQEEEQRRDFTWQWQAEEKSERGRQRLSARPPLREQRERQLRAEERQQREQRFLPEEEEKEQRRRQRREREKELQFLEEEEQLQRRERAQQLQEEEDGLQEDQERRRSQEQRRDQKWRWQLEEERKRRRHTLYAKPALQEQLRKEQQLLQEEEEELQREEREKRRRQEQERQYREEEQLQQEEEQLLREEREKRRRQERERQYRKDKKLQQKEEQLLGEEPEKRRRQEREKKYREEEELQQEEEQLLREEREKRRRQEWERQYRKKDELQQEEEQLLREEREKRRLQERERQYREEEELQQEEEQLLGEERETRRRQELERQYRKEEELQQEEEQLLREEPEKRRRQERERQCREEEELQQEEEQLLREEREKRRRQELERQYREEEEVQQEEEQLLREEPEKRRRQELERQYREEEELQQEEEQLLREEQEKRRQERERQYREEEELQRQKRKQRYRDEDQRSDLKWQWEPEKENAVRDNKVYCKGRENEQFRQLEDSQLRDRQSQQDLQHLLGEQQERDREQERRRWQQRDRHFPEEEQLEREEQKEAKRRDRKSQEEKQLLREEREEKRRRQETDRKFREEEQLLQEREEQPLRRQERDRKFREEELRHQEQGRKFLEEEQRLRRQERERKFLKEEQQLRCQEREQQLRQDRDRKFREEEQQLSRQERDRKFREEEQQVRRQERERKFLEEEQQLRQERHRKFREEEQLLQEREEQQLHRQERDRKFLEEEQQLRRQERDRKFREQELRSQEPERKFLEEEQQLHRQQRQRKFLQEEQQLRRQERGQQRRQDRDRKFREEEQLRQEREEQQLSRQERDRKFRLEEQKVRRQEQERKFMEDEQQLRRQEGQQQLRQERDRKFREDEQLLQEREEQQLHRQERDRKFLEEEPQLRRQEREQQLRHDRDRKFREEEQLLQEGEEQQLRRQERDRKFREEEQQLRRQERERKFLQEEQQLRRQELERKFREEEQLRQETEQEQLRRQERYRKILEEEQLRPEREEQQLRRQERDRKFREEEQLRQEREEQQLRSQESDRKFREEEQLRQEREEQQLRPQQRDGKYRWEEEQLQLEEQEQRLRQERDRQYRAEEQFATQEKSRREEQELWQEEEQKRRQERERKLREEHIRRQQKEEQRHRQVGEIKSQEGKGHGRLLEPGTHQFASVPVRSSPLYEYIQEQRSQYRP

SEQ ID NO: 92139 - protein, 1943 aa, Homo sapiens; identical to SEQ ID NO: 92138
  Payload ID: 18451
  Gene Name: trichohyalin
  Uniprot ID: Q07283
  ENSP ID: ENSP00000480484

SEQ ID NO: 92140 - protein, 904 aa, Homo sapiens
  Payload ID: 18452
  Gene Name: trichohyalin-like 1
  Uniprot ID: Q5QJ38
  ENSP ID: ENSP00000357796
MPQLLRNVLCVIETFHKYASEDSNGATLTGRELKQLIQGEFGDFFQPCVLHAVEKNSNLLNIDSNGIISFDEFVLAIFNLLNLCYLDIKSLLSSELRQVTKPEKEKLDDVDVQATTGDGQWTVGTSPTQEKRMLPSGMASSSQLIPEESGAVGNNRVDPWREAKTHNFPGEASEHNDPKNKHLEGDEQSQEVAQDIQTTEDNEGQLKTNKPMAGSKKTSSPTERKGQDKEISQEGDEPAREQSVSKIRDQFGEQEGNLATQSSPPKEATQRPCEDQEVRTEKEKHSNIQEPPLQREDEPSSQHADLPEQAAARSPSQTQKSTDSKDVCRMFDTQEPGKDADQTPAKTKNLGEPEDYGRTSETQEKECETKDLPVQYGSRNGSETSDMRDERKERRGPEAHGTAGQKERDRKTRPLVLETQTQDGKYQELQGLSKSKDAEKGSETQYLSSEGGDQTHPELEGTAVSGEEAEHTKEGTAEAFVNSKNAPAAERTLGARERTQDLAPLEKQSVGENTRVTKTHDQPVEEEDGYQGEDPESPFTQSDEGSSETPNSLASEEGNSSSETGELPVQGDSQSQGDQHGESVQGGHNNNPDTQRQGTPGEKNRALEAVVPAVRGEDVQLTEDQEQPARGEHKNQGPGTKGPGAAVEPNGHPEAQESTAGDENRKSLEIEITGALDEDFTDQLSLMQLPGKGDSRNELKVQGPSSKEEKGRATEAQNTLLESLDEDNSASLKIQLETKEPVTSEEEDESPQELAGEGGDQKSPAKKEHNSSVPWSSLEKQMQRDQEPCSVERGAVYSSPLYQYLQEKILQQTNVTQEEHQKQVQIAQASGPELCSVSLTSEISDCSVFFNYSQASQPYTRGLPLDESPAGAQETPAPQALEDKQGHPQRERLVLQREASTTKQ

SEQ ID NO: 92141 - protein, 498 aa, Homo sapiens
  Payload ID: 18453
  Gene Name: trichoplein, keratin filament binding
  Uniprot ID: Q9BT92
  ENSP ID: ENSP00000324404
MALPTLPSYWCSQQRLNQQLARQREQEARLRQQWEQNSRYFRMSDICSSKQAEWSSKTSYQRSMHAYQREKMKEEKRRSLEARREKLRQLMQEEQDLLARELEELRLSMNLQERRIREQHGKLKSAKEEQRKLIAEQLLYEHWKKNNPKLREMELDLHQKHVVNSWEMQKEEKKQQEATAEQENKRYENEYERARREALERMKAEEERRQLEDKLQAEALLQQMEELKLKEVEATKLKKEQENLLKQRWELERLEEERKQMEAFRQKAELGRFLRHQYNAQLSRRTQQIQEELEADRRILQALLEKEDESQRLHLARREQVMADVAWMKQAIEEQLQLERAREAELQMLLREEAKEMWEKREAEWARERSARDRLMSEVLTGRQQQIQEKIEQNRRAQEESLKHREQLIRNLEEVRELARREKEESEKLKSARKQELEAQVAERRLQAWEADQQEEEEEEEARRVEQLSDALLQQEAETMAEQGYRPKPYGHPKIAWN

SEQ ID NO: 92142 - protein, 498 aa, Homo sapiens; identical to SEQ ID NO: 92141
  Payload ID: 18453
  Gene Name: trichoplein, keratin filament binding
  Uniprot ID: Q9BT92
  ENSP ID: ENSP00000384520

SEQ ID NO: 92143 - protein, 498 aa, Homo sapiens; identical to SEQ ID NO: 92141
  Payload ID: 18453
  Gene Name: trichoplein, keratin filament binding
  Uniprot ID: Q9BT92
  ENSP ID: ENSP00000440838

SEQ ID NO: 92144 - protein, 174 aa, Homo sapiens
  Payload ID: 18453
  Gene Name: trichoplein, keratin filament binding
  ENSP ID: ENSP00000441835
MALPTLPSYWCSQQRLNQQLARQREQEARLRQQWEQNSRYFRMSDICSSKQAEWSSKTSYQRSMHAYQREKMKEEKRRSLEARREKLRQLMQEEQDLLARELEELRLSMNLQERRIREQHGKLKSAKEEQRKLIAEQLLYEHWKKNNPKLREMELDLHQKHVVNSWEMQKEEKK

SEQ ID NO: 92145 - protein, 1281 aa, Homo sapiens
  Payload ID: 18454
  Gene Name: trichorhinophalangeal syndrome I
  Uniprot ID: Q9UHF7
  ENSP ID: ENSP00000220888
MVRKKNPPLRNVASEGEGQILEPIGTESKVSGKNKEFSADQMSENTDQSDAAELNHKEEHSLHVQDPSSSSKKDLKSAVLSEKAGFNYESPSKGGNFPSFPHDEVTDRNMLAFSSPAAGGVCEPLKSPQRAEADDPQDMACTPSGDSLETKEDQKMSPKATEETGQAQSGQANCQGLSPVSVASKNPQVPSDGGVRLNKSKTDLLVNDNPDPAPLSPELQDFKCNICGYGYYGNDPTDLIKHFRKYHLGLHNRTRQDAELDSKILALHNMVQFSHSKDFQKVNRSVFSGVLQDINSSRPVLLNGTYDVQVTSGGTFIGIGRKTPDCQGNTKYFRCKFCNFTYMGNSSTELEQHFLQTHPNKIKASLPSSEVAKPSEKNSNKSIPALQSSDSGDLGKWQDKITVKAGDDTPVGYSVPIKPLDSSRQNGTEATSYYWCKFCSFSCESSSSLKLLEHYGKQHGAVQSGGLNPELNDKLSRGSVINQNDLAKSSEGETMTKTDKSSSGAKKKDFSSKGAEDNMVTSYNCQFCDFRYSKSHGPDVIVVGPLLRHYQQLHNIHKCTIKHCPFCPRGLCSPEKHLGEITYPFACRKSNCSHCALLLLHLSPGAAGSSRVKHQCHQCSFTTPDVDVLLFHYESVHESQASDVKQEANHLQGSDGQQSVKESKEHSCTKCDFITQVEEEISRHYRRAHSCYKCRQCSFTAADTQSLLEHFNTVHCQEQDITTANGEEDGHAISTIKEEPKIDFRVYNLLTPDSKMGEPVSESVVKREKLEEKDGLKEKVWTESSSDDLRNVTWRGADILRGSPSYTQASLGLLTPVSGTQEQTKTLRDSPNVEAAHLARPIYGLAVETKGFLQGAPAGGEKSGALPQQYPASGENKSKDESQSLLRRRRGSGVFCANCLTTKTSLWRKNANGGYVCNACGLYQKLHSTPRPLNIIKQNNGEQIIRRRTRKRLNPEALQAEQLNKQQRGSNEEQVNGSPLERRSEDHLTESHQREIPLPSLSKYEAQGSLTKSHSAQQPVLVSQTLDIHKRMQPLHIQIKSPQESTGDPGNSSSVSEGKGSSERGSPIEKYMRPAKHPNYSPPGSPIEKYQYPLFGLPFVHNDFQSEADWLRFWSKYKLSVPGNPHYLSHVPGLPNPCQNYVPYPTFNLPPHFSAVGSDNDIPLDLAIKHSRPGPTANGASKEKTKAPPNVKNEGPLNVVKTEKVDRSTQDELSTKCVHCGIVFLDEVMYALHMSCHGDSGPFQCSICQHLCTDKYDFTTHIQRGLHRNNAQVEKNGKPKE

SEQ ID NO: 92146 - protein, 117 aa, Homo sapiens
  Payload ID: 18454
  Gene Name: trichorhinophalangeal syndrome I
  ENSP ID: ENSP00000379063
MPYEVNAGYDFTNMVRKKNPPLRNVASEGEGQILEPIGTESKVSGKNKEFSADQMSENTDQSDAAELNHKEEHSLHVQDPSSSSKKDLKSAVLSEKAGFNYESPSKGGNFPSFPHDE

SEQ ID NO: 92147 - protein, 1294 aa, Homo sapiens
  Payload ID: 18454
  Gene Name: trichorhinophalangeal syndrome I
  Uniprot ID: Q9UHF7
  ENSP ID: ENSP00000379065
MPYEVNAGYDFTNMVRKKNPPLRNVASEGEGQILEPIGTESKVSGKNKEFSADQMSENTDQSDAAELNHKEEHSLHVQDPSSSSKKDLKSAVLSEKAGFNYESPSKGGNFPSFPHDEVTDRNMLAFSSPAAGGVCEPLKSPQRAEADDPQDMACTPSGDSLETKEDQKMSPKATEETGQAQSGQANCQGLSPVSVASKNPQVPSDGGVRLNKSKTDLLVNDNPDPAPLSPELQDFKCNICGYGYYGNDPTDLIKHFRKYHLGLHNRTRQDAELDSKILALHNMVQFSHSKDFQKVNRSVFSGVLQDINSSRPVLLNGTYDVQVTSGGTFIGIGRKTPDCQGNTKYFRCKFCNFTYMGNSSTELEQHFLQTHPNKIKASLPSSEVAKPSEKNSNKSIPALQSSDSGDLGKWQDKITVKAGDDTPVGYSVPIKPLDSSRQNGTEATSYYWCKFCSFSCESSSSLKLLEHYGKQHGAVQSGGLNPELNDKLSRGSVINQNDLAKSSEGETMTKTDKSSSGAKKKDFSSKGAEDNMVTSYNCQFCDFRYSKSHGPDVIVVGPLLRHYQQLHNIHKCTIKHCPFCPRGLCSPEKHLGEITYPFACRKSNCSHCALLLLHLSPGAAGSSRVKHQCHQCSFTTPDVDVLLFHYESVHESQASDVKQEANHLQGSDGQQSVKESKEHSCTKCDFITQVEEEISRHYRRAHSCYKCRQCSFTAADTQSLLEHFNTVHCQEQDITTANGEEDGHAISTIKEEPKIDFRVYNLLTPDSKMGEPVSESVVKREKLEEKDGLKEKVWTESSSDDLRNVTWRGADILRGSPSYTQASLGLLTPVSGTQEQTKTLRDSPNVEAAHLARPIYGLAVETKGFLQGAPAGGEKSGALPQQYPASGENKSKDESQSLLRRRRGSGVFCANCLTTKTSLWRKNANGGYVCNACGLYQKLHSTPRPLNIIKQNNGEQIIRRRTRKRLNPEALQAEQLNKQQRGSNEEQVNGSPLERRSEDHLTESHQREIPLPSLSKYEAQGSLTKSHSAQQPVLVSQTLDIHKRMQPLHIQIKSPQESTGDPGNSSSVSEGKGSSERGSPIEKYMRPAKHPNYSPPGSPIEKYQYPLFGLPFVHNDFQSEADWLRFWSKYKLSVPGNPHYLSHVPGLPNPCQNYVPYPTFNLPPHFSAVGSDNDIPLDLAIKHSRPGPTANGASKEKTKAPPNVKNEGPLNVVKTEKVDRSTQDELSTKCVHCGIVFLDEVMYALHMSCHGDSGPFQCSICQHLCTDKYDFTTHIQRGLHRNNAQVEKNGKPKE

SEQ ID NO: 92148 - protein, 9 aa, Homo sapiens
  Payload ID: 18454
  Gene Name: trichorhinophalangeal syndrome I
  ENSP ID: ENSP00000400360
MPYEVNAGY

SEQ ID NO: 92149 - protein, 61 aa, Homo sapiens
  Payload ID: 18454
  Gene Name: trichorhinophalangeal syndrome I
  ENSP ID: ENSP00000405028
MPYEVNAGYDFTNMVRKKNPPLRNVASEGEGQILEPIGTESKVSGKNKEFSADQMSENTDQ

SEQ ID NO: 92150 - protein, 271 aa, Homo sapiens
  Payload ID: 18454
  Gene Name: trichorhinophalangeal syndrome I
  ENSP ID: ENSP00000428121
  MOD_RES (1)..(1): Any amino acid
XKSTVTPLILPKRRRGSGVFCANCLTTKTSLWRKNANGGYVCNACGLYQKLHSTPRPLNIIKQNNGEQIIRRRTRKRLNPEALQAEQLNKQQRGSNEEQVNGSPLERRSEDHLTESHQREIPLPSLSKYEAQGSLTKSHSAQQPVLVSQTLDIHKRMQPLHIQIKSPQESTGDPGNSSSVSEGKGSSERGSPIEKYMRPAKHPNYSPPGSPIEKYQYPLFGLPFVHNDFQSEADWLRFWSKYKLSVPGNPHYLSHVPGLPNPCQNYVPYPT

SEQ ID NO: 92151 - protein, 1285 aa, Homo sapiens
  Payload ID: 18454
  Gene Name: trichorhinophalangeal syndrome I
  Uniprot ID: Q9UHF7
  ENSP ID: ENSP00000428680
MQSNMVRKKNPPLRNVASEGEGQILEPIGTESKVSGKNKEFSADQMSENTDQSDAAELNHKEEHSLHVQDPSSSSKKDLKSAVLSEKAGFNYESPSKGGNFPSFPHDEVTDRNMLAFSSPAAGGVCEPLKSPQRAEADDPQDMACTPSGDSLETKEDQKMSPKATEETGQAQSGQANCQGLSPVSVASKNPQVPSDGGVRLNKSKTDLLVNDNPDPAPLSPELQDFKCNICGYGYYGNDPTDLIKHFRKYHLGLHNRTRQDAELDSKILALHNMVQFSHSKDFQKVNRSVFSGVLQDINSSRPVLLNGTYDVQVTSGGTFIGIGRKTPDCQGNTKYFRCKFCNFTYMGNSSTELEQHFLQTHPNKIKASLPSSEVAKPSEKNSNKSIPALQSSDSGDLGKWQDKITVKAGDDTPVGYSVPIKPLDSSRQNGTEATSYYWCKFCSFSCESSSSLKLLEHYGKQHGAVQSGGLNPELNDKLSRGSVINQNDLAKSSEGETMTKTDKSSSGAKKKDFSSKGAEDNMVTSYNCQFCDFRYSKSHGPDVIVVGPLLRHYQQLHNIHKCTIKHCPFCPRGLCSPEKHLGEITYPFACRKSNCSHCALLLLHLSPGAAGSSRVKHQCHQCSFTTPDVDVLLFHYESVHESQASDVKQEANHLQGSDGQQSVKESKEHSCTKCDFITQVEEEISRHYRRAHSCYKCRQCSFTAADTQSLLEHFNTVHCQEQDITTANGEEDGHAISTIKEEPKIDFRVYNLLTPDSKMGEPVSESVVKREKLEEKDGLKEKVWTESSSDDLRNVTWRGADILRGSPSYTQASLGLLTPVSGTQEQTKTLRDSPNVEAAHLARPIYGLAVETKGFLQGAPAGGEKSGALPQQYPASGENKSKDESQSLLRRRRGSGVFCANCLTTKTSLWRKNANGGYVCNACGLYQKLHSTPRPLNIIKQNNGEQIIRRRTRKRLNPEALQAEQLNKQQRGSNEEQVNGSPLERRSEDHLTESHQREIPLPSLSKYEAQGSLTKSHSAQQPVLVSQTLDIHKRMQPLHIQIKSPQESTGDPGNSSSVSEGKGSSERGSPIEKYMRPAKHPNYSPPGSPIEKYQYPLFGLPFVHNDFQSEADWLRFWSKYKLSVPGNPHYLSHVPGLPNPCQNYVPYPTFNLPPHFSAVGSDNDIPLDLAIKHSRPGPTANGASKEKTKAPPNVKNEGPLNVVKTEKVDRSTQDELSTKCVHCGIVFLDEVMYALHMSCHGDSGPFQCSICQHLCTDKYDFTTHIQRGLHRNNAQVEKNGKPKE

SEQ ID NO: 92152 - protein, 1035 aa, Homo sapiens
  Payload ID: 18454
  Gene Name: trichorhinophalangeal syndrome I
  ENSP ID: ENSP00000428910
MVRKKNPPLRNVASEGEGQILEPIGTESKVSGKNKEFSADQMSENTDQSDAAELNHKEEHSLHVQDPSSSTAGGVCEPLKSPQRAEADDPQDMACTPSGDSLETKEDQKMSPKATEETGQAQSGQANCQGLSPVSVASKNPQVPSDGGVRLNKSKTDLLVNDNPDPAPLSPELQDFKCNICGYGYYGNDPTDLIKHFRKYHLGLHNRTRQDAELDSKILALHNMVQFSHSKDFQKVNRSVFSGVLQDINSSRPVLLNGTYDVQVTSGGTFIGIGRKTPDCQGNTKYFRCKFCNFTYMGNSSTELEQHFLQTHPNKIKASLPSSEVAKPSEKNSNKSIPALQSSDSGDLGKWQDKITVKAGDDTPVGYSVPIKPLDSSRQNDVLLFHYESVHESQASDVKQEANHLQGSDGQQSVKESKEHSCTKCDFITQVEEEISRHYRRAHSCYKCRQCSFTAADTQSLLEHFNTVHCQEQDITTANGEEDGHAISTIKEEPKIDFRVYNLLTPDSKMGEPVSESVVKREKLEEKDGLKEKVWTESSSDDLRNVTWRGADILRGSPSYTQASLGLLTPVSGTQEQTKTLRDSPNVEAAHLARPIYGLAVETKGFLQGAPAGGEKSGALPQQYPASGENKSKDESQSLLRRRRGSGVFCANCLTTKTSLWRKNANGGYVCNACGLYQKLHSTPRPLNIIKQNNGEQIIRRRTRKRLNPEALQAEQLNKQQRGSNEEQVNGSPLERRSEDHLTESHQREIPLPSLSKYEAQGSLTKSHSAQQPVLVSQTLDIHKRMQPLHIQIKSPQESTGDPGNSSSVSEGKGSSERGSPIEKYMRPAKHPNYSPPGSPIEKYQYPLFGLPFVHNDFQSEADWLRFWSKYKLSVPGNPHYLSHVPGLPNPCQNYVPYPTFNLPPHFSAVGSDNDIPLDLAIKHSRPGPTANGASKEKTKAPPNVKNEGPLNVVKTEKVDRSTQDELSTKCVHCGIVFLDEVMYALHMSCHGDSGPFQCSICQHLCTDKYDFTTHIQRGLHRNNAQVEKNGKPKE

SEQ ID NO: 92153 - protein, 902 aa, Homo sapiens
  Payload ID: 18454
  Gene Name: trichorhinophalangeal syndrome I
  ENSP ID: ENSP00000429174
MVRKKNPPLRNVASEGEGQILEPIGTESKVSGKNKEFSADQMSENTDQSDAAELNHKEEHSLHVQDPSSSSKKDLKSAVLSEKAGFNYESPSKGGNFPSFPHDEVTDRNMLAFSSPAAGGVCEPLKSPQRAEADDPQDMACTPSGDSLETKEDQKMSPKATEETGQAQSGQANCQGLSPVSVASKNPQVPSDGGVRLNKSKTDLLVNDNPDPAPLSPELQDFKCNICGYGYYGNDPTDLIKHFRKYHLGLHNRTRQDAELDSKILALHNMVQFSHSKDFQKVNRSVFSGVLQDINSSRPVLLNGTYDVQVTSGGTFIGIGRKTPDCQGNTKYFRCKFCNFTYMGNSSTELEQHFLQTHPNKIKASLPSSEVAKPSEKNSNKSIPALQSSDSGDLGKWQDKITVKAGDDTPVGYSVPIKPLDSSRQNGTEATSYYWCKFCSFSCESSSSLKLLEHYGKQHGAVQSGGLNPELNDKLSRGSVINQNDLAKSSEGETMTKTDKSSSGAKKKDFSSKGAEDNMVTSYNCQFCDFRYSKSHGPDVIVVGPLLRHYQQLHNIHKCTIKHCPFCPRGLCSPEKHLGEITYPFACRKSNCSHCALLLLHLSPGAAGSSRVKHQCHQCSFTTPDVDVLLFHYESVHESQASDVKQEANHLQGSDGQQSVKESKEHSCTKCDFITQVEEEISRHYRRAHSCYKCRQCSFTAADTQSLLEHFNTVHCQEQDITTANGEEDGHAISTIKEEPKIDFRVYNLLTPDSKMGEPVSESVVKREKLEEKDGLKEKVWTESSSDDLRNVTWRGADILRGSPSYTQASLGLLTPVSGTQEQTKTLRDSPNVEAAHLARPIYGLAVETKGFLQGAPAGGEKSGALPQQYPASGENKSKDESQSLLRVFESAWMTPEEQFSL

SEQ ID NO: 92154 - protein, 108 aa, Homo sapiens
  Payload ID: 18454
  Gene Name: trichorhinophalangeal syndrome I
  ENSP ID: ENSP00000430383
MPYEVNAGYDFTNMVRKKNPPLRNVASEGEGQILEPIGTESKVSGKNKEFSADQMSENTDQSDAAELNHKEEHSLHVQDPSSSSKKDLKSAVLSEKAGFNYESPSKGG

SEQ ID NO: 92155 - protein, 691 aa, Homo sapiens
  Payload ID: 18454
  Gene Name: trichorhinophalangeal syndrome I
  ENSP ID: ENSP00000430803
MQSNMVRKKNPPLRNVASEGEGQILEPIGTESKVSGKNKEFSADQMSENTDQSDAAELNHKEEHSLHVQDPSSSSKKDLKSAVLSEKAGFNYESPSKGGNFPSFPHDEVTDRNMLAFSSPAAGGVCEPLKSPQRAEADDPQDMACTPSGDSLETKEDQKMSPKATEETGQAQSGQANCQGLSPVSVASKNPQVPSDGGVRLNKSKTDLLVNDNPDPAPLSPELQDFKCNICGYGYYGNDPTDLIKHFRKYHLGLHNRTRQDAELDSKILALHNMVQFSHSKDFQKVNRSVFSGVLQDINSSRPVLLNGTYDVQVTSGGTFIGIGRKTPDCQGNTKYFRCKFCNFTYMGNSSTELEQHFLQTHPNKIKASLPSSEVAKPSEKNSNKSIPALQSSDSGDLGKWQDKITVKAGDDTPVGYSVPIKPLDSSRQNDVLLFHYESVHESQASDVKQEANHLQGSDGQQSVKESKEHSCTKCDFITQVEEEISRHYRRAHSCYKCRQCSFTAADTQSLLEHFNTVHCQEQDITTANGEEDGHAISTIKEEPKIDFRVYNLLTPDSKMGEPVSESVVKREKLEEKDGLKEKVWTESSSDDLRNVTWRGADILRGSPSYTQASLGLLTPVSGTQEQTKTLRDSPNVEAAHLARPIYGLAVETKGFLQGAPAGGEKSGALPQQYPASGENKSKDESQSLLR

SEQ ID NO: 92156 - protein, 234 aa, Homo sapiens
  Payload ID: 18455
  Gene Name: triggering receptor expressed on myeloid cells 1
  Uniprot ID: Q9NP99
  ENSP ID: ENSP00000244709
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRVPVFNIVILLAGGFLSKSLVFSVLFAVTLRSFVP

SEQ ID NO: 92157 - protein, 150 aa, Homo sapiens
  Payload ID: 18455
  Gene Name: triggering receptor expressed on myeloid cells 1
  Uniprot ID: Q9NP99
  ENSP ID: ENSP00000334284
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFRCSTLSFSWLVDS

SEQ ID NO: 92158 - protein, 225 aa, Homo sapiens
  Payload ID: 18455
  Gene Name: triggering receptor expressed on myeloid cells 1
  Uniprot ID: Q9NP99
  ENSP ID: ENSP00000465345
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRYSFQVPGPLVWTLSPLFPSLCAERM

SEQ ID NO: 92159 - protein, 250 aa, Homo sapiens
  Payload ID: 18455
  Gene Name: triggering receptor expressed on myeloid cells 1
  ENSP ID: ENSP00000465688
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIREKSMTFGIRRLDVESHPLPPLHTGHFRISQFFSQAGTQSLHSCYKGKPTP

SEQ ID NO: 92160 - protein, 219 aa, Homo sapiens
  Payload ID: 18456
  Gene Name: triggering receptor expressed on myeloid cells 2
  Uniprot ID: Q9NZC2
  ENSP ID: ENSP00000342651
MEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRAERHVKEDDGRKSPGEVPPGTSPACILATWPPGLLVLLWQETTLPEHCFSWTLEAGTG

SEQ ID NO: 92161 - protein, 230 aa, Homo sapiens
  Payload ID: 18456
  Gene Name: triggering receptor expressed on myeloid cells 2
  Uniprot ID: Q9NZC2
  ENSP ID: ENSP00000362205
MEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRSLLEGEIPFPPTSILLLLACIFLIKILAASALWAAAWHGQKPGTHPPSELDCGHDPGYQLQTLPGLRDT

SEQ ID NO: 92162 - protein, 222 aa, Homo sapiens
  Payload ID: 18456
  Gene Name: triggering receptor expressed on myeloid cells 2
  Uniprot ID: Q9NZC2
  ENSP ID: ENSP00000362214
MEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRPSQGSHLPSCLSKEPLGRRNPLPTHFHPSPPGLHLSHQDSSSQRPLGCSLAWTEARDTSTQ

SEQ ID NO: 92163 - protein, 199 aa, Homo sapiens
  Payload ID: 18457
  Gene Name: triggering receptor expressed on myeloid cells-like 1
  Uniprot ID: Q86YW5
  ENSP ID: ENSP00000362219
MGLTLLLLLLLGLEGQGIVGSLPEVLQAPVGSSILVQCHYRLQDVKAQKVWCRFLPEGCQPLVSSAVDRRAPAGRRTFLTDLGGGLLQVEMVTLQEEDAGEYGCMVDGARGPQILHRVSLNILPPEEEEETHKIGSLAENAFSDPAGSANPLEPSQDEKSIPLIWGAVLLVGLLVAAVVLFAVMAKRKQESLLSGPPRQ

SEQ ID NO: 92164 - protein, 200 aa, Homo sapiens
  Payload ID: 18457
  Gene Name: triggering receptor expressed on myeloid cells-like 1
  Uniprot ID: Q86YW5
  ENSP ID: ENSP00000400405
MGLTLLLLLLLGLEEEEEETHKIGSLAENAFSDPAGSANPLEPSQDEKSIPLIWGAVLLVGLLVAAVVLFAVMAKRKQGNRLGVCGRFLSSRVSGMNPSSVVHHVSDSGPAAELPLDVPHIRLDSPPSFDNTTYTSLPLDSPSGKPSLPAPSSLPPLPPKVLVCSKPVTYATVIFPGGNKGGGTSCGPAQNPPNNQTPSS

SEQ ID NO: 92165 - protein, 311 aa, Homo sapiens
  Payload ID: 18457
  Gene Name: triggering receptor expressed on myeloid cells-like 1
  Uniprot ID: Q86YW5
  ENSP ID: ENSP00000402855
MGLTLLLLLLLGLEGQGIVGSLPEVLQAPVGSSILVQCHYRLQDVKAQKVWCRFLPEGCQPLVSSAVDRRAPAGRRTFLTDLGGGLLQVEMVTLQEEDAGEYGCMVDGARGPQILHRVSLNILPPEEEEETHKIGSLAENAFSDPAGSANPLEPSQDEKSIPLIWGAVLLVGLLVAAVVLFAVMAKRKQGNRLGVCGRFLSSRVSGMNPSSVVHHVSDSGPAAELPLDVPHIRLDSPPSFDNTTYTSLPLDSPSGKPSLPAPSSLPPLPPKVLVCSKPVTYATVIFPGGNKGGGTSCGPAQNPPNNQTPSS

SEQ ID NO: 92166 - protein, 321 aa, Homo sapiens
  Payload ID: 18458
  Gene Name: triggering receptor expressed on myeloid cells-like 2
  Uniprot ID: Q5T2D2
  ENSP ID: ENSP00000418767
MAPAFLLLLLLWPQGCVSGPSADSVYTKVRLLEGETLSVQCSYKGYKNRVEGKVWCKIRKKKCEPGFARVWVKGPRYLLQDDAQAKVVNITMVALKLQDSGRYWCMRNTSGILYPLMGFQLDVSPAPQTERNIPFTHLDNILKSGTVTTGQAPTSGPDAPFTTGVMVFTPGLITLPRLLASTRPASKTGYSFTATSTTSQGPRRTMGSQTVTASPSNARDSSAGPESISTKSGDLSTRSPTTGLCLTSRSLLNRLPSMPSIRHQDVYSTVLGVVLTLLVLMLIMVYGFWKKRHMASYSMCSDPSTRDPPGRPEPYVEVYLI

SEQ ID NO: 92167 - protein, 200 aa, Homo sapiens
  Payload ID: 18459
  Gene Name: triggering receptor expressed on myeloid cells-like 4
  Uniprot ID: Q6UXN2
  ENSP ID: ENSP00000342570
MAWGGVHTCCFHLCCCCSWPQGAVPEELHKHPGQTLLLQCQYSPKRGPYQPKSWCQQTSPSRCTLLVTSSKPWTAVQKSHYTIWDKPNAGFFNITMIQLTQNDSGFYWCGIYNASENIITVLRNISLVVSPAPTTSPMWTLPWLPTSTVLITSPEGTSGHPSINGSETRKSRAPACLGSGGPRFLVLVLCGLLLAKGLML

SEQ ID NO: 92168 - protein, 200 aa, Homo sapiens; identical to SEQ ID NO: 92167
  Payload ID: 18459
  Gene Name: triggering receptor expressed on myeloid cells-like 4
  Uniprot ID: Q6UXN2
  ENSP ID: ENSP00000418078

SEQ ID NO: 92169 - protein, 71 aa, Homo sapiens
  Payload ID: 18459
  Gene Name: triggering receptor expressed on myeloid cells-like 4
  ENSP ID: ENSP00000418480
  MOD_RES (1)..(1): Any amino acid
XDSGFYWCGIYNASENIITVLRNISLVVSPAPTTSPMWTLPWLPTSTVLITSPEGTSGHPSINGSETRNGS

SEQ ID NO: 92170 - protein, 503 aa, Homo sapiens
  Payload ID: 18460
  Gene Name: TRIM39-RPP21 readthrough
  ENSP ID: ENSP00000485378
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKDVKSTLEKCEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTQGSSNQ

SEQ ID NO: 92171 - protein, 842 aa, Homo sapiens
  Payload ID: 18461
  Gene Name: TRIM6-TRIM34 readthrough
  ENSP ID: ENSP00000346916
MCGSERILQAGNILEIRVGQAGARRVATMTSPVLVDIREEVTCPICLELLTEPLSIDCGHSFCQACITPNGRESVIGQEGERSCPVCQTSYQPGNLRPNRHLANIVRRLREVVLGPGKQLKAVLCADHGEKLQLFCQEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWAIQGSLTRRERRASGVRTRRSQGSSAMASKILLNVQEEVTCPICLELLTEPLSLDCGHSLCRACITVSNKEAVTSMGGKSSCPVCGISYSFEHLQANQHLANIVERLKEVKLSPDNGKKRDLCDHHGEKLLLFCKEDRKVICWLCERSQEHRGHHTVLTEEVFKECQEKLQAVLKRLKKEEEEAEKLEADIREEKTSWKYQVQTERQRIQTEFDQLRSILNNEEQRELQRLEEEEKKTLDKFAEAEDELVQQKQLVRELISDVECRSQWSTMELLQDMSGIMKWSEIWRLKKPKMVSKKLKTVFHAPDLSRMLQMFRELTAVRCYWVDVTLNSVNLNLNLVLSEDQRQVISVPIWPFQCYNYGVLGSQYFSSGKHYWEVDVSKKTAWILGVYCRTYSRHMKYVVRRCANRQNLYTKYRPLFGYWVIGLQNKCKYGVFEESLSSDPEVLTLSMAVPPCRVGVFLDYEAGIVSFFNVTSHGSLIYKFSKCCFSQPVYPYFNPWNCPAPMTLCPPSS

SEQ ID NO: 92172 - protein, 853 aa, Homo sapiens
  Payload ID: 18462
  Gene Name: trimethylguanosine synthase 1
  Uniprot ID: Q96RS0
  ENSP ID: ENSP00000260129
MCCEKWSRVAEMFLFIEEREDCKILCLCSRAFVEDRKLYNLGLKGYYIRDSGNNSGDQATEEEEGGYSCGTAESHDSKGIGLDESELDSEAELMRSMGLPLQFGRITAHKDFEVSMNTRNKVKIKKKKHQKKYLDEIVQESWRKEYEEDDILASDDPSSIEQYENTRTYELQSKKDTETENPPVENTLSPKLEITEKWEKYWNEYGGGLLWQSWQEKHPGQALSSEPWNFPDTKEEWEQHYSQLYWYYLEQFQYWEAQGWTFDASQSCDTDTYTSKTEADDKNDEKCMKVDLVSFPSSPIMVDNDSSGTSDKDHSEILDGISNIKLNSEEVTQSQLDSCTSHDGHQQLSEVSSKRECPASGQSEPRNGGTNEESNSSGNTNTDPPAEDSQKSSGANTSKDRPHASGTDGDESEEDPPEHKPSKLKRSHELDIDENPASDFDDSGSLLGFKYGSGQKYGGIPNFSHRQVRYLEKNVKLKSKYLDMRRQIKMKNKHIFFTKESEKPFFKKSKILSKVEKFLTWVNKPMDEEASQESSSHDNVHDASTSSDSEEQDMSVKKGDDLLETNNPEPEKCQSVSSAGELETENYERDSLLATVPDEQDCVTQEVPDSRQAETEAEVKKKKNKKKNKKVNGLPPEIAAVPELAKYWAQRYRLFSRFDDGIKLDREGWFSVTPEKIAEHIAGRVSQSFKCDVVVDAFCGVGGNTIQFALTGMRVIAIDIDPVKIALARNNAEVYGIADKIEFICGDFLLLASFLKADVVFLSPPWGGPDYATAETFDIRTMMSPDGFEIFRLSKKITNNIVYFLPRNADIDQVASLAGPGGQVEIEQNFLNNKLKTITAYFGDLIRRPASET

SEQ ID NO: 92173 - protein, 53 aa, Homo sapiens
  Payload ID: 18462
  Gene Name: trimethylguanosine synthase 1
  ENSP ID: ENSP00000430467
MCCEKWSRVAEMFLFIEEREDCKILCLCSRAFVERPGDRRRGRWLFLWYCRIT

SEQ ID NO: 92174 - protein, 421 aa, Homo sapiens
  Payload ID: 18463
  Gene Name: trimethyllysine hydroxylase, epsilon
  Uniprot ID: Q9NVH6
  ENSP ID: ENSP00000335261
MWYHRLSHLHSRLQDLLKGGVIYPALPQPNFKSLLPLAVHWHHTASKSLTCAWQQHEDHFELKYANTVMRFDYVWLRDHCRSASCYNSKTHQRSLDTASVDLCIKPKTIRLDETTLFFTWPDGHVTKYDLNWLVKNSYEGQKQKVIQPRILWNAEIYQQAQVPSVDCQSFLETNEGLKKFLQNFLLYGIAFVENVPPTQEHTEKLAERISLIRETIYGRMWYFTSDFSRGDTAYTKLALDRHTDTTYFQEPCGIQVFHCLKHEGTGGRTLLVDGFYAAEQVLQKAPEEFELLSKVPLKHEYIEDVGECHNHMIGIGPVLNIYPWNKELYLIRYNNYDRAVINTVPYDVVHRWYTAHRTLTIELRRPENEFWVKLKPGRVLFIDNWRVLHGRECFTGYRQLCGCYLTRDDVLNTARLLGLQA

SEQ ID NO: 92175 - protein, 376 aa, Homo sapiens
  Payload ID: 18463
  Gene Name: trimethyllysine hydroxylase, epsilon
  Uniprot ID: Q9NVH6
  ENSP ID: ENSP00000358447
MWYHRLSHLHSRLQDLLKGGVIYPALPQPNFKSLLPLAVHWHHTASKSLTCAWQQHEDHFELKYANTVMRFDYVWLRDHCRSASCYNSKTHQRSLDTASVDLCIKPKTIRLDETTLFFTWPDGHVTKYDLNWLVKNSYEGQKQKVIQPRILWNAEIYQQAQVPSVDCQSFLETNEGLKKFLQNFLLYGIAFVENVPPTQEHTEKLAERISLIRETIYGRMWYFTSDFSRGDTAYTKLALDRHTDTTYFQEPCGIQVFHCLKHEGTGGRTLLVDGFYAAEQVLQKAPEEFELLSKVPLKHEYIEDVGECHNHMIGIGPVLNIYPWNKELYLIRLFKEKQNTVNRQWNSSLQCDIPERILTYRHFVSGTSIEHRGSLI

SEQ ID NO: 92176 - protein, 407 aa, Homo sapiens
  Payload ID: 18464
  Gene Name: trinucleotide repeat containing 18
  ENSP ID: ENSP00000329902
  MOD_RES (1)..(1): Any amino acid
XYRVVVEGERGNRPHIYCLEQLLQEAIIDVRPASTRFLPQGTRIAAYWSQQYRCLYPGTVVRGLLDLEDDGDLITVEFDDGDTGRIPLSHIRLLPPDYKIQCAEPSPALLVPSAKRRSRKTSKDTGEGKDGGTAGSEEPGAKARGRGRKPSAKAKGDRAATLEEGNPTDEVPSTPLALEPSSTPGSKKSPPEPVDKRAKAPKARPAPPQPSPAPPAFTSCPAPEPFAELPAPATSLAPAPLITMPATRPKPKKARAAEESGAKGPRRPGEEAELLVKLDHEGVTSPKSKKAKEALLLREDPGAGGWQEPKSLLSLGSYPPAAGSSEPKAPWPKATDGDLAQEPGPGLTFEDSGNPKSPDKAQAEQDGAEESESSSSSSSGSSSSSSSSSSSGSETEGEEEGDKNGDG

SEQ ID NO: 92177 - protein, 130 aa, Homo sapiens
  Payload ID: 18464
  Gene Name: trinucleotide repeat containing 18
  ENSP ID: ENSP00000382364
MGPSASSHGSPVPLPSDLSFRSPTPSNLPMVQLWAAHAHEGFSHLPSGLYPSYLHLNHLEPPSSGSPLLSQLGQPSIFDTQKGQGPGGGKTGVRGWGWHRGLLRGFWGLWQHPGSPQLCPGCWLFFFFFF

SEQ ID NO: 92178 - protein, 2968 aa, Homo sapiens
  Payload ID: 18464
  Gene Name: trinucleotide repeat containing 18
  ENSP ID: ENSP00000382452
MDGRDFGPQRSVHGPPPPLLSGLAMDSHRVGAATAGRLPASGLPGPLPPGKYMAGLNLHPHPGEAFLGSFVASGMGPSASSHGSPVPLPSDLSFRSPTPSNLPMVQLWAAHAHEGFSHLPSGLYPSYLHLNHLEPPSSGSPLLSQLGQPSIFDTQKGQGPGGDGFYLPTAGAPGSLHSHAPSARTPGGGHSSGAPAKGSSSRDGPAKERAGRGGEPPPLFGKKDPRARGEEASGPRGVVDLTQEARAEGRQDRGPPRLAERLSPFLAESKTKNAALQPSVLTMCNGGAGDVGLPALVAEAGRGGAKEAARQDEGARLLRRTETLLPGPRPCPSPLPPPPAPPKGPPAPPAATPAGVYTVFREQGREHRVVAPTFVPSVEAFDERPGPIQIASQARDARAREREAGRPGVLQAPPGSPRPLDRPEGLREKNSVIRSLKRPPPADAPTVRATRASPDPRAYVPAKELLKPEADPRPCERAPRGPAGPAAQQAAKLFGLEPGRPPPTGPEHKWKPFELGNFAATQMAVLAAQHHHSRAEEEAAVVAASSSKKAYLDPGAVLPRSAATCGRPVADMHSAAHGSGEASAMQSLIKYSGSFARDAVAVRPGGCGKKSPFGGLGTMKPEPAPTSAGASRAQARLPHSGGPAAGGGRQLKRDPERPESAKAFGREGSGAQGEAEVRHPPVGIAVAVARQKDSGGSGRLGPGLVDQERSLSLSNVKGHGRADEDCVDDRARHREERLLGARLDRDQEKLLRESKELADLARLHPTSCAPNGLNPNLMVTGGPALAGSGRWSADPAAHLATHPWLPRSGNASMWLAGHPYGLGPPSLHQGMAPAFPPGLGGSLPSAYQFVRDPQSGQLVVIPSDHLPHFAELMERATVPPLWPALYPPGRSPLHHAQQLQLFSQQHFLRQQEFLYLQQQAAQALELQRSAQLVQERLKAQEHRAEMEEKGSKRGLEAAGKAGLATAGPGLLPRKPPGLAAGPAGTYGKAVSPPPSPRASPVAALKAKVIQKLEDVSKPPAYAYPATPSSHPTSPPPASPPPTPGITRKEEAPENVVEKKDLELEKEAPSPFQALFSDIPPRYPFQALPPHYGRPYPFLLQPTAAADADGLAPDVPLPADGPERLALSPEDKPIRLSPSKITEPLREGPEEEPLAEREVKAEVEDMDEGPTELPPLESPLPLPAAEAMATPSPAGGCGGGLLEAQALSATGQSCAEPSECPDFVEGPEPRVDSPGRTEPCTAALDLGVQLTPETLVEAKEEPVEVPVAVPVVEAVPEEGLAQVAPSESQPTLEMSDCDVPAGEGQCPSLEPQEAVPVLGSTCFLEEASSDQFLPSLEDPLAGMNALAAAAELPQARPLPSPGAAGAQALEKLEAAESLVLEQSFLHGITLLSEIAELELERRSQEMGGAERALVARPSLESLLAAGSHMLREVLDGPVVDPLKNLRLPRELKPNKKYSWMRKKEERMYAMKSSLEDMDALELDFRMRLAEVQRQYKEKQRELVKLQRRRDSEDRREEPHRSLARRGPGRPRKRTHAPSALSPPRKRGKSGHSSGKLSSKSLLTSDDYELGAGIRKRHKGSEEEHDALIGMGKARGRNQTWDEHEASSDFISQLKIKKKKMASDQEQLASKLDKALSLTKQDKLKSPFKFSDSAGGKSKTSGGCGRYLTPYDSLLGKNRKALAKGLGLSLKSSREGKHKRAAKTRKMEVGFKARGQPKSAHSPFASEVSSYSYNTDSEEDEEFLKDEWPAQGPSSSKLTPSLLCSMVAKNSKAAGGPKLTKRGLAAPRTLKPKPATSRKQPFCLLLREAEARSSFSDSSEESFDQDESSEEEDEEEELEEEDEASGGGYRLGARERALSPGLEESGLGLLARFAASALPSPTVGPSLSVVQLEAKQKARKKEERQSLLGTEFEYTDSESEVKVRKRSPAGLLRPKKGLGEPGPSLAAPTPGARGPDPSSPDKAKLAVEKGRKARKLRGPKEPGFEAGPEASDDDLWTRRRSERIFLHDASAAAPAPVSTAPATKTSRCAKGGPLSPRKDAGRAKDRKDPRKKKKGKEAGPGAGLPPPRAPALPSEARAPHASSLTAAKRSKAKAKGKEVKKENRGKGGAVSKLMESMAAEEDFEPNQDSSFSEDEHLPRGGAVERPLTPAPRSCIIDKDELKDGLRVLIPMDDKLLYAGHVQTVHSPDIYRVVVEGERGNRPHIYCLEQLLQEAIIDVRPASTRFLPQGTRIAAYWSQQYRCLYPGTVVRGLLDLEDDGDLITVEFDDGDTGRIPLSHIRLLPPDYKIQCAEPSPALLVPSAKRRSRKTSKDTGEGKDGGTAGSEEPGAKARGRGRKPSAKAKGGRAATLEEGNPTDEVPSTPLALEPSSTPGSKKSPPEPVDKRAKAPKARPAPPQPSPAPPAFTSCPAPEPFAELPAPATSLAPAPLITMPATRPKPKKARAAEESGAKGPRRPGEEAELLVKLDHEGVTSPKSKKAKEALLLREDPGAGGWQEPKSLLSLGSYPPAAGSSEPKAPWPKATDGDLAQEPGPGLTFEDSGNPKSPDKAQAEQDGAEESESSSSSSSGSSSSSSSSSSSGSETEGEEEGDKNGDGGCGTGGRNCSAASSRAASPASSSSSSSSSSSSSSSSSSSSSSSSSSSSSSSSSSSSSSSSSSSSSSSSSSSSSSSSSSTTDEDSSCSSDDEAAPAPTAGPSAQAALPTKATKQAGKARPSAHSPGKKTPAPQPQAPPPQPTQPLQPKAQAGAKSRPKKREGVHLPTTKELAKRQRLPSVENRPKIAAFLPARQLWKWFGKPTQRRGMKGKARKLFYKAIVRGKEMIRIGDCAVFLSAGRPNLPYIGRIQSMWESWGNNMVVRVKWFYHPEETSPGKQFHQGQHWDQKSSRSLPAALRVSSQRKDFMERALYQSSHVDENDVQTVSHKCLVVGLEQYEQMLKTKKYQDSEGLYYLAGTYEPTTGMIFSTDGVPVLC

SEQ ID NO: 92179 - protein, 2968 aa, Homo sapiens
  Payload ID: 18464
  Gene Name: trinucleotide repeat containing 18
  Uniprot ID: O15417
  ENSP ID: ENSP00000395538
MDGRDFGPQRSVHGPPPPLLSGLAMDSHRVGAATAGRLPASGLPGPLPPGKYMAGLNLHPHPGEAFLGSFVASGMGPSASSHGSPVPLPSDLSFRSPTPSNLPMVQLWAAHAHEGFSHLPSGLYPSYLHLNHLEPPSSGSPLLSQLGQPSIFDTQKGQGPGGDGFYLPTAGAPGSLHSHAPSARTPGGGHSSGAPAKGSSSRDGPAKERAGRGGEPPPLFGKKDPRARGEEASGPRGVVDLTQEARAEGRQDRGPPRLAERLSPFLAESKTKNAALQPSVLTMCNGGAGDVGLPALVAEAGRGGAKEAARQDEGARLLRRTETLLPGPRPCPSPLPPPPAPPKGPPAPPAATPAGVYTVFREQGREHRVVAPTFVPSVEAFDERPGPIQIASQARDARAREREAGRPGVLQAPPGSPRPLDRPEGLREKNSVIRSLKRPPPADAPTVRATRASPDPRAYVPAKELLKPEADPRPCERAPRGPAGPAAQQAAKLFGLEPGRPPPTGPEHKWKPFELGNFAATQMAVLAAQHHHSRAEEEAAVVAASSSKKAYLDPGAVLPRSAATCGRPVADMHSAAHGSGEASAMQSLIKYSGSFARDAVAVRPGGCGKKSPFGGLGTMKPEPAPTSAGASRAQARLPHSGGPAAGGGRQLKRDPERPESAKAFGREGSGAQGEAEVRHPPVGIAVAVARQKDSGGSGRLGPGLVDQERSLSLSNVKGHGRADEDCVDDRARHREERLLGARLDRDQEKLLRESKELADLARLHPTSCAPNGLNPNLMVTGGPALAGSGRWSADPAAHLATHPWLPRSGNASMWLAGHPYGLGPPSLHQGMAPAFPPGLGGSLPSAYQFVRDPQSGQLVVIPSDHLPHFAELMERATVPPLWPALYPPGRSPLHHAQQLQLFSQQHFLRQQEFLYLQQQAAQALELQRSAQLVQERLKAQEHRAEMEEKGSKRGLEAAGKAGLATAGPGLLPRKPPGLAAGPAGTYGKAVSPPPSPRASPVAALKAKVIQKLEDVSKPPAYAYPATPSSHPTSPPPASPPPTPGITRKEEAPENVVEKKDLELEKEAPSPFQALFSDIPPRYPFQALPPHYGRPYPFLLQPTAAADADGLAPDVPLPADGPERLALSPEDKPIRLSPSKITEPLREGPEEEPLAEREVKAEVEDMDEGPTELPPLESPLPLPAAEAMATPSPAGGCGGGLLEAQALSATGQSCAEPSECPDFVEGPEPRVDSPGRTEPCTAALDLGVQLTPETLVEAKEEPVEVPVAVPVVEAVPEEGLAQVAPSESQPTLEMSDCDVPAGEGQCPSLEPQEAVPVLGSTCFLEEASSDQFLPSLEDPLAGMNALAAAAELPQARPLPSPGAAGAQALEKLEAAESLVLEQSFLHGITLLSEIAELELERRSQEMGGAERALVARPSLESLLAAGSHMLREVLDGPVVDPLKNLRLPRELKPNKKYSWMRKKEERMYAMKSSLEDMDALELDFRMRLAEVQRQYKEKQRELVKLQRRRDSEDRREEPHRSLARRGPGRPRKRTHAPSALSPPRKRGKSGHSSGKLSSKSLLTSDDYELGAGIRKRHKGSEEEHDALIGMGKARGRNQTWDEHEASSDFISQLKIKKKKMASDQEQLASKLDKALSLTKQDKLKSPFKFSDSAGGKSKTSGGCGRYLTPYDSLLGKNRKALAKGLGLSLKSSREGKHKRAAKTRKMEVGFKARGQPKSAHSPFASEVSSYSYNTDSEEDEEFLKDEWPAQGPSSSKLTPSLLCSMVAKNSKAAGGPKLTKRGLAAPRTLKPKPATSRKQPFCLLLREAEARSSFSDSSEESFDQDESSEEEDEEEELEEEDEASGGGYRLGARERALSPGLEESGLGLLARFAASALPSPTVGPSLSVVQLEAKQKARKKEERQSLLGTEFEYTDSESEVKVRKRSPAGLLRPKKGLGEPGPSLAAPTPGARGPDPSSPDKAKLAVEKGRKARKLRGPKEPGFEAGPEASDDDLWTRRRSERIFLHDASAAAPAPVSTAPATKTSRCAKGGPLSPRKDAGRAKDRKDPRKKKKGKEAGPGAGLPPPRAPALPSEARAPHASSLTAAKRSKAKAKGKEVKKENRGKGGAVSKLMESMAAEEDFEPNQDSSFSEDEHLPRGGAVERPLTPAPRSCIIDKDELKDGLRVLIPMDDKLLYAGHVQTVHSPDIYRVVVEGERGNRPHIYCLEQLLQEAIIDVRPASTRFLPQGTRIAAYWSQQYRCLYPGTVVRGLLDLEDDGDLITVEFDDGDTGRIPLSHIRLLPPDYKIQCAEPSPALLVPSAKRRSRKTSKDTGEGKDGGTAGSEEPGAKARGRGRKPSAKAKGDRAATLEEGNPTDEVPSTPLALEPSSTPGSKKSPPEPVDKRAKAPKARPAPPQPSPAPPAFTSCPAPEPFAELPAPATSLAPAPLITMPATRPKPKKARAAEESGAKGPRRPGEEAELLVKLDHEGVTSPKSKKAKEALLLREDPGAGGWQEPKSLLSLGSYPPAAGSSEPKAPWPKATDGDLAQEPGPGLTFEDSGNPKSPDKAQAEQDGAEESESSSSSSSGSSSSSSSSSSSGSETEGEEEGDKNGDGGCGTGGRNCSAASSRAASPASSSSSSSSSSSSSSSSSSSSSSSSSSSSSSSSSSSSSSSSSSSSSSSSSSSSSSSSSSTTDEDSSCSSDDEAAPAPTAGPSAQAALPTKATKQAGKARPSAHSPGKKTPAPQPQAPPPQPTQPLQPKAQAGAKSRPKKREGVHLPTTKELAKRQRLPSVENRPKIAAFLPARQLWKWFGKPTQRRGMKGKARKLFYKAIVRGKEMIRIGDCAVFLSAGRPNLPYIGRIQSMWESWGNNMVVRVKWFYHPEETSPGKQFHQGQHWDQKSSRSLPAALRVSSQRKDFMERALYQSSHVDENDVQTVSHKCLVVGLEQYEQMLKTKKYQDSEGLYYLAGTYEPTTGMIFSTDGVPVLC

SEQ ID NO: 92180 - protein, 252 aa, Homo sapiens
  Payload ID: 18464
  Gene Name: trinucleotide repeat containing 18
  ENSP ID: ENSP00000395990
AMKSSLEDMDALELDFRMRLAEVQRQYKEKQRELVKLQRRRDSELSSKSLLTSDDYELGAGIRKRHKGSEEEHDALIGMGKARGRNQTWDEHEASSDFISQLKIKKKKMASDQEQLASKLDKALSLTKQDKLKSPFKFSDSAGGKSKTSGGCGRYLTPYDSLLGKNRKALAKGLGLSLKSSREGKHKRAAKTRKMEVGFKARGQPKSAHSPFASEVSSYSYNTDSEEDEEFLKDEWPAQGPSSSKLTPSLLC

SEQ ID NO: 92181 - protein, 192 aa, Homo sapiens
  Payload ID: 18464
  Gene Name: trinucleotide repeat containing 18
  ENSP ID: ENSP00000398809
  MOD_RES (1)..(1): Any amino acid
XVEKGRKARKLRGPKEPGFEAGPEASDDDLWTRRRSERIFLHDASAAAPAPVSTAPATKTSRCAKGGPLSPRKDAGRAKDRKDPRKVPATVSKGRHWKKKGKEAGPGAGLPPPRAPALPSEARAPHASSLTAAKRSKAKAKGKEVKKENRGKGGAVSKLMESMAAEEDFEPNQDSSFSEDEHLPRGGAVERP

SEQ ID NO: 92182 - protein, 99 aa, Homo sapiens
  Payload ID: 18464
  Gene Name: trinucleotide repeat containing 18
  ENSP ID: ENSP00000410856
MGPSASSHGSPVPLPSDLSFRSPTPSNLPMVQLWAAHAHEGFSHLPSGLYPSYLHLNHLEPPSSGSPLLSQLGQPSIFDTQKGQGPGGDGFYLPTAGAP

SEQ ID NO: 92183 - protein, 308 aa, Homo sapiens
  Payload ID: 18464
  Gene Name: trinucleotide repeat containing 18
  ENSP ID: ENSP00000413911
AVAVRPGGCGKKSPFGGLGTMKPEPAPTSAGASRAQARLPHSGGPAAGGGRQLKRDPERPESAKAFGREGSGAQGEAEVRHPPVGIAVAVARQKDSGGSGRLGPGLVDQERSLSLSNVKGHGRADEDCVDDRARHREERLLGARLDRDQEKLLRESKELADLARLHPTSCAPNGLNPNLMVTGGPALAGSGRWSADPAAHLATHPWLPRSGNASMWLAGHPYGLGPPSLHQGMAPAFPPGLGGSLPSAYQFVRDPQSGQLVVIPSDHLPHFAELMERATVPPLWPALYPPGRSPLHHAQQLQLFSQQH

SEQ ID NO: 92184 - protein, 1913 aa, Homo sapiens
  Payload ID: 18465
  Gene Name: trinucleotide repeat containing 6A
  Uniprot ID: Q8NDV7
  ENSP ID: ENSP00000326900
MRELEAKATKDVERNLSRDLVQEEEQLMEEKKKKKDDKKKKEAAQKKATEQKIKVPEQIKPSVSQPQPANSNNGTSTATSTNNNAKRATANNQQPQQQQQQQQPQQQQPQQQPQPQPQQQQPQQQPQALPRYPREVPPRFRHQEHKQLLKRGQHFPVIAANLGSAVKVLNSQSESSALTNQQPQNNGEVQNSKNQSDINHSTSGSHYENSQRGPVSSTSDSSTNCKNAVVSDLSEKEAWPSAPGSDPELASECMDADSASSSESERNITIMASGNTGGEKDGLRNSTGLGSQNKFVVGSSSNNVGHGSSTGPWGFSHGAIISTCQVSVDAPESKSESSNNRMNAWGTVSSSSNGGLNPSTLNSASNHGAWPVLENNGLALKGPVGSGSSGINIQCSTIGQMPNNQSINSKVSGGSTHGTWGSLQETCESEVSGTQKVSFSGQPQNITTEMTGPNNTTNFMTSSLPNSGSVQNNELPSSNTGAWRVSTMNHPQMQAPSGMNGTSLSHLSNGESKSGGSYGTTWGAYGSNYSGDKCSGPNGQANGDTVNATLMQPGVNGPMGTNFQVNTNKGGGVWESGAANSQSTSWGSGNGANSGGSRRGWGTPAQNTGTNLPSVEWNKLPSNQHSNDSANGNGKTFTNGWKSTEEEDQGSATSQTNEQSSVWAKTGGTVESDGSTESTGRLEEKGTGESQSRDRRKIDQHTLLQSIVNRTDLDPRVLSNSGWGQTPIKQNTAWDTETSPRGERKTDNGTEAWGSSATQTFNSGACIDKTSPNGNDTSSVSGWGDPKPALRWGDSKGSNCQGGWEDDSAATGMVKSNQWGNCKEEKAAWNDSQKNKQGWGDGQKSSQGWSVSASDNWGETSRNNHWGEANKKSSSGGSDSDRSVSGWNELGKTSSFTWGNNINPNNSSGWDESSKPTPSQGWGDPPKSNQSLGWGDSSKPVSSPDWNKQQDIVGSWGIPPATGKPPGTGWLGGPIPAPAKEEEPTGWEEPSPESIRRKMEIDDGTSAWGDPSKYNYKNVNMWNKNVPNGNSRSDQQAQVHQLLTPASAISNKEASSGSGWGEPWGEPSTPATTVDNGTSAWGKPIDSGPSWGEPIAAASSTSTWGSSSVGPQALSKSGPKSMQDGWCGDDMPLPGNRPTGWEEEEDVEIGMWNSNSSQELNSSLNWPPYTKKMSSKGLSGKKRRRERGMMKGGNKQEEAWINPFVKQFSNISFSRDSPEENVQSNKMDLSGGMLQDKRMEIDKHSLNIGDYNRTVGKGPGSRPQISKESSMERNPYFDKNGNPSMFGVGNTAAQPRGMQQPPAQPLSSSQPNLRAQVPPPLLSPQVPVSLLKYAPNNGGLNPLFGPQQVAMLNQLSQLNQLSQISQLQRLLAQQQRAQSQRSVPSGNRPQQDQQGRPLSVQQQMMQQSRQLDPNLLVKQQTPPSQQQPLHQPAMKSFLDNVMPHTTPELQKGPSPINAFSNFPIGLNSNLNVNMDMNSIKEPQSRLRKWTTVDSISVNTSLDQNSSKHGAISSGFRLEESPFVPYDFMNSSTSPASPPGSIGDGWPRAKSPNGSSSVNWPPEFRPGEPWKGYPNIDPETDPYVTPGSVINNLSINTVREVDHLRDRNSGSSSSLNTTLPSTSAWSSIRASNYNVPLSSTAQSTSARNSDSKLTWSPGSVTNTSLAHELWKVPLPPKNITAPSRPPPGLTGQKPPLSTWDNSPLRIGGGWGNSDARYTPGSSWGESSSGRITNWLVLKNLTPQIDGSTLRTLCMQHGPLITFHLNLPHGNALVRYSSKEEVVKAQKSLHMCVLGNTTILAEFASEEEISRFFAQSQSLTPSPGWQSLGSSQSRLGSLDCSHSFSSRTDLNHWNGAGLSGTNCGDLHGTSLWGTPHYSTSLWGPPSSSDPRGISSPSPINAFLSVDHLGGGGESM

SEQ ID NO: 92185 - protein, 1962 aa, Homo sapiens
  Payload ID: 18465
  Gene Name: trinucleotide repeat containing 6A
  Uniprot ID: Q8NDV7
  ENSP ID: ENSP00000379144
MRELEAKATKDVERNLSRDLVQEEEQLMEEKKKKKDDKKKKEAAQKKATEQKIKVPEQIKPSVSQPQPANSNNGTSTATSTNNNAKRATANNQQPQQQQQQQQPQQQQPQQQPQPQPQQQQPQQQPQALPRYPREVPPRFRHQEHKQLLKRGQHFPVIAANLGSAVKVLNSQSESSALTNQQPQNNGEVQNSKNQSDINHSTSGSHYENSQRGPVSSTSDSSTNCKNAVVSDLSEKEAWPSAPGSDPELASECMDADSASSSESERNITIMASGNTGGEKDGLRNSTGLGSQNKFVVGSSSNNVGHGSSTGPWGFSHGAIISTCQVSVDAPESKSESSNNRMNAWGTVSSSSNGGLNPSTLNSASNHGAWPVLENNGLALKGPVGSGSSGINIQCSTIGQMPNNQSINSKVSGGSTHGTWGSLQETCESEVSGTQKVSFSGQPQNITTEMTGPNNTTNFMTSSLPNSGSVQNNELPSSNTGAWRVSTMNHPQMQAPSGMNGTSLSHLSNGESKSGGSYGTTWGAYGSNYSGDKCSGPNGQANGDTVNATLMQPGVNGPMGTNFQVNTNKGGGVWESGAANSQSTSWGSGNGANSGGSRRGWGTPAQNTGTNLPSVEWNKLPSNQHSNDSANGNGKTFTNGWKSTEEEDQGSATSQTNEQSSVWAKTGGTVESDGSTESTGRLEEKGTGESQSRDRRKIDQHTLLQSIVNRTDLDPRVLSNSGWGQTPIKQNTAWDTETSPRGERKTDNGTEAWGSSATQTFNSGACIDKTSPNGNDTSSVSGWGDPKPALRWGDSKGSNCQGGWEDDSAATGMVKSNQWGNCKEEKAAWNDSQKNKQGWGDGQKSSQGWSVSASDNWGETSRNNHWGEANKKSSSGGSDSDRSVSGWNELGKTSSFTWGNNINPNNSSGWDESSKPTPSQGWGDPPKSNQSLGWGDSSKPVSSPDWNKQQDIVGSWGIPPATGKPPGTGWLGGPIPAPAKEEEPTGWEEPSPESIRRKMEIDDGTSAWGDPSKYNYKNVNMWNKNVPNGNSRSDQQAQVHQLLTPASAISNKEASSGSGWGEPWGEPSTPATTVDNGTSAWGKPIDSGPSWGEPIAAASSTSTWGSSSVGPQALSKSGPKSMQDGWCGDDMPLPGNRPTGWEEEEDVEIGMWNSNSSQELNSSLNWPPYTKKMSSKGLSGKKRRRERGMMKGGNKQEEAWINPFVKQFSNISFSRDSPEENVQSNKMDLSGGMLQDKRMEIDKHSLNIGDYNRTVGKGPGSRPQISKESSMERNPYFDKDGIVADESQNMQFMSSQSMKLPPSNSALPNQALGSIAGLGMQNLNSVRQNGNPSMFGVGNTAAQPRGMQQPPAQPLSSSQPNLRAQVPPPLLSPQVPVSLLKYAPNNGGLNPLFGPQQVAMLNQLSQLNQLSQISQLQRLLAQQQRAQSQRSVPSGNRPQQDQQGRPLSVQQQMMQQSRQLDPNLLVKQQTPPSQQQPLHQPAMKSFLDNVMPHTTPELQKGPSPINAFSNFPIGLNSNLNVNMDMNSIKEPQSRLRKWTTVDSISVNTSLDQNSSKHGAISSGFRLEESPFVPYDFMNSSTSPASPPGSIGDGWPRAKSPNGSSSVNWPPEFRPGEPWKGYPNIDPETDPYVTPGSVINNLSINTVREVDHLRDRNSGSSSSLNTTLPSTSAWSSIRASNYNVPLSSTAQSTSARNSDSKLTWSPGSVTNTSLAHELWKVPLPPKNITAPSRPPPGLTGQKPPLSTWDNSPLRIGGGWGNSDARYTPGSSWGESSSGRITNWLVLKNLTPQIDGSTLRTLCMQHGPLITFHLNLPHGNALVRYSSKEEVVKAQKSLHMCVLGNTTILAEFASEEEISRFFAQSQSLTPSPGWQSLGSSQSRLGSLDCSHSFSSRTDLNHWNGAGLSGTNCGDLHGTSLWGTPHYSTSLWGPPSSSDPRGISSPSPINAFLSVDHLGGGGESM

SEQ ID NO: 92186 - protein, 906 aa, Homo sapiens
  Payload ID: 18465
  Gene Name: trinucleotide repeat containing 6A
  ENSP ID: ENSP00000404278
QQDIVGSWGIPPATGKPPGTGWLGGPIPAPAKEEEPTGWEEPSPESIRRKMEIDDGTSAWGDPSKYNYKNVNMWNKNVPNGNSRSDQQAQVHQLLTPASAISNKEASSGSGPKSMQDGWCGDDMPLPGNRPTGWEEEEDVEIGMWNSNSSQELNSSLNWPPYTKKMSSKGLSGKKRRRERGMMKGGNKQEEAWINPFVKQFSNISFSRDSPEENVQSNKMDLSGGMLQDKRMEIDKHSLNIGDYNRTVGKGPGSRPQISKESSMERNPYFDKNGNPSMFGVGNTAAQPRGMQQPPAQPLSSSQPNLRAQVPPPLLSPQVPVSLLKYAPNNGGLNPLFGPQQVAMLNQLSQLNQLSQISQLQRLLAQQQRAQSQRSVPSGNRPQQDQQGRPLSVQQQMMQQSRQLDPNLLVKQQTPPSQQQPLHQPAMKSFLDNVMPHTTPELQKGPSPINAFSNFPIGLNSNLNVNMDMNSIKEPQSRLRKWTTVDSISVNTSLDQNSSKHGAISSGFRLEESPFVPYDFMNSSTSPASPPGSIGDGWPRAKSPNGSSSVNWPPEFRPGEPWKGYPNIDPETDPYVTPGSVINNLSINTVREVDHLRDRNSGSSSSLNTTLPSTSAWSSIRASNYNVPLSSTAQSTSARNSDSKLTWSPGSVTNTSLAHELWKVPLPPKNITAPSRPPPGLTGQKPPLSTWDNSPLRIGGGWGNSDARYTPGSSWGESSSGRITNWLVLKNLTPQIDGSTLRTLCMQHGPLITFHLNLPHGNALVRYSSKEEVVKAQKSLHMCVLGNTTILAEFASEEEISRFFAQSQSLTPSPGWQSLGSSQSRLGSLDCSHSFSSRTDLNHWNGAGLSGTNCGDLHGTSLWGTPHYSTSLWGPPSSSDPRGISSPSPINAFLSVDHLGGGGESM

SEQ ID NO: 92187 - protein, 160 aa, Homo sapiens
  Payload ID: 18465
  Gene Name: trinucleotide repeat containing 6A
  ENSP ID: ENSP00000456394
STAQSTSARNSDSKLTWSPGSVTNTSLAHELWKVPLPPKNITAPSRPPPGLTGQKPPLSTWDNSPLRIGGGWGNSDARYTPGSSWGESSSGRITNWLVLKNLTPQIDGSTLRTLCMQHGPLITFHLNLPHGNALVRYSSKEEVVKAQKSLHISDLFLLTL

SEQ ID NO: 92188 - protein, 203 aa, Homo sapiens
  Payload ID: 18465
  Gene Name: trinucleotide repeat containing 6A
  ENSP ID: ENSP00000457273
  MOD_RES (1)..(1): Any amino acid
XQDGIVADESQNMQFMSSQSMKLPPSNSALPNQALGSIAGLGMQNLNSVRQNGNPSMFGVGNTAAQPRGMQQPPAQPLSSSQPNLRAQVPPPLLSPQVAMLNQLSQLNQLSQISQLQRLLAQQQRAQSQRSVPSGNRPQQDQQGRPLSVQQQMMQQSRQLDPNLLVKQQTPPSQQQPLHQPAMKSFLDNVMPHTTPELQKGPS

SEQ ID NO: 92189 - protein, 96 aa, Homo sapiens
  Payload ID: 18465
  Gene Name: trinucleotide repeat containing 6A
  ENSP ID: ENSP00000459297
  MOD_RES (1)..(1): Any amino acid
XHTTPELQKGPSPINAFSNFPIGLNSNLNVNMDMNSIKEPQSRLRKWTTVDSISVNTSLDQNSSKHGFVTSGLTTDVAQIGVLRLTCADEKECRSD

SEQ ID NO: 92190 - protein, 40 aa, Homo sapiens
  Payload ID: 18465
  Gene Name: trinucleotide repeat containing 6A
  ENSP ID: ENSP00000460688
  MOD_RES (1)..(1): Any amino acid
XNLGSAVKVLNSQSESSALTNQQPQNNGEVQNSKNQSVNK

SEQ ID NO: 92191 - protein, 1029 aa, Homo sapiens
  Payload ID: 18466
  Gene Name: trinucleotide repeat containing 6B
  Uniprot ID: Q9UPQ9
  ENSP ID: ENSP00000306759
MQTNEGEVSEESSSKVEQEDFVMEGHGKTPPPGEESKQEKEQEREEQLMEDKKRKKEDKKKKEATQKVTEQKTKVPEVTKPSLSQPTAASPIGSSPSPPVNGGNNAKRVAVPNGQPPSAARYMPREVPPRFRCQQDHKVLLKRGQPPPPSCMLLGGGAGPPPCTAPGANPNNAQVTGALLQSESGTAPVWSKSTPPAPDNGTSAWGEPNESSPGWGEMDDTGASTTGWGNTPANAPNAMKPNSKSMQDGWGESDGPVTGARHPSWEEEEDGGVWNTTGSQGSASSHNSASWGQGGKKQMKCSLKGGNNDSWMNPLAKQFSNMGLLSQTEDNPSSKMDLSVGSLSDKKFDVDKRAMNLGDFNDIMRKDRSGFRPPNSKDMGTTDSGPYFEKGGSHGLFGNSTAQSRGLHTPVQPLNSSPSLRAQVPPQFISPQVSASMLKQFPNSGLSPGLFNVGPQLSPQQIAMLSQLPQIPQFQLACQLLLQQQQQQQLLQNQRKISQAVRQQQEQQLARMVSALQQQQQQQQRQPGMKHSPSHPVGPKPHLDNMVPNALNVGLPDLQTKGPIPGYGSGFSSGGMDYGMVGGKEAGTESRFKQWTSMMEGLPSVATQEANMHKNGAIVAPGKTRGGSPYNQFDIIPGDTLGGHTGPAGDSWLPAKSPPTNKIGSKSSNASWPPEFQPGVPWKGIQNIDPESDPYVTPGSVLGGTATSPIVDTDHQLLRDNTTGSNSSLNTSLPSPGAWPYSASDNSFTNVHSTSAKFPDYKSTWSPDPIGHNPTHLSNKMWKNHISSRNTTPLPRPPPGLTNPKPSSPWSSTAPRSVRGWGTQDSRLASASTWSDGGSVRPSYWLVLHNLTPQIDGSTLRTICMQHGPLLTFHLNLTQGTALIRYSTKQEAAKAQTALHMCVLGNTTILAEFATDDEVSRFLAQAQPPTPAATPSAPAAGWQSLETGQNQSDPVGPALNLFGGSTGLGQWSSSAGGSSGADLAGASLWGPPNYSSSLWGVPTVEDPHRMGSPAPLLPGDLLGGGSDSI

SEQ ID NO: 92192 - protein, 1723 aa, Homo sapiens
  Payload ID: 18466
  Gene Name: trinucleotide repeat containing 6B
  Uniprot ID: Q9UPQ9
  ENSP ID: ENSP00000338371
MREKEQEREEQLMEDKKRKKEDKKKKEATQKVTEQKTKVPEVTKPSLSQPTAASPIGSSPSPPVNGGNNAKRVAVPNGQPPSAARYMPREVPPRFRCQQDHKVLLKRGQPPPPSCMLLGGGAGPPPCTAPGANPNNAQVTGALLQSESGTAPDSTLGGAAASNYANSTWGSGASSNNGTSPNPIHIWDKVIVDGSDMEEWPCIASKDTESSSENTTDNNSASNPGSEKSTLPGSTTSNKGKGSQCQSASSGNECNLGVWKSDPKAKSVQSSNSTTENNNGLGNWRNVSGQDRIGPGSGFSNFNPNSNPSAWPALVQEGTSRKGALETDNSNSSAQVSTVGQTSREQQSKMENAGVNFVVSGREQAQIHNTDGPKNGNTNSLNLSSPNPMENKGMPFGMGLGNTSRSTDAPSQSTGDRKTGSVGSWGAARGPSGTDTVSGQSNSGNNGNNGKEREDSWKGASVQKSTGSKNDSWDNNNRSTGGSWNFGPQDSNDNKWGEGNKMTSGVSQGEWKQPTGSDELKIGEWSGPNQPNSSTGAWDNQKGHPLPENQGNAQAPCWGRSSSSTGSEVGGQSTGSNHKAGSSDSHNSGRRSYRPTHPDCQAVLQTLLSRTDLDPRVLSNTGWGQTQIKQDTVWDIEEVPRPEGKSDKGTEGWESAATQTKNSGGWGDAPSQSNQMKSGWGELSASTEWKDPKNTGGWNDYKNNNSSNWGGGRPDEKTPSSWNENPSKDQGWGGGRQPNQGWSSGKNGWGEEVDQTKNSNWESSASKPVSGWGEGGQNEIGTWGNGGNASLASKGGWEDCKRSPAWNETGRQPNSWNKQHQQQQPPQQPPPPQPEASGSWGGPPPPPPGNVRPSNSSWSSGPQPATPKDEEPSGWEEPSPQSISRKMDIDDGTSAWGDPNSYNYKNVNLWDKNSQGGPAPREPNLPTPMTSKSASDSKSMQDGWGESDGPVTGARHPSWEEEEDGGVWNTTGSQGSASSHNSASWGQGGKKQMKCSLKGGNNDSWMNPLAKQFSNMGLLSQTEDNPSSKMDLSVGSLSDKKFDVDKRAMNLGDFNDIMRKDRSGFRPPNSKDMGTTDSGPYFEKGGSHGLFGNSTAQSRGLHTPVQPLNSSPSLRAQVPPQFISPQVSASMLKQFPNSGLSPGLFNVGPQLSPQQIAMLSQLPQIPQFQLACQLLLQQQQQQQLLQNQRKISQAVRQQQEQQLARMVSALQQQQQQQQRQPGMKHSPSHPVGPKPHLDNMVPNALNVGLPDLQTKGPIPGYGSGFSSGGMDYGMVGGKEAGTESRFKQWTSMMEGLPSVATQEANMHKNGAIVAPGKTRGGSPYNQFDIIPGDTLGGHTGPAGDSWLPAKSPPTNKIGSKSSNASWPPEFQPGVPWKGIQNIDPESDPYVTPGSVLGGTATSPIVDTDHQLLRDNTTGSNSSLNTSLPSPGAWPYSASDNSFTNVHSTSAKFPDYKSTWSPDPIGHNPTHLSNKMWKNHISSRNTTPLPRPPPGLTNPKPSSPWSSTAPRSVRGWGTQDSRLASASTWSDGGSVRPSYWLVLHNLTPQIDGSTLRTICMQHGPLLTFHLNLTQGTALIRYSTKQEAAKAQTALHMCVLGNTTILAEFATDDEVSRFLAQAQPPTPAATPSAPAAGWQSLETGQNQSDPVGPALNLFGGSTGLGQWSSSAGGSSGADLAGASLWGPPNYSSSLWGVPTVEDPHRMGSPAPLLPGDLLGGGSDSI

SEQ ID NO: 92193 - protein, 1029 aa, Homo sapiens; identical to SEQ ID NO: 92191
  Payload ID: 18466
  Gene Name: trinucleotide repeat containing 6B
  Uniprot ID: Q9UPQ9
  ENSP ID: ENSP00000384795

SEQ ID NO: 92194 - protein, 37 aa, Homo sapiens
  Payload ID: 18466
  Gene Name: trinucleotide repeat containing 6B
  ENSP ID: ENSP00000397491
MQTNEGEVSEESSSKVEQEDFVMEGHGKTPPPGEESK

SEQ ID NO: 92195 - protein, 1833 aa, Homo sapiens
  Payload ID: 18466
  Gene Name: trinucleotide repeat containing 6B
  Uniprot ID: Q9UPQ9
  ENSP ID: ENSP00000401946
MREKEQEREEQLMEDKKRKKEDKKKKEATQKVTEQKTKVPEVTKPSLSQPTAASPIGSSPSPPVNGGNNAKRVAVPNGQPPSAARYMPREVPPRFRCQQDHKVLLKRGQPPPPSCMLLGGGAGPPPCTAPGANPNNAQVTGALLQSESGTAPDSTLGGAAASNYANSTWGSGASSNNGTSPNPIHIWDKVIVDGSDMEEWPCIASKDTESSSENTTDNNSASNPGSEKSTLPGSTTSNKGKGSQCQSASSGNECNLGVWKSDPKAKSVQSSNSTTENNNGLGNWRNVSGQDRIGPGSGFSNFNPNSNPSAWPALVQEGTSRKGALETDNSNSSAQVSTVGQTSREQQSKMENAGVNFVVSGREQAQIHNTDGPKNGNTNSLNLSSPNPMENKGMPFGMGLGNTSRSTDAPSQSTGDRKTGSVGSWGAARGPSGTDTVSGQSNSGNNGNNGKEREDSWKGASVQKSTGSKNDSWDNNNRSTGGSWNFGPQDSNDNKWGEGNKMTSGVSQGEWKQPTGSDELKIGEWSGPNQPNSSTGAWDNQKGHPLPENQGNAQAPCWGRSSSSTGSEVGGQSTGSNHKAGSSDSHNSGRRSYRPTHPDCQAVLQTLLSRTDLDPRVLSNTGWGQTQIKQDTVWDIEEVPRPEGKSDKGTEGWESAATQTKNSGGWGDAPSQSNQMKSGWGELSASTEWKDPKNTGGWNDYKNNNSSNWGGGRPDEKTPSSWNENPSKDQGWGGGRQPNQGWSSGKNGWGEEVDQTKNSNWESSASKPVSGWGEGGQNEIGTWGNGGNASLASKGGWEDCKRSPAWNETGRQPNSWNKQHQQQQPPQQPPPPQPEASGSWGGPPPPPPGNVRPSNSSWSSGPQPATPKDEEPSGWEEPSPQSISRKMDIDDGTSAWGDPNSYNYKNVNLWDKNSQGGPAPREPNLPTPMTSKSASVWSKSTPPAPDNGTSAWGEPNESSPGWGEMDDTGASTTGWGNTPANAPNAMKPNSKSMQDGWGESDGPVTGARHPSWEEEEDGGVWNTTGSQGSASSHNSASWGQGGKKQMKCSLKGGNNDSWMNPLAKQFSNMGLLSQTEDNPSSKMDLSVGSLSDKKFDVDKRAMNLGDFNDIMRKDRSGFRPPNSKDMGTTDSGPYFEKLTLPFSNQDGCLGDEAPCSPFSPSPSYKLSPSGSTLPNVSLGAIGTGLNPQNFAARQGGSHGLFGNSTAQSRGLHTPVQPLNSSPSLRAQVPPQFISPQVSASMLKQFPNSGLSPGLFNVGPQLSPQQIAMLSQLPQIPQFQLACQLLLQQQQQQQLLQNQRKISQAVRQQQEQQLARMVSALQQQQQQQQRQPGMKHSPSHPVGPKPHLDNMVPNALNVGLPDLQTKGPIPGYGSGFSSGGMDYGMVGGKEAGTESRFKQWTSMMEGLPSVATQEANMHKNGAIVAPGKTRGGSPYNQFDIIPGDTLGGHTGPAGDSWLPAKSPPTNKIGSKSSNASWPPEFQPGVPWKGIQNIDPESDPYVTPGSVLGGTATSPIVDTDHQLLRDNTTGSNSSLNTSLPSPGAWPYSASDNSFTNVHSTSAKFPDYKSTWSPDPIGHNPTHLSNKMWKNHISSRNTTPLPRPPPGLTNPKPSSPWSSTAPRSVRGWGTQDSRLASASTWSDGGSVRPSYWLVLHNLTPQIDGSTLRTICMQHGPLLTFHLNLTQGTALIRYSTKQEAAKAQTALHMCVLGNTTILAEFATDDEVSRFLAQAQPPTPAATPSAPAAGWQSLETGQNQSDPVGPALNLFGGSTGLGQWSSSAGGSSGADLAGASLWGPPNYSSSLWGVPTVEDPHRMGSPAPLLPGDLLGGGSDSI

SEQ ID NO: 92196 - protein, 1391 aa, Homo sapiens
  Payload ID: 18466
  Gene Name: trinucleotide repeat containing 6B
  ENSP ID: ENSP00000409429
  MOD_RES (1)..(1): Any amino acid
XWKSDPKAKSVQSSNSTTENNNGLGNWRNVSGQDRIGPGSGFSNFNPNSNPSAWPALVQEGTSRKGALETDNSNSSAQVSTVGQTSREQQSKMENAGVNFVVSGREQAQIHNTDGPKNGNTNSLNLSSPNPMENKGMPFGMGLGNTSRSTDAPSQSTGDRKTGSVGSWGAARGPSGTDTVSGQSNSGNNGNNGKEREDSWKGASVQKSTGSKNDSWDNNNRSTGGSWNFGPQDSNDNKWGEGNKMTSGVSQGEWKQPTGSDELKIGEWSGPNQPNSSTGAWDNQKGHPLPENQGNAQAPCWGRSSSSTGSEVGGQSTGSNHKAGSSDSHNSGRRSYRPTHPDCQAVLQTLLSRTDLDPRVLSNTGWGQTQIKQDTVWDIEEVPRPEGKSDKGTEGWESAATQTKNSGGWGDAPSQSNQMKSGWGELSASTEWKDPKNTGGWNDYKNNNSSNWGGGRPDEKTPSSWNENPSKDQGWGGGRQPNQGWSSGKNGWGEEVDQTKNSNWESSASKPVSGWGEGGQNEIGTWGNGGNASLASKGGWEDCKRSPAWNETGRQPNSWNKQHQQQQPPQQPPPPQPEASGSWGGPPPPPPGNVRPSNSSWSSGPQPATPKDEEPSGWEEPSPQSISRKMDIDDGTSAWGDPNSYNYKNVNLWDKNSQGGPAPREPNLPTPMTSKSASVWSKSTPPAPDNGTSAWGEPNESSPGWGEMDDTGASTTGWGNTPANAPNAMKPNSKSMQDGWGESDGPVTGARHPSWEEEEDGGVWNTTGSQGSASSHNSASWGQGGKKQMKCSLKGGNNDSWMNPLAKQFSNMGLLSQTEDNPSSKMDLSVGSLSDKKFDVDKRAMNLGDFNDIMRKDRSGFRPPNSKDMGTTDSGPYFEKGGSHGLFGNSTAQSRGLHTPVQPLNSSPSLRAQVPPQFISPQVSASMLKQFPNSGLSPGLFNVGPQLSPQQIAMLSQLPQIPQFQLACQLLLQQQQQQQLLQNQRKISQAVRQQQEQQLARMVSALQQQQQQQQRQPGMKHSPSHPVGPKPHLDNMVPNALNVGLPDLQTKGPIPGYGSGFSSGGMDYGMVGGKEAGTESRFKQWTSMMEGLPSVATQEANMHKNGAIVAPGKTRGGSPYNQFDIIPGDTLGGHTGPAGDSWLPAKSPPTNKIGSKSSNASWPPEFQPGVPWKGIQNIDPESDPYVTPGSVLGGTATSPIVDTDHQLLRDNTTGSNSSLNTSLPSPGAWPYSASDNSFTNVHSTSAKFPDYKSTWSPDPIGHNPTHLSNKMWKNHISSRNTTPLPRPPPGLTNPKPSSPWSSTAPRSVRGWGTQDSRLASASTWSDGGSVRPSYWLVLHNLTPQIDGSTLRTICMQHGPLLTFHLNLTQGTALIRYSTKQEAAKAQTALHM

SEQ ID NO: 92197 - protein, 1690 aa, Homo sapiens
  Payload ID: 18467
  Gene Name: trinucleotide repeat containing 6C
  Uniprot ID: Q9HCJ0
  ENSP ID: ENSP00000301624
MATGSAQGNFTGHTKKTNGNNGTNGALVQSPSNQSALGAGGANSNGSAARVWGVATGSSSGLAHCSVSGGDGKMDTMIGDGRSQNCWGASNSNAGINLNLNPNANPAAWPVLGHEGTVATGNPSSICSPVSAIGQNMGNQNGNPTGTLGAWGNLLPQESTEPQTSTSQNVSFSAQPQNLNTDGPNNTNPMNSSPNPINAMQTNGLPNWGMAVGMGAIIPPHLQGLPGANGSSVSQVSGGSAEGISNSVWGLSPGNPATGNSNSGFSQGNGDTVNSALSAKQNGSSSAVQKEGSGGNAWDSGPPAGPGILAWGRGSGNNGVGNIHSGAWGHPSRSTSNGVNGEWGKPPNQHSNSDINGKGSTGWESPSVTSQNPTVQPGGEHMNSWAKAASSGTTASEGSSDGSGNHNEGSTGREGTGEGRRRDKGIIDQGHIQLPRNDLDPRVLSNTGWGQTPVKQNTAWEFEESPRSERKNDNGTEAWGCAATQASNSGGKNDGSIMNSTNTSSVSGWVNAPPAAVPANTGWGDSNNKAPSGPGVWGDSISSTAVSTAAAAKSGHAWSGAANQEDKSPTWGEPPKPKSQHWGDGQRSNPAWSAGGGDWADSSSVLGHLGDGKKNGSGWDADSNRSGSGWNDTTRSGNSGWGNSTNTKANPGTNWGETLKPGPQQNWASKPQDNNVSNWGGAASVKQTGTGWIGGPVPVKQKDSSEATGWEEPSPPSIRRKMEIDDGTSAWGDPSNYNNKTVNMWDRNNPVIQSSTTTNTTTTTTTTTSNTTHRVETPPPHQAGTQLNRSPLLGPGRKVSSGWGEMPNVHSKTENSWGEPSSPSTLVDNGTAAWGKPPSSGSGWGDHPAEPPVAFGRAGAPVAASALCKPASKSMQEGWGSGGDEMNLSTSQWEDEEGDVWNNAASQESTSSCSSWGNAPKKGLQKGMKTSGKQDEAWIMSRLIKQLTDMGFPREPAEEALKSNNMNLDQAMSALLEKKVDVDKRGLGVTDHNGMAAKPLGCRPPISKESSVDRPTFLDKDGGLVEEPTPSPFLPSPSLKLPLSHSALPSQALGGIASGLGMQNLNSSRQIPSGNLGMFGNSGAAQARTMQQPPQPPVQPLNSSQPSLRAQVPQFLSPQVQAQLLQFAAKNIGLNPALLTSPINPQHMTMLNQLYQLQLAYQRLQIQQQMLQAQRNVSGSMRQQEQQVARTITNLQQQIQQHQRQLAQALLVKQPPPPPPPPHLSLHPSAGKSAMDSFPSHPQTPGLPDLQTKEQQSSPNTFAPYPLAGLNPNMNVNSMDMTGGLSVKDPSQSQSRLPQWTHPNSMDNLPSAASPLEQNPSKHGAIPGGLSIGPPGKSSIDDSYGRYDLIQNSESPASPPVAVPHSWSRAKSDSDKISNGSSINWPPEFHPGVPWKGLQNIDPENDPDVTPGSVPTGPTINTTIQDVNRYLLKSGGKLSDIKSTWSSGPTSHTQASLSHELWKVPRNSTAPTRPPPGLTNPKPSSTWGASPLGWTSSYSSGSAWSTDTSGRTSSWLVLRNLTPQIDGSTLRTLCLQHGPLITFHLNLTQGNAVVRYSSKEEAAKAQKSLHMCVLGNTTILAEFAGEEEVNRFLAQGQALPPTSSWQSSSASSQPRLSAAGSSHGLVRSDAGHWNAPCLGGKGSSELLWGGVPQYSSSLWGPPSADDSRVIGSPTPLTTLLPGDLLSGESL

SEQ ID NO: 92198 - protein, 1726 aa, Homo sapiens
  Payload ID: 18467
  Gene Name: trinucleotide repeat containing 6C
  Uniprot ID: Q9HCJ0
  ENSP ID: ENSP00000336783
MATGSAQGNFTGHTKKTNGNNGTNGALVQSPSNQSALGAGGANSNGSAARVWGVATGSSSGLAHCSVSGGDGKMDTMIGDGRSQNCWGASNSNAGINLNLNPNANPAAWPVLGHEGTVATGNPSSICSPVSAIGQNMGNQNGNPTGTLGAWGNLLPQESTEPQTSTSQNVSFSAQPQNLNTDGPNNTNPMNSSPNPINAMQTNGLPNWGMAVGMGAIIPPHLQGLPGANGSSVSQVSGGSAEGISNSVWGLSPGNPATGNSNSGFSQGNGDTVNSALSAKQNGSSSAVQKEGSGGNAWDSGPPAGPGILAWGRGSGNNGVGNIHSGAWGHPSRSTSNGVNGEWGKPPNQHSNSDINGKGSTGWESPSVTSQNPTVQPGGEHMNSWAKAASSGTTASEGSSDGSGNHNEGSTGREGTGEGRRRDKGIIDQGHIQLPRNDLDPRVLSNTGWGQTPVKQNTAWEFEESPRSERKNDNGTEAWGCAATQASNSGGKNDGSIMNSTNTSSVSGWVNAPPAAVPANTGWGDSNNKAPSGPGVWGDSISSTAVSTAAAAKSGHAWSGAANQEDKSPTWGEPPKPKSQHWGDGQRSNPAWSAGGGDWADSSSVLGHLGDGKKNGSGWDADSNRSGSGWNDTTRSGNSGWGNSTNTKANPGTNWGETLKPGPQQNWASKPQDNNVSNWGGAASVKQTGTGWIGGPVPVKQKDSSEATGWEEPSPPSIRRKMEIDDGTSAWGDPSNYNNKTVNMWDRNNPVIQSSTTTNTTTTTTTTTSNTTHRVETPPPHQAGTQLNRSPLLGPVSSGWGEMPNVHSKTENSWGEPSSPSTLVDNGTAAWGKPPSSGSGWGDHPAEPPVAFGRAGAPVAASALCKPASKSMQEGWGSGGDEMNLSTSQWEDEEGDVWNNAASQESTSSCSSWGNAPKKGLQKGMKTSGKQDEAWIMSRLIKQLTDMGFPREPAEEALKSNNMNLDQAMSALLEKKVDVDKRGLGVTDHNGMAAKPLGCRPPISKESSVDRPTFLDKDGGLVEEPTPSPFLPSPSLKLPLSHSALPSQALGGIASGLGMQNLNSSRQIPSGNLGMFGNSGAAQARTMQQPPQPPVQPLNSSQPSLRAQVPQFLSPQVQAQLLQFAAKNIGLNPALLTSPINPQHMTMLNQLYQLQLAYQRLQIQQQMLQAQRNVSGSMRQQEQQVARTITNLQQQIQQHQRQLAQALLVKQPPPPPPPPHLSLHPSAGKSAMDSFPSHPQTPGLPDLQTKEQQSSPNTFAPYPLAGLNPNMNVNSMDMTGGLSVKDPSQSQSRLPQWTHPNSMDNLPSAASPLEQNPSKHGAIPGGLSIGPPGKSSIDDSYGRYDLIQNSESPASPPVAVPHSWSRAKSDSDKISNGSSINWPPEFHPGVPWKGLQNIDPENDPDVTPGSVPTGPTINTTIQDVNRYLLKSGGSSPPSSQNATLPSSSAWPLSASGYSSSFSSIASAPSVAGKLSDIKSTWSSGPTSHTQASLSHELWKVPRNSTAPTRPPPGLTNPKPSSTWGASPLGWTSSYSSGSAWSTDTSGRTSSWLVLRNLTPQIDGSTLRTLCLQHGPLITFHLNLTQGNAVVRYSSKEEAAKAQKSLHMCVLGNTTILAEFAGEEEVNRFLAQGQALPPTSSWQSSSASSQPRLSAAGSSHGLVRSDAGHWNAPCLGGKGSSELLWGGVPQYSSSLWGPPSADDSRVIGSPTPLTTLLPGDLLSGESL

SEQ ID NO: 92199 - protein, 95 aa, Homo sapiens
  Payload ID: 18467
  Gene Name: trinucleotide repeat containing 6C
  ENSP ID: ENSP00000465707
MATGSAQGNFTGHTKKTNGNNGTNGALVQSPSNQSALGAGGANSNGSAARVWGVATGSSSGLAHCSVSGGDGKMDTMIGDGRSQNCWGASNSNAG

SEQ ID NO: 92200 - protein, 116 aa, Homo sapiens
  Payload ID: 18467
  Gene Name: trinucleotide repeat containing 6C
  ENSP ID: ENSP00000466277
MPNVHSKTENSWGEPSSPSTLVDNGTAAWGKPPSSGSGWGDHPAEPPVAFGRAGAPVAASALCKPASKSMQEGWGSGGDEMNLSTSQWEDEEGDVWNNAASQESTSSCSSWGNAPK

SEQ ID NO: 92201 - protein, 1726 aa, Homo sapiens; identical to SEQ ID NO: 92198
  Payload ID: 18467
  Gene Name: trinucleotide repeat containing 6C
  Uniprot ID: Q9HCJ0
  ENSP ID: ENSP00000467154

SEQ ID NO: 92202 - protein, 1690 aa, Homo sapiens; identical to SEQ ID NO: 92197
  Payload ID: 18467
  Gene Name: trinucleotide repeat containing 6C
  Uniprot ID: Q9HCJ0
  ENSP ID: ENSP00000468647

SEQ ID NO: 92203 - protein, 104 aa, Homo sapiens
  Payload ID: 18468
  Gene Name: TRIO and F-actin binding protein
  ENSP ID: ENSP00000340312
MEEVPGDALCEHFEANILTQNRCQNCFHPEEAHGARYQELRSPSGAEVPYCDLPRCPPAPEDPLSASTSGCQSVVDPGLRPGPKRTGTLLRGRRRRPPAGTSSQ

SEQ ID NO: 92204 - protein, 431 aa, Homo sapiens
  Payload ID: 18468
  Gene Name: TRIO and F-actin binding protein
  Uniprot ID: Q9H2D6
  ENSP ID: ENSP00000383913
MGGWKGPGQRRGKEGPEARRRAAERGGGGGGGGVPAPRSPAREPRPRSCLLLPPPWGAAMTPDLLNFKKGWMSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRENKRVPLTALLNQSRGERRGPPSDGHEALEKEVQALRAQLEAWRLQGEAPQSALRSQEDGHIPPGYISQLVGVITVPVLQTRPLSSERLCDLPKVTPPAGLKGGI

SEQ ID NO: 92205 - protein, 2365 aa, Homo sapiens
  Payload ID: 18468
  Gene Name: TRIO and F-actin binding protein
  Uniprot ID: Q9H2D6
  ENSP ID: ENSP00000384312
MEEVPGDALCEHFEANILTQNRCQNCFHPEEAHGARYQELRSPSGAEVPYCDLPRCPPAPEDPLSASTSGCQSVVDPGLRPGPKRGPSPSAGLPEEGPTAAPRSRSRELEAVPYLEGLTTSLCGSCNEDPGSDPTSSPDSATPDDTSNSSSVDWDTVERQEEEAPSWDELAVMIPRRPREGPRADSSQRAPSLLTRSPVGGDAAGQKKEDTGGGGRSAGQHWARLRGESGLSLERHRSTLTQASSMTPHSGPRSTTSQASPAQRDTAQAASTREIPRASSPHRITQRDTSRASSTQQEISRASSTQQETSRASSTQEDTPRASSTQEDTPRASSTQWNTPRASSPSRSTQLDNPRTSSTQQDNPQTSFPTCTPQRENPRTPCVQQDDPRASSPNRTTQRENSRTSCAQRDNPKASRTSSPNRATRDNPRTSCAQRDNPRASSPSRATRDNPTTSCAQRDNPRASRTSSPNRATRDNPRTSCAQRDNPRASSPSRATRDNPTTSCAQRDNPRASRTSSPNRATRDNPRTSCAQRDNPRASSPNRAARDNPTTSCAQRDNPRASRTSSPNRATRDNPRTSCAQRDNPRASSPNRATRDNPTTSCAQRDNPRASRTSSPNRATRDNPRTSCAQRDNPRASSPNRTTQQDSPRTSCARRDDPRASSPNRTIQQENPRTSCALRDNPRASSPSRTIQQENPRTSCAQRDDPRASSPNRTTQQENPRTSCARRDNPRASSRNRTIQRDNPRTSCAQRDNPRASSPNRTIQQENLRTSCTRQDNPRTSSPNRATRDNPRTSCAQRDNLRASSPIRATQQDNPRTCIQQNIPRSSSTQQDNPKTSCTKRDNLRPTCTQRDRTQSFSFQRDNPGTSSSQCCTQKENLRPSSPHRSTQWNNPRNSSPHRTNKDIPWASFPLRPTQSDGPRTSSPSRSKQSEVPWASIALRPTQGDRPQTSSPSRPAQHDPPQSSFGPTQYNLPSRATSSSHNPGHQSTSRTSSPVYPAAYGAPLTSPEPSQPPCAVCIGHRDAPRASSPPRYLQHDPFPFFPEPRAPESEPPHHEPPYIPPAVCIGHRDAPRASSPPRHTQFDPFPFLPDTSDAEHQCQSPQHEPLQLPAPVCIGYRDAPRASSPPRQAPEPSLLFQDLPRASTESLVPSMDSLHECPHIPTPVCIGHRDAPSFSSPPRQAPEPSLFFQDPPGTSMESLAPSTDSLHGSPVLIPQVCIGHRDAPRASSPPRHPPSDLAFLAPSPSPGSSGGSRGSAPPGETRHNLEREEYTVLADLPPPRRLAQRQPGPQAQCSSGGRTHSPGRAEVERLFGQERRKSEAAGAFQAQDEGRSQQPSQGQSQLLRRQSSPAPSRQVTMLPAKQAELTRRSQAEPPHPWSPEKRPEGDRQLQGSPLPPRTSARTPERELRTQRPLESGQAGPRQPLGVWQSQEEPPGSQGPHRHLERSWSSQEGGLGPGGWWGCGEPSLGAAKAPEGAWGGTSREYKESWGQPEAWEEKPTHELPRELGKRSPLTSPPENWGGPAESSQSWHSGTPTAVGWGAEGACPYPRGSERRPELDWRDLLGLLRAPGEGVWARVPSLDWEGLLELLQARLPRKDPAGHRDDLARALGPELGPPGTNDVPEQESHSQPEGWAEATPVNGHSPALQSQSPVQLPSPACTSTQWPKIKVTRGPATATLAGLEQTGPLGSRSTAKGPSLPELQFQPEEPEESEPSRGQDPLTDQKQADSADKRPAEGKAGSPLKGRLVTSWRMPGDRPTLFNPFLLSLGVLRWRRPDLLNFKKGWMSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRENKRVPLTALLNQSRGERRGPPSDGHEALEKEVQALRAQLEAWRLQGEAPQSALRSQEDGHIPPGYISQEACERSLAEMESSHQQVMEELQRHHERELQRLQQEKEWLLAEETAATASAIEAMKKAYQEELSRELSKTRSLQQGPDGLRKQHQSDVEALKRELQVLSEQYSQKCLEIGALMRQAEEREHTLRRCQQEGQELLRHNQELHGRLSEEIDQLRGFIASQGMGNGCGRSNERSSCELEVLLRVKENELQYLKKEVQCLRDELQMMQKDKRFTSGKYQDVYVELSHIKTRSEREIEQLKEHLRLAMAALQEKESMRNSLAE

SEQ ID NO: 92206 - protein, 652 aa, Homo sapiens
  Payload ID: 18468
  Gene Name: TRIO and F-actin binding protein
  Uniprot ID: Q9H2D6
  ENSP ID: ENSP00000386026
MGGWKGPGQRRGKEGPEARRRAAERGGGGGGGGVPAPRSPAREPRPRSCLLLPPPWGAAMTPDLLNFKKGWMSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRENKRVPLTALLNQSRGERRGPPSDGHEALEKEVQALRAQLEAWRLQGEAPQSALRSQEDGHIPPGYISQEACERSLAEMESSHQQVMEELQRHHERELQRLQQEKEWLLAEETAATASAIEAMKKAYQEELSRELSKTRSLQQGPDGLRKQHQSDVEALKRELQVLSEQYSQKCLEIGALMRQAEEREHTLRRCQQEGQELLRHNQELHGRLSEEIDQLRGFIASQGMGNGCGRSNERSSCELEVLLRVKENELQYLKKEVQCLRDELQMMQKDKRFTSGKYQDVYVELSHIKTRSEREIEQLKEHLRLAMAALQEKESMRNSLAE

SEQ ID NO: 92207 - protein, 256 aa, Homo sapiens
  Payload ID: 18468
  Gene Name: TRIO and F-actin binding protein
  ENSP ID: ENSP00000387881
MSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRE

SEQ ID NO: 92208 - protein, 265 aa, Homo sapiens
  Payload ID: 18468
  Gene Name: TRIO and F-actin binding protein
  ENSP ID: ENSP00000396946
MLQLVAPRPRGCAPLGGTQKPDLLNFKKGWMSILDEPGEPPSPSLTTTSTSQWKKHWFVLTDSSLKYYRDSTAEEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQ

SEQ ID NO: 92209 - protein, 311 aa, Homo sapiens
  Payload ID: 18468
  Gene Name: TRIO and F-actin binding protein
  ENSP ID: ENSP00000399006
  MOD_RES (1)..(1): Any amino acid
XGKEGPEARRRAAERGGGGGGGGVPAPRSPAREPRPRSCLLLPPPWGAAMTPDLLNFKKGWMSILDEPGEADELDGEIDLRSCTDVTEYAVQRNYGFQIHTKDAVYTLSAMTSGIRRNWIEALRKTVRPTSAPDVTKLSDSNKENALHSYSTQKGPLKAGEQRAGSEVISRGGPRKADGQRQALDYVELSPLTQASPQRARTPARTPDRLAKQEELERDLAQRSEERRKWFEATDSRTPEVPAGEGPRRGLGAPLTEDQQNRLSEEIEKKWQELEKLPLRENKRVPLTALLNQSRGERRGPPSDGHEALEK

SEQ ID NO: 92210 - protein, 102 aa, Homo sapiens
  Payload ID: 18468
  Gene Name: TRIO and F-actin binding protein
  ENSP ID: ENSP00000400680
GGGGGVPAPRSPAREPRPRSCLLLPPPWGAAMTVYREGLGCQPTGSPDCGCGRFWIFSCPKPRPICSTSRRDGCRSWTSLESLPPPRSPPPLLRSGRNIGLC

SEQ ID NO: 92211 - protein, 83 aa, Homo sapiens
  Payload ID: 18468
  Gene Name: TRIO and F-actin binding protein
  ENSP ID: ENSP00000407542
MSILDEPGEPPSPSLTTTSTSQWKKHWFVLTDSSLKYYRDSTAEEADELDGEIDLRSCTDVTEYAVQRNYGFQIHTKDAVYTL

SEQ ID NO: 92212 - protein, 596 aa, Homo sapiens
  Payload ID: 18469
  Gene Name: trio Rho guanine nucleotide exchange factor
  Uniprot ID: O75962
  ENSP ID: ENSP00000339291
MLPSQAQGLLWWVFPLFPASSLSYPPVSYRADGLARNTFLKACSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 92213 - protein, 3097 aa, Homo sapiens
  Payload ID: 18469
  Gene Name: trio Rho guanine nucleotide exchange factor
  Uniprot ID: O75962
  ENSP ID: ENSP00000339299
MSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQLENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLQLRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSGTSTPGPSLPPPGAAPEAGPSAPSRRPPGADAEGSEREAEPIPKMKVLESPRKGAANASGSSPDAPAKDARASLGTLPLGKPRAGAASPLNSPLSSAVPSLGKEPFPPSSPLQKGGSFWSSIPASPASRPGSFTFPGDSDSLQRQTPRHAAPGKDTDRMSTCSSASEQSVQSTQSNGSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 92214 - protein, 2309 aa, Homo sapiens
  Payload ID: 18469
  Gene Name: trio Rho guanine nucleotide exchange factor
  ENSP ID: ENSP00000421555
MKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQLENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLQLRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSE

SEQ ID NO: 92215 - protein, 2546 aa, Homo sapiens
  Payload ID: 18469
  Gene Name: trio Rho guanine nucleotide exchange factor
  ENSP ID: ENSP00000426342
IKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQLENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLQLRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSGTSTPGPSLPPPGAAPEAGPSAPSRRPPGADAEGSEREAEPIPKMKVLESPRKGAANASGSSPDAPAKDARASLGTLPLGKPRAGAASPLNSPLSSAVPSLGKEPFPPSSPLQKGGSFWSSIPASPASRPGSFTFPGDSDSLQRQTPRHAAPGKDTDRMSTCSSASEQSVQSTQSNGSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRANWNNWSPY

SEQ ID NO: 92216 - protein, 1508 aa, Homo sapiens
  Payload ID: 18469
  Gene Name: trio Rho guanine nucleotide exchange factor
  ENSP ID: ENSP00000445592
MAEGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQLENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLQLRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFVSIGVQNCKSKGNTIAVFL

SEQ ID NO: 92217 - protein, 255 aa, Homo sapiens
  Payload ID: 18469
  Gene Name: trio Rho guanine nucleotide exchange factor
  ENSP ID: ENSP00000483869
MALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGRVVALCHRFKETFREICWF

SEQ ID NO: 92218 - protein, 575 aa, Homo sapiens
  Payload ID: 18470
  Gene Name: triokinase/FMN cyclase
  Uniprot ID: Q3LXA3
  ENSP ID: ENSP00000378360
MTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVAKAMGTLGVSLSSCSVPGSKPTFELSADEVELGLGIHGEAGVRRIKMATADEIVKLMLDHMTNTTNASHVPVQPGSSVVMMVNNLGGLSFLELGIIADATVRSLEGRGVKIARALVGTFMSALEMPGISLTLLLVDEPLLKLIDAETTAAAWPNVAAVSITGRKRSRVAPAEPQEAPDSTAAGGSASKRMALVLERVCSTLLGLEEHLNALDRAAGDGDCGTTHSRAARAIQEWLKEGPPPASPAQLLSKLSVLLLEKMGGSSGALYGLFLTAAAQPLKAKTSLPAWSAAMDAGLEAMQKYGKAAPGDRTMLDSLWAAGQELQAWKSPGADLLQVLTKAVKSAEAAAEATKNMEAGAGRASYISSARLEQPDPGAVAAAAILRAILEVLQS

SEQ ID NO: 92219 - protein, 162 aa, Homo sapiens
  Payload ID: 18470
  Gene Name: triokinase/FMN cyclase
  ENSP ID: ENSP00000431844
MTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHK

SEQ ID NO: 92220 - protein, 533 aa, Homo sapiens
  Payload ID: 18470
  Gene Name: triokinase/FMN cyclase
  ENSP ID: ENSP00000432539
TSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVAKAMGTLGVSLSSCSVPGSKPTFELSADEVELGLGIHGEAGVRRIKMATADEIVKLMLDHMTNTTNASHVPVQPGSSVVMMVNNLGGLSFLELGIIADATVRSLEGRGVKIARALVGTFMSALEMPGISLTLLLVDEPLLKLIDAETTAAAWPNVAAVSITGRKRSRVAPAEPQEAPDSTAAGGSASKRMALVLERVCSTLLGLEEHLNALDRAAGDGDCGTTHSRAARAIQEWLKEGPPPASPAQLLSKLSVLLLEKMGGSSGALYGLFLTAAAQPLKAKTSLPAWSAAMDAGLEAMQKYGKAAPGDRTMLDSLWAAGQELQAWKSPGADLLQVLTKAVKEGGGLVICP

SEQ ID NO: 92221 - protein, 57 aa, Homo sapiens
  Payload ID: 18470
  Gene Name: triokinase/FMN cyclase
  ENSP ID: ENSP00000434405
MTSKKLVNSVAGCADDALAGLVACNPNLQLLQGHRVALRSDLDSLKGRVALLSGGGS

SEQ ID NO: 92222 - protein, 219 aa, Homo sapiens
  Payload ID: 18470
  Gene Name: triokinase/FMN cyclase
  ENSP ID: ENSP00000459382
SRVAPAEPQEAPDSTAAGGSASKRMALVLERVCSTLLGLEEHLNALDRAAGDGDCGTTHSRAARAIQEWLKEGPPPASPAQLLSKLSVLLLEKMGGSSGALYGLFLTAAAQPLKAKTSLPAWSAAMDAGLEAMQKYGKAAPGDRTMLDSLWAAGQELQAWKSPGADLLQVLTKAVKIRSGPNPKISPPLGESCDHRVYLLKTLFPPLHLRVGDPTALTN

SEQ ID NO: 92223 - protein, 576 aa, Homo sapiens
  Payload ID: 18470
  Gene Name: triokinase/FMN cyclase
  ENSP ID: ENSP00000478735
LQTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVAKAMGTLGVSLSSCSVPGSKPTFELSADEVELGLGIHGEAGVRRIKMATADEIVKLMLDHMTNTTNASHVPVQPGSSVVMMVNNLGGLSFLELGIIADATVRSLEGRGVKIARALVGTFMSALEMPGISLTLLLVDEPLLKLIDAETTAAAWPNVAAVSITGRKRSRVAPAEPQEAPDSTAAGGSASKRMALVLERVCSTLLGLEEHLNALDRAAGDGDCGTTHSRAARAIQEWLKEGPPPASPAQLLSKLSVLLLEKMGGSSGALYGLFLTAAAQPLKAKTSLPAWSAAMDAGLEAMQKYGKAAPGDRTMLDSLWAAGQELQAWKSPGADLLQVLTKAVKSAEAAAEATKNMEAGAGRASYISSARLEQPDPGAVAAAAILRAILEVLQS

SEQ ID NO: 92224 - protein, 286 aa, Homo sapiens
  Payload ID: 18471
  Gene Name: triosephosphate isomerase 1
  Uniprot ID: P60174
  ENSP ID: ENSP00000229270
MAEDGEEAEFHFAALYISGQWPRLRADTDLQRLGSSAMAPSRKFFVGGNWKMNGRKQSLGELIGTLNAAKVPADTEVVCAPPTAYIDFARQKLDPKIAVAAQNCYKVTNGAFTGEISPGMIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSDAVAQSTRIIYGGSVTGATCKELASQPDVDGFLVGGASLKPEFVDIINAKQ

SEQ ID NO: 92225 - protein, 249 aa, Homo sapiens
  Payload ID: 18471
  Gene Name: triosephosphate isomerase 1
  Uniprot ID: P60174
  ENSP ID: ENSP00000379933
MAPSRKFFVGGNWKMNGRKQSLGELIGTLNAAKVPADTEVVCAPPTAYIDFARQKLDPKIAVAAQNCYKVTNGAFTGEISPGMIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSDAVAQSTRIIYGGSVTGATCKELASQPDVDGFLVGGASLKPEFVDIINAKQ

SEQ ID NO: 92226 - protein, 167 aa, Homo sapiens
  Payload ID: 18471
  Gene Name: triosephosphate isomerase 1
  Uniprot ID: P60174
  ENSP ID: ENSP00000443599
MIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSDAVAQSTRIIYGGSVTGATCKELASQPDVDGFLVGGASLKPEFVDIINAKQ

SEQ ID NO: 92227 - protein, 38 aa, Homo sapiens
  Payload ID: 18471
  Gene Name: triosephosphate isomerase 1
  ENSP ID: ENSP00000475184
MIKDCGATWVVLGHSERRHVFGESDELIGQKVAHALAE

SEQ ID NO: 92228 - protein, 113 aa, Homo sapiens
  Payload ID: 18471
  Gene Name: triosephosphate isomerase 1
  ENSP ID: ENSP00000475364
MIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKS

SEQ ID NO: 92229 - protein, 167 aa, Homo sapiens; identical to SEQ ID NO: 92226
  Payload ID: 18471
  Gene Name: triosephosphate isomerase 1
  Uniprot ID: P60174
  ENSP ID: ENSP00000475620

SEQ ID NO: 92230 - protein, 98 aa, Homo sapiens
  Payload ID: 18471
  Gene Name: triosephosphate isomerase 1
  ENSP ID: ENSP00000475829
MIKDCGATWVVLGHSERRHVFGESDELIGQKVAHALAEGLGVIACIGEKLDEREAGITEKVVFEQTKVIADNVKDWSKVVLAYEPVWAIGTGKTATPQ

SEQ ID NO: 92231 - protein, 286 aa, Homo sapiens; identical to SEQ ID NO: 92224
  Payload ID: 18471
  Gene Name: triosephosphate isomerase 1
  Uniprot ID: P60174
  ENSP ID: ENSP00000484435

SEQ ID NO: 92232 - protein, 395 aa, Homo sapiens
  Payload ID: 18472
  Gene Name: tripartite motif containing 10
  Uniprot ID: Q9UDY6
  ENSP ID: ENSP00000259941
MASAASVTSLADEVNCPICQGTLREPVTIDCGHNFCRACLTRYCEIPGPDLEESPTCPLCKEPFRPGSFRPNWQLANVVENIERLQLVSTLGLGEEDVCQEHGEKIYFFCEDDEMQLCVVCREAGEHATHTMRFLEDAAAPYREQIHKCLKCLRKEREEIQEIQSRENKRMQVLLTQVSTKRQQVISEFAHLRKFLEEQQSILLAQLESQDGDILRQRDEFDLLVAGEICRFSALIEELEEKNERPARELLTDIRSTLIRCETRKCRKPVAVSPELGQRIRDFPQQALPLQREMKMFLEKLCFELDYEPAHISLDPQTSHPKLLLSEDHQRAQFSYKWQNSPDNPQRFDRATCVLAHTGITGGRHTWVWMARVPGDSGCCQFCSPPSVLGTEVAA

SEQ ID NO: 92233 - protein, 481 aa, Homo sapiens
  Payload ID: 18472
  Gene Name: tripartite motif containing 10
  Uniprot ID: Q9UDY6
  ENSP ID: ENSP00000343695
MASAASVTSLADEVNCPICQGTLREPVTIDCGHNFCRACLTRYCEIPGPDLEESPTCPLCKEPFRPGSFRPNWQLANVVENIERLQLVSTLGLGEEDVCQEHGEKIYFFCEDDEMQLCVVCREAGEHATHTMRFLEDAAAPYREQIHKCLKCLRKEREEIQEIQSRENKRMQVLLTQVSTKRQQVISEFAHLRKFLEEQQSILLAQLESQDGDILRQRDEFDLLVAGEICRFSALIEELEEKNERPARELLTDIRSTLIRCETRKCRKPVAVSPELGQRIRDFPQQALPLQREMKMFLEKLCFELDYEPAHISLDPQTSHPKLLLSEDHQRAQFSYKWQNSPDNPQRFDRATCVLAHTGITGGRHTWVVSIDLAHGGSCTVGVVSEDVQRKGELRLRPEEGVWAVRLAWGFVSALGSFPTRLTLKEQPRQVRVSLDYEVGWVTFTNAVTREPIYTFTASFTRKVIPFFGLWGRGSSFSLSS

SEQ ID NO: 92234 - protein, 395 aa, Homo sapiens; identical to SEQ ID NO: 92232
  Payload ID: 18472
  Gene Name: tripartite motif containing 10
  Uniprot ID: Q9UDY6
  ENSP ID: ENSP00000365894

SEQ ID NO: 92235 - protein, 481 aa, Homo sapiens; identical to SEQ ID NO: 92233
  Payload ID: 18472
  Gene Name: tripartite motif containing 10
  Uniprot ID: Q9UDY6
  ENSP ID: ENSP00000390497

SEQ ID NO: 92236 - protein, 481 aa, Homo sapiens; identical to SEQ ID NO: 92233
  Payload ID: 18472
  Gene Name: tripartite motif containing 10
  Uniprot ID: Q9UDY6
  ENSP ID: ENSP00000391445

SEQ ID NO: 92237 - protein, 395 aa, Homo sapiens; identical to SEQ ID NO: 92232
  Payload ID: 18472
  Gene Name: tripartite motif containing 10
  Uniprot ID: Q9UDY6
  ENSP ID: ENSP00000393576

SEQ ID NO: 92238 - protein, 395 aa, Homo sapiens; identical to SEQ ID NO: 92232
  Payload ID: 18472
  Gene Name: tripartite motif containing 10
  Uniprot ID: Q9UDY6
  ENSP ID: ENSP00000393787

SEQ ID NO: 92239 - protein, 395 aa, Homo sapiens; identical to SEQ ID NO: 92232
  Payload ID: 18472
  Gene Name: tripartite motif containing 10
  Uniprot ID: Q9UDY6
  ENSP ID: ENSP00000393976

SEQ ID NO: 92240 - protein, 481 aa, Homo sapiens; identical to SEQ ID NO: 92233
  Payload ID: 18472
  Gene Name: tripartite motif containing 10
  Uniprot ID: Q9UDY6
  ENSP ID: ENSP00000395598

SEQ ID NO: 92241 - protein, 481 aa, Homo sapiens; identical to SEQ ID NO: 92233
  Payload ID: 18472
  Gene Name: tripartite motif containing 10
  Uniprot ID: Q9UDY6
  ENSP ID: ENSP00000397073

SEQ ID NO: 92242 - protein, 481 aa, Homo sapiens; identical to SEQ ID NO: 92233
  Payload ID: 18472
  Gene Name: tripartite motif containing 10
  Uniprot ID: Q9UDY6
  ENSP ID: ENSP00000397440

SEQ ID NO: 92243 - protein, 395 aa, Homo sapiens; identical to SEQ ID NO: 92232
  Payload ID: 18472
  Gene Name: tripartite motif containing 10
  Uniprot ID: Q9UDY6
  ENSP ID: ENSP00000398404

SEQ ID NO: 92244 - protein, 481 aa, Homo sapiens; identical to SEQ ID NO: 92233
  Payload ID: 18472
  Gene Name: tripartite motif containing 10
  Uniprot ID: Q9UDY6
  ENSP ID: ENSP00000399446

SEQ ID NO: 92245 - protein, 395 aa, Homo sapiens; identical to SEQ ID NO: 92232
  Payload ID: 18472
  Gene Name: tripartite motif containing 10
  Uniprot ID: Q9UDY6
  ENSP ID: ENSP00000405578

SEQ ID NO: 92246 - protein, 481 aa, Homo sapiens; identical to SEQ ID NO: 92233
  Payload ID: 18472
  Gene Name: tripartite motif containing 10
  Uniprot ID: Q9UDY6
  ENSP ID: ENSP00000410849

SEQ ID NO: 92247 - protein, 395 aa, Homo sapiens; identical to SEQ ID NO: 92232
  Payload ID: 18472
  Gene Name: tripartite motif containing 10
  Uniprot ID: Q9UDY6
  ENSP ID: ENSP00000412370

SEQ ID NO: 92248 - protein, 468 aa, Homo sapiens
  Payload ID: 18473
  Gene Name: tripartite motif containing 11
  Uniprot ID: Q96F44
  ENSP ID: ENSP00000284551
MAAPDLSTNLQEEATCAICLDYFTDPVMTDCGHNFCRECIRRCWGQPEGPYACPECRELSPQRNLRPNRPLAKMAEMARRLHPPSPVPQGVCPAHREPLAAFCGDELRLLCAACERSGEHWAHRVRPLQDAAEDLKAKLEKSLEHLRKQMQDALLFQAQADETCVLWQKMVESQRQNVLGEFERLRRLLAEEEQQLLQRLEEEELEVLPRLREGAAHLGQQSAHLAELIAELEGRCQLPALGLLQDIKDALRRVQDVKLQPPEVVPMELRTVCRVPGLVETLRRFRGDVTLDPDTANPELILSEDRRSVQRGDLRQALPDSPERFDPGPCVLGQERFTSGRHYWEVEVGDRTSWALGVCRENVNRKEKGELSAGNGFWILVFLGSYYNSSERALAPLRDPPRRVGIFLDYEAGHLSFYSATDGSLLFIFPEIPFSGTLRPLFSPLSSSPTPMTICRPKGGSGDTLAPQ

SEQ ID NO: 92249 - protein, 385 aa, Homo sapiens
  Payload ID: 18473
  Gene Name: tripartite motif containing 11
  Uniprot ID: Q96F44
  ENSP ID: ENSP00000355660
MAAPDLSTNLQEEATCAICLDYFTDPVMTDCGHNFCRECIRRCWGQPEGPYACPECRELSPQRNLRPNRPLAKMAEMARRLHPPSPVPQGVCPAHREPLAAFCGDELRLLCAACERSGEHWAHRVRPLQDAAEDLKAKLEKSLEHLRKQMQDALLFQAQADETCVLWQKMVESQRQNVLGEFERLRRLLAEEEQQLLQRLEEEELEVLPRLREGAAHLGQQSAHLAELIAELEGRCQLPALGLLQDIKDALRRVQDVKLQPPEVVPMELRTVCRVPGLVETLRRFRGRCGGPRWGDDSRRGPAKDLGSQPRVLCPATASSKLTVSWWWVVGKTSSAHTSDISCVGIFTPNNSSTSGNELGIQGFHSALNRIASADTTGVSTDPTD

SEQ ID NO: 92250 - protein, 343 aa, Homo sapiens
  Payload ID: 18473
  Gene Name: tripartite motif containing 11
  ENSP ID: ENSP00000473360
MSHGPAWPLPQAKLEKSLEHLRKQMQDALLFQAQADETCVLWQKMVESQRQNVLGEFERLRRLLAEEEQQLLQRLEEEELEVLPRLREGAAHLGQQSAHLAELIAELEGRCQLPALGLLQDIKDALRRVQDVKLQPPEVVPMELRTVCRVPGLVETLRRFRGDVTLDPDTANPELILSEDRRSVQRGDLRQALPDSPERFDPGPCVLGQERFTSGRHYWEVEVGDRTSWALGVCRENVNRKEKGELSAGNGFWILVFLGSYYNSSERALAPLRDPPRRVGIFLDYEAGHLSFYSATDGSLLFIFPEIPFSGTLRPLFSPLSSSPTPMTICRPKGGSGDTLAPQ

SEQ ID NO: 92251 - protein, 228 aa, Homo sapiens
  Payload ID: 18473
  Gene Name: tripartite motif containing 11
  ENSP ID: ENSP00000473574
  MOD_RES (1)..(1): Any amino acid
XRPLQDAAEDLKAKLEKSLEHLRKQMQDALLFQAQADETCVLWQDIKDALRRVQDVKLQPPEVVPMELRTVCRVPGLVETLRRFRGDVTLDPDTANPELILSEDRRSVQRGDLRQALPDSPERFDPGPCVLGQERFTSGRHYWEVEVGDRTSWALGVCRENVNRKEKGELSAGNGFWILVFLGSYYNSSERALAPLRDPPRRVGIFLDYEAGHLSFYSATDGSLLFIF

SEQ ID NO: 92252 - protein, 54 aa, Homo sapiens
  Payload ID: 18473
  Gene Name: tripartite motif containing 11
  ENSP ID: ENSP00000473579
RPLQDAAEDLKDIKDALRRYEPSLSWRGGRREWGGTQLLAMATTPGLSPLGSRM

SEQ ID NO: 92253 - protein, 410 aa, Homo sapiens
  Payload ID: 18474
  Gene Name: tripartite motif containing 13
  Uniprot ID: O60858
  ENSP ID: ENSP00000348299
MDVMELLEEDLTCPICCSLFDDPRVLPCSHNFCKKCLEGILEGSVRNSLWRPAPFKCPTCRKETSATGINSLQVNYSLKGIVEKYNKIKISPKMPVCKGHLGQPLNIFCLTDMQLICGICATRGEHTKHVFCSIEDAYAQERDAFESLFQSFETWRRGDALSRLDTLETSKRKSLQLLTKDSDKVKEFFEKLQHTLDQKKNEILSDFETMKLAVMQAYDPEINKLNTILQEQRMAFNIAEAFKDVSEPIVFLQQMQEFREKIKVIKETPLPPSNLPASPLMKNFDTSQWEDIKLVDVDKLSLPQDTGTFISKIPWSFYKLFLLILLLGLVIVFGPTMFLEWSLFDDLATWKGCLSNFSSYLTKTADFIEQSVFYWEQVTDGFFIFNERFKNFTLVVLNNVAEFVCKYKLL

SEQ ID NO: 92254 - protein, 407 aa, Homo sapiens
  Payload ID: 18474
  Gene Name: tripartite motif containing 13
  Uniprot ID: O60858
  ENSP ID: ENSP00000367424
MELLEEDLTCPICCSLFDDPRVLPCSHNFCKKCLEGILEGSVRNSLWRPAPFKCPTCRKETSATGINSLQVNYSLKGIVEKYNKIKISPKMPVCKGHLGQPLNIFCLTDMQLICGICATRGEHTKHVFCSIEDAYAQERDAFESLFQSFETWRRGDALSRLDTLETSKRKSLQLLTKDSDKVKEFFEKLQHTLDQKKNEILSDFETMKLAVMQAYDPEINKLNTILQEQRMAFNIAEAFKDVSEPIVFLQQMQEFREKIKVIKETPLPPSNLPASPLMKNFDTSQWEDIKLVDVDKLSLPQDTGTFISKIPWSFYKLFLLILLLGLVIVFGPTMFLEWSLFDDLATWKGCLSNFSSYLTKTADFIEQSVFYWEQVTDGFFIFNERFKNFTLVVLNNVAEFVCKYKLL

SEQ ID NO: 92255 - protein, 266 aa, Homo sapiens
  Payload ID: 18474
  Gene Name: tripartite motif containing 13
  ENSP ID: ENSP00000367425
MELLEEDLTCPICCSLFDDPRVLPCSHNFCKKCLEGILEGSVRNSLWRPAPFKCPTCRKETSATGINSLQVNYSLKGIVEKYNKIKISPKMPVCKGHLGQPLNIFCLTDMQLICGICATRGEHTKHVFCSIEDAYAQERDAFESLFQSFETWRRGDALSRLDTLETSKRKSLQLLTKDSDKVKEFFEKLQHTLDQKKNEILSDFETMKLAVMQAYDPEINKLNTILQEQRMAFNIAEAFKDVSEPIVFLQQMQEFREKIKVIKETP

SEQ ID NO: 92256 - protein, 407 aa, Homo sapiens; identical to SEQ ID NO: 92254
  Payload ID: 18474
  Gene Name: tripartite motif containing 13
  Uniprot ID: O60858
  ENSP ID: ENSP00000399206

SEQ ID NO: 92257 - protein, 129 aa, Homo sapiens
  Payload ID: 18474
  Gene Name: tripartite motif containing 13
  ENSP ID: ENSP00000404586
MELLEEDLTCPICCSLFDDPRVLPCSHNFCKKCLEGILEGSVRNSLWRPAPFKCPTCRKETSATGINSLQVNYSLKGIVEKYNKIKISPKMPVCKGHLGQPLNIFCLTDMQLICGICATRGEHTKHVFC

SEQ ID NO: 92258 - protein, 407 aa, Homo sapiens; identical to SEQ ID NO: 92254
  Payload ID: 18474
  Gene Name: tripartite motif containing 13
  Uniprot ID: O60858
  ENSP ID: ENSP00000412943

SEQ ID NO: 92259 - protein, 442 aa, Homo sapiens
  Payload ID: 18475
  Gene Name: tripartite motif containing 14
  Uniprot ID: Q14142
  ENSP ID: ENSP00000343990
MAGAATGSRTPGRSELVEGCGWRCPEHGDRVAELFCRRCRRCVCALCPVLGAHRGHPVGLALEAAVHVQKLSQECLKQLAIKKQQHIDNITQIEDATEKLKANAESSKTWLKGKFTELRLLLDEEEALAKKFIDKNTQLTLQVYREQADSCREQLDIMNDLSNRVWSISQEPDPVQRLQAYTATEQEMQQQMSLGELCHPVPLSFEPVKSFFKGLVEAVESTLQTPLDIRLKESINCQLSDPSSTKPGTLLKTSPSPERSLLLKYARTPTLDPDTMHARLRLSADRLTVRCGLLGSLGPVPVLRFDALWQVLARDCFATGRHYWEVDVQEAGAGWWVGAAYASLRRRGASAAARLGCNRQSWCLKRYDLEYWAFHDGQRSRLRPRDDLDRLGVFLDYEAGVLAFYDVTGGMSHLHTFRATFQEPLYPALRLWEGAISIPRLP

SEQ ID NO: 92260 - protein, 442 aa, Homo sapiens; identical to SEQ ID NO: 92259
  Payload ID: 18475
  Gene Name: tripartite motif containing 14
  Uniprot ID: Q14142
  ENSP ID: ENSP00000344208

SEQ ID NO: 92261 - protein, 442 aa, Homo sapiens; identical to SEQ ID NO: 92259
  Payload ID: 18475
  Gene Name: tripartite motif containing 14
  Uniprot ID: Q14142
  ENSP ID: ENSP00000364239

SEQ ID NO: 92262 - protein, 110 aa, Homo sapiens
  Payload ID: 18475
  Gene Name: tripartite motif containing 14
  ENSP ID: ENSP00000428805
MAGAATGSRTPGRSELVEGCGWRCPEHGDRVAELFCRRCRRCVCALCPVLGAHRGHPVGLALEAAVHVQGLEYQPGARSCPEASGIHGHRAGDAAADEPRGAVPSRAPLL

SEQ ID NO: 92263 - protein, 465 aa, Homo sapiens [sequence omitted]

SEQ ID NO: 92264 - protein, 115 aa, Homo sapiens
  Payload ID: 18476
  Gene Name: tripartite motif containing 15
  Uniprot ID: Q9C019
  ENSP ID: ENSP00000365878
MPATPSLKVVHELPACTLCAGPLEDAVTIPCGHTFCRLCLPALSQMGAQSSGKILLCPLCQEEEQAETPMAPVPLGPLGETYCEEHGEKIYFFCENDAEFLCTSECRTTDGFGCA

SEQ ID NO: 92265 - protein, 465 aa, Homo sapiens [sequence omitted]

SEQ ID NO: 92266 - protein, 164 aa, Homo sapiens
  Payload ID: 18476
  Gene Name: tripartite motif containing 15
  ENSP ID: ENSP00000389858
  MOD_RES (1)..(1): Any amino acid
XKKHQVETAFERLQQELEQQRCLLLARLRELEQQIWKERDEYITKVSEEVTRLGAQVKELEEKCQQPASELLQDVRVNQSRCEMKTFVSPEAISPDLVKKIRDFHRKILTLPEMMRMFSENLAHHLEIDSDRQPEPGSLGRQEVSEVHPAEEEPARQPPALRRP

SEQ ID NO: 92267 - protein, 164 aa, Homo sapiens; identical to SEQ ID NO: 92266
  Payload ID: 18476
  Gene Name: tripartite motif containing 15
  ENSP ID: ENSP00000391673
  MOD_RES (1)..(1): Any amino acid

SEQ ID NO: 92268 - protein, 164 aa, Homo sapiens; identical to SEQ ID NO: 92266
  Payload ID: 18476
  Gene Name: tripartite motif containing 15
  ENSP ID: ENSP00000392768
  MOD_RES (1)..(1): Any amino acid

SEQ ID NO: 92269 - protein, 465 aa, Homo sapiens
  Payload ID: 18476
  Gene Name: tripartite motif containing 15
  ENSP ID: ENSP00000398224
MPATPSLKVVHELPACTLCAGPLEDAVTIPCGHTFCRLCLPALSQMGAQSSGKILLCPLCQEEEQAETPMAPVPLGPLGETYCEEHGEKIYFFCENDAEFLCVFCREGPTHQAHTVGFLDEAIQPYRDRLRSRLEALSTERDEIEDVKCQEDQKLQVLLTQIESKKHQVETAFERLQQELEQQRCLLLARLRELEQQIWKERDEYITKVSEEVTRLGAQVKELEEKCQQPASELLQDVRVNQSRCEMKTFVSPEAISPDLVKKIRDFHRKILTLPEMMRMFSENLAHHLEIDSGVITLDPQTASRSLVLSEDRKSVRYTRQKKNLPDSPLRFDGLPAVLGFPGFSSGRHRWQVDLQLGDGGGCTVGVAGEGVRRKGEMGLSAEDGVWAVIISHQQCWASTSPGTDLPLSEIPRGVRVALDYEAGQVTLHNAQTQEPIFTFTASFSGKVFPFFAVWKKGSCLTLKG

SEQ ID NO: 92270 - protein, 164 aa, Homo sapiens; identical to SEQ ID NO: 92266
  Payload ID: 18476
  Gene Name: tripartite motif containing 15
  ENSP ID: ENSP00000398285
  MOD_RES (1)..(1): Any amino acid

SEQ ID NO: 92271 - protein, 164 aa, Homo sapiens; identical to SEQ ID NO: 92266
  Payload ID: 18476
  Gene Name: tripartite motif containing 15
  ENSP ID: ENSP00000400174
  MOD_RES (1)..(1): Any amino acid

SEQ ID NO: 92272 - protein, 164 aa, Homo sapiens; identical to SEQ ID NO: 92266
  Payload ID: 18476
  Gene Name: tripartite motif containing 15
  ENSP ID: ENSP00000402326
  MOD_RES (1)..(1): Any amino acid

SEQ ID NO: 92273 - protein, 465 aa, Homo sapiens [sequence omitted]

SEQ ID NO: 92274 - protein, 164 aa, Homo sapiens; identical to SEQ ID NO: 92266
  Payload ID: 18476
  Gene Name: tripartite motif containing 15
  ENSP ID: ENSP00000403836
  MOD_RES (1)..(1): Any amino acid

SEQ ID NO: 92275 - protein, 465 aa, Homo sapiens; identical to SEQ ID NO: 92269
  Payload ID: 18476
  Gene Name: tripartite motif containing 15
  ENSP ID: ENSP00000409605

SEQ ID NO: 92276 - protein, 465 aa, Homo sapiens [sequence omitted]

SEQ ID NO: 92277 - protein, 164 aa, Homo sapiens; identical to SEQ ID NO: 92266
  Payload ID: 18476
  Gene Name: tripartite motif containing 15
  ENSP ID: ENSP00000412755
  MOD_RES (1)..(1): Any amino acid

SEQ ID NO: 92278 - protein, 465 aa, Homo sapiens [sequence omitted]

SEQ ID NO: 92279 - protein, 465 aa, Homo sapiens [sequence omitted]

SEQ ID NO: 92280 - protein, 396 aa, Homo sapiens
  Payload ID: 18476
  Gene Name: tripartite motif containing 15
  ENSP ID: ENSP00000447004
MAPVPLGPLGETYCEEHGEKIYFFCENDAEFLCVFCREGPTHQAHTVGFLDEAIQPYRDRLRSRLEALSTERDEIEDVKCQEDQKLQVLLTQIESKKHQVETAFERLQQELEQQRCLLLARLRELEQQIWKERDEYITKVSEEVTRLGAQVKELEEKCQQPASELLQDVRGTIVTCEMKTFVSPEAISPDLVKKIRDFHRKILTLPEMMRMFSENLAHHLEIDSGVITLDPQTASRSLVLSEDRKSVRYTRQKKNLPDSPLRFDGLPAVLGFPGFSSGRHRWQVDLQLGDGGGCTVGVAGEGVRRKGEMGLSAEDGVWAVIISHQQCWASTSPGTDLPLSEIPRGVRVALDYEAGQVTLHNAQTQEPIFTFTASFSGKVFPFFAVWKKGSCLTLKG

SEQ ID NO: 92281 - protein, 396 aa, Homo sapiens
  Payload ID: 18476
  Gene Name: tripartite motif containing 15
  ENSP ID: ENSP00000447232
MAPVPLGPLGETYCEEHGEKIYFFCENDAEFLCVFCREGPTHQAHTVGFLDEAIQPYRDRLRSRLEALSTERDEIEDVKCQEDQKLQVLLTQIESKKHQVETAFERLQQELEQQRCLLLARLRELEQQIWKERDEYITKVSEEVTRLGAQVKELEEKCQQPASELLQDVRGTIVTCEMKTFVSPEAISPDLVKKIRDFHRKILTLPEMMRMFSENLAHHLEIDSGVITLDPQTASRSLVLSEDRKSVRYTRQKKSLPDSPLRFDGLPAVLGFPGFSSGRHRWQVDLQLGDGGGCTVGVAGEGVRRKGEMGLSAEDGVWAVIISHQQCWASTSPGTDLPLSEIPRGVRVALDYEAGQVTLHNAQTQEPIFTFTASFSGKVFPFFAVWKKGSCLTLKG

SEQ ID NO: 92282 - protein, 115 aa, Homo sapiens; identical to SEQ ID NO: 92264
  Payload ID: 18476
  Gene Name: tripartite motif containing 15
  Uniprot ID: Q9C019
  ENSP ID: ENSP00000447500

SEQ ID NO: 92283 - protein, 396 aa, Homo sapiens; identical to SEQ ID NO: 92281
  Payload ID: 18476
  Gene Name: tripartite motif containing 15
  ENSP ID: ENSP00000447725

SEQ ID NO: 92284 - protein, 396 aa, Homo sapiens; identical to SEQ ID NO: 92281
  Payload ID: 18476
  Gene Name: tripartite motif containing 15
  ENSP ID: ENSP00000448307

SEQ ID NO: 92285 - protein, 396 aa, Homo sapiens; identical to SEQ ID NO: 92280
  Payload ID: 18476
  Gene Name: tripartite motif containing 15
  ENSP ID: ENSP00000448772

SEQ ID NO: 92286 - protein, 396 aa, Homo sapiens; identical to SEQ ID NO: 92281
  Payload ID: 18476
  Gene Name: tripartite motif containing 15
  ENSP ID: ENSP00000449583

SEQ ID NO: 92287 - protein, 115 aa, Homo sapiens; identical to SEQ ID NO: 92264
  Payload ID: 18476
  Gene Name: tripartite motif containing 15
  Uniprot ID: Q9C019
  ENSP ID: ENSP00000449617

SEQ ID NO: 92288 - protein, 115 aa, Homo sapiens; identical to SEQ ID NO: 92264
  Payload ID: 18476
  Gene Name: tripartite motif containing 15
  Uniprot ID: Q9C019
  ENSP ID: ENSP00000449686

SEQ ID NO: 92289 - protein, 396 aa, Homo sapiens; identical to SEQ ID NO: 92281
  Payload ID: 18476
  Gene Name: tripartite motif containing 15
  ENSP ID: ENSP00000450011

SEQ ID NO: 92290 - protein, 396 aa, Homo sapiens; identical to SEQ ID NO: 92281
  Payload ID: 18476
  Gene Name: tripartite motif containing 15
  ENSP ID: ENSP00000484001

SEQ ID NO: 92291 - protein, 564 aa, Homo sapiens
  Payload ID: 18477
  Gene Name: tripartite motif containing 16
  Uniprot ID: O95361
  ENSP ID: ENSP00000338989
MAELDLMAPGPLPRATAQPPAPLSPDSGSPSPDSGSASPVEEEDVGSSEKLGRETEEQDSDSAEQGDPAGEGKEVLCDFCLDDTRRVKAVKSCLTCMVNYCEEHLQPHQVNIKLQSHLLTEPVKDHNWRYCPAHHSPLSAFCCPDQQCICQDCCQEHSGHTIVSLDAARRDKEAELQCTQLDLERKLKLNENAISRLQANQKSVLVSVSEVKAVAEMQFGELLAAVRKAQANVMLFLEEKEQAALSQANGIKAHLEYRSAEMEKSKQELERMAAISNTVQFLEEYCKFKNTEDITFPSVYVGLKDKLSGIRKVITESTVHLIQLLENYKKKLQEFSKEEEYDIRTQVSAVVQRKYWTSKPEPSTREQFLQYAYDITFDPDTAHKYLRLQEENRKVTNTTPWEHPYPDLPSRFLHWRQVLSQQSLYLHRYYFEVEIFGAGTYVGLTCKGIDRKGEERNSCISGNNFSWSLQWNGKEFTAWYSDMETPLKAGPFRRLGVYIDFPGGILSFYGVEYDTMTLVHKFACKFSEPVYAAFWLSKKENAIRIVDLGEEPEKPAPSLVGTAP

SEQ ID NO: 92292 - protein, 434 aa, Homo sapiens
  Payload ID: 18477
  Gene Name: tripartite motif containing 16
  ENSP ID: ENSP00000399918
MIMEDWTCKLQNRVLPSEDPALSQKGYLKKENMAALCRTAESQAELQCTQLDLERKLKLNENAISRLQANQKSVLVSVSEVKAVAEMQFGELLAAVRKAQANVMLFLEEKEQAALSQANGIKAHLEYRSAEMEKSKQELERMAAISNTVQFLEEYCKFKNTEDITFPSVYVGLKDKLSGIRKVITESTVHLIQLLENYKKKLQEFSKEEEYDIRTQVSAVVQRKYWTSKPEPSTREQFLQYAYDITFDPDTAHKYLRLQEENRKVTNTTPWEHPYPDLPSRFLHWRQVLSQQSLYLHRYYFEVEIFGAGTYVGLTCKGIDRKGEERNSCISGNNFSWSLQWNGKEFTAWYSDMETPLKAGPFRRLGVYIDFPGGILSFYGVEYDTMTLVHKFACKFSEPVYAAFWLSKKENAIRIVDLGEEPEKPAPSLVGTAP

SEQ ID NO: 92293 - protein, 348 aa, Homo sapiens
  Payload ID: 18477
  Gene Name: tripartite motif containing 16
  Uniprot ID: O95361
  ENSP ID: ENSP00000462903
MQFGELLAAVRKAQANVMLFLEEKEQAALSQANGIKAHLEYRSAEMEKSKQELERMAAISNTVQFLEEYCKFKNTEDITFPSVYVGLKDKLSGIRKVITESTVHLIQLLENYKKKLQEFSKEEEYDIRTQVSAVVQRKYWTSKPEPSTREQFLQYAYDITFDPDTAHKYLRLQEENRKVTNTTPWEHPYPDLPSRFLHWRQVLSQQSLYLHRYYFEVEIFGAGTYVGLTCKGIDRKGEERNSCISGNNFSWSLQWNGKEFTAWYSDMETPLKAGPFRRLGVYIDFPGGILSFYGVEYDTMTLVHKFACKFSEPVYAAFWLSKKENAIRIVDLGEEPEKPAPSLVGTAP

SEQ ID NO: 92294 - protein, 564 aa, Homo sapiens; identical to SEQ ID NO: 92291
  Payload ID: 18477
  Gene Name: tripartite motif containing 16
  Uniprot ID: O95361
  ENSP ID: ENSP00000463188

SEQ ID NO: 92295 - protein, 115 aa, Homo sapiens
  Payload ID: 18477
  Gene Name: tripartite motif containing 16
  ENSP ID: ENSP00000463293
MQFGELLAAVRKAQANVMLFLEEKEQAALSQANGIKAHLEYRSAEMEKSKQELERMAAISNTVQFLEEYCKFKNTEDITFPSVYVGLKDKLSGIRKVITESTVHLIQLLENYKKK

SEQ ID NO: 92296 - protein, 96 aa, Homo sapiens
  Payload ID: 18477
  Gene Name: tripartite motif containing 16
  ENSP ID: ENSP00000463360
MIMEDWTCKLQNRVLPSEDPALSQKGYLKKENMAALCRTAESQAELQCTQLDLERKLKLNENAISRLQANQKSVLVSVSEVKAVAEMQFGELLAAV

SEQ ID NO: 92297 - protein, 140 aa, Homo sapiens
  Payload ID: 18477
  Gene Name: tripartite motif containing 16
  ENSP ID: ENSP00000463639
MQFGELLAAVRKAQANVMLFLEEKEQAALSQANGIKAHLEYRSAEMEKSKQELERMAAISNTVQFLEMRMTSRLTRTQHTSISGCRRRTARSPTPRPGSIPTRTSPAGSCTGGRCCPSRVCTCTGTILRWRSSGQAPMLA

SEQ ID NO: 92298 - protein, 111 aa, Homo sapiens
  Payload ID: 18477
  Gene Name: tripartite motif containing 16
  ENSP ID: ENSP00000464072
MQFGELLAAVRKAQANVMLFLEEKEQAALSQANGIKAHLEYRSAEMEKSKQELERMAAISNTVQFLERSMTSELKCLPLFSANIGLPNLSPAPGNSSSNMRMTSRLTRTQH

SEQ ID NO: 92299 - protein, 55 aa, Homo sapiens
  Payload ID: 18477
  Gene Name: tripartite motif containing 16
  ENSP ID: ENSP00000465169
GYLKKENMAALCRTAESQNPMQVFQGFMSFKDVAVNFTRKNGENWTLLRESCTGM

SEQ ID NO: 92300 - protein, 184 aa, Homo sapiens
  Payload ID: 18477
  Gene Name: tripartite motif containing 16
  ENSP ID: ENSP00000465907
LSQKGYLKKENMAALCRTAESQEKDRAGDQFADSDPKPESSLGLHLQAELQCTQLDLERKLKLNENAISRLQANQKSVLVSVSEVKAVAEMQFGELLAAVRKAQANVMLFLEEKEQAALSQANGIKAHLEYRSAEMEKSKQELERMAAISNTVQFLEEYCKFKNTEDITFPSVYVGLKDKLSGI

SEQ ID NO: 92301 - protein, 232 aa, Homo sapiens
  Payload ID: 18477
  Gene Name: tripartite motif containing 16
  ENSP ID: ENSP00000467031
ANGIKAHLEYRSAEMEKSKQELERMAAISNTVQFLEEYCKFKNTEDITFPSVYVGLKDKLSGIRKVITESTVHLIQLLENYKKKLQEFSKEEEYDIRTQVSAVVQRKYWTSKPEPSTREQFLQYAYDITFDPDTAHKYLRLQEENRKVTNTTPWEHPYPDLPSRFLHWRQVLSQQSLYLHRYYFEVEIFGAGTYVGLTCKGIDRKGEERNSCISGNNFSWSLQWNGKEFTAW

SEQ ID NO: 92302 - protein, 348 aa, Homo sapiens
  Payload ID: 18478
  Gene Name: tripartite motif containing 16-like
  Uniprot ID: Q309B1
  ENSP ID: ENSP00000379030
MQFGELLAAVRKAQANVMLFLEEKEQAALSQANGIKAHLEYRSAEMEKSKQELETMAAISNTVQFLEEYCKFKNTEDITFPSVYIGLKDKLSGIRKVITESTVHLIQLLENYKKKLQEFSKEEEYDIRTQVSAIVQRKYWTSKPEPSTREQFLQYVHDITFDPDTAHKYLRLQEENRKVTNTTPWEHPYPDLPSRFLHWRQVLSQQSLYLHRYYFEVEIFGAGTYVGLTCKGIDQKGEERSSCISGNNFSWSLQWNGKEFTAWYSDMETPLKAGPFWRLGVYIDFPGGILSFYGVEYDSMTLVHKFACKFSEPVYAAFWLSKKENAIRIVDLGEEPEKPAPSLVGTAP

SEQ ID NO: 92303 - protein, 114 aa, Homo sapiens
  Payload ID: 18478
  Gene Name: tripartite motif containing 16-like
  ENSP ID: ENSP00000399959
MQFGELLAAVRKAQANVMLFLEEKEQAALSQANGIKAHLEYRSAEMEKSKQELETMAAISNTVQFLERSMTSELKCLPLFSANIGLPNLSPAPGNSSSNMCMTSRSTRTQHTSI

SEQ ID NO: 92304 - protein, 140 aa, Homo sapiens
  Payload ID: 18478
  Gene Name: tripartite motif containing 16-like
  Uniprot ID: Q309B1
  ENSP ID: ENSP00000403648
MQFGELLAAVRKAQANVMLFLEEKEQAALSQANGIKAHLEYRSAEMEKSKQELETMAAISNTVQFLEMCMTSRSTRTQHTSISGCRRRTARSPTPRPGSIPTRTSPAGSCTGGRCCPSRVCTCTGTILRWRSSGQAPMLA

SEQ ID NO: 92305 - protein, 115 aa, Homo sapiens
  Payload ID: 18478
  Gene Name: tripartite motif containing 16-like
  ENSP ID: ENSP00000459199
MQFGELLAAVRKAQANVMLFLEEKEQAALSQANGIKAHLEYRSAEMEKSKQELETMAAISNTVQFLEEYCKFKNTEDITFPSVYIGLKDKLSGIRKVITESTVHLIQLLENYKKK

SEQ ID NO: 92306 - protein, 232 aa, Homo sapiens
  Payload ID: 18478
  Gene Name: tripartite motif containing 16-like
  ENSP ID: ENSP00000459623
ANGIKAHLEYRSAEMEKSKQELETMAAISNTVQFLEEYCKFKNTEDITFPSVYIGLKDKLSGIRKVITESTVHLIQLLENYKKKLQEFSKEEEYDIRTQVSAIVQRKYWTSKPEPSTREQFLQYVHDITFDPDTAHKYLRLQEENRKVTNTTPWEHPYPDLPSRFLHWRQVLSQQSLYLHRYYFEVEIFGAGTYVGLTCKGIDQKGEERSSCISGNNFSWSLQWNGKEFTAW

SEQ ID NO: 92307 - protein, 348 aa, Homo sapiens; identical to SEQ ID NO: 92302
  Payload ID: 18478
  Gene Name: tripartite motif containing 16-like
  Uniprot ID: Q309B1
  ENSP ID: ENSP00000460272

SEQ ID NO: 92308 - protein, 224 aa, Homo sapiens
  Payload ID: 18478
  Gene Name: tripartite motif containing 16-like
  ENSP ID: ENSP00000460537
MQFGELLAAVRKAQANVMLFLEEKEQAALSQANGIKAHLEYRSAEMEKSKQELETMAAISNTVQFLEEYCKFKNTEDITFPSVYIGLKDKLSGIRKVITESTVHLIQLLENYKKKLQEFSKEEEYDIRTQVSAIVQRKYWTSKPEPSTREQFLQYVHDITFDPDTAHKYLRLQEENRKVTNTTPWEHPYPDLPSRFLHWRQVLSQQSLYLHRYYFEVEIFGAGT

SEQ ID NO: 92309 - protein, 348 aa, Homo sapiens; identical to SEQ ID NO: 92302
  Payload ID: 18478
  Gene Name: tripartite motif containing 16-like
  Uniprot ID: Q309B1
  ENSP ID: ENSP00000461386

SEQ ID NO: 92310 - protein, 53 aa, Homo sapiens
  Payload ID: 18478
  Gene Name: tripartite motif containing 16-like
  ENSP ID: ENSP00000462695
MQFGELLAAVRKAQANVMLFLEEKEQAALSQANGIKAHLEYRSAEMEKRVLQV

SEQ ID NO: 92311 - protein, 348 aa, Homo sapiens; identical to SEQ ID NO: 92302
  Payload ID: 18478
  Gene Name: tripartite motif containing 16-like
  Uniprot ID: Q309B1
  ENSP ID: ENSP00000463750

SEQ ID NO: 92312 - protein, 477 aa, Homo sapiens
  Payload ID: 18479
  Gene Name: tripartite motif containing 17
  Uniprot ID: Q9Y577
  ENSP ID: ENSP00000295033
MEAVELARKLQEEATCSICLDYFTDPVMTTCGHNFCRACIQLSWEKARGKKGRRKRKGSFPCPECREMSPQRNLLPNRLLTKVAEMAQQHPGLQKQDLCQEHHEPLKLFCQKDQSPICVVCRESREHRLHRVLPAEEAVQGYKLKLEEDMEYLREQITRTGNLQAREEQSLAEWQGKVKERRERIVLEFEKMNLYLVEEEQRLLQALETEEEETASRLRESVACLDRQGHSLELLLLQLEERSTQGPLQMLQDMKEPLSRKNNVSVQCPEVAPPTRPRTVCRVPGQIEVLRGFLEDVVPDATSAYPYLLLYESRQRRYLGSSPEGSGFCSKDRFVAYPCAVGQTAFSSGRHYWEVGMNITGDALWALGVCRDNVSRKDRVPKCPENGFWVVQLSKGTKYLSTFSALTPVMLMEPPSHMGIFLDFEAGEVSFYSVSDGSHLHTYSQATFPGPLQPFFCLGAPKSGQMVISTVTMWVKG

SEQ ID NO: 92313 - protein, 175 aa, Homo sapiens
  Payload ID: 18479
  Gene Name: tripartite motif containing 17
  ENSP ID: ENSP00000347794
MEAVELARKLQEEATCSICLDYFTDPVMTTCGHNFCRACIQLSWEKARGKKGRRKRKGSFPCPECREMSPQRNLLPNRLLTKVAEMAQQHPGLQKQDLCQEHHEPLKLFCQKDQSPICVVCRESREHRLHRVLPAEEAVQGYKLKLEEDMEYLREQITRTGNLQAREEQSLAEWQ

SEQ ID NO: 92314 - protein, 477 aa, Homo sapiens; identical to SEQ ID NO: 92312
  Payload ID: 18479
  Gene Name: tripartite motif containing 17
  Uniprot ID: Q9Y577
  ENSP ID: ENSP00000355658

SEQ ID NO: 92315 - protein, 477 aa, Homo sapiens; identical to SEQ ID NO: 92312
  Payload ID: 18479
  Gene Name: tripartite motif containing 17
  Uniprot ID: Q9Y577
  ENSP ID: ENSP00000355659

SEQ ID NO: 92316 - protein, 30 aa, Homo sapiens
  Payload ID: 18479
  Gene Name: tripartite motif containing 17
  ENSP ID: ENSP00000397688
MTTCGHNFCRACIQLSWEKARGKKGRRKRK

SEQ ID NO: 92317 - protein, 343 aa, Homo sapiens
  Payload ID: 18479
  Gene Name: tripartite motif containing 17
  Uniprot ID: Q9Y577
  ENSP ID: ENSP00000403312
MEAVELARKLQEEATCSICLDYFTDPVMTTCGHNFCRACIQLSWEKARGKKGRRKRKGSFPCPECREMSPQRNLLPNRLLTKVAEMAQQHPGLQKQDLCQEHHEPLKLFCQKDQSPICVVCRESREHRLHRVLPAEEAVQGYKLKLEEDMEYLREQITRTGNLQAREEQSLAEWQGKVKERRERIVLEFEKMNLYLVEEEQRLLQALETEEEETASRLRESVACLDRQGHSLELLLLQLEERSTQGPLQMLQDMKEPLSRKNNVSVQCPEVAPPTRPRTVCRVPGQIEVLRGFLGKWAPRARTSDPGSLGDAPLYPLASEATNGGGSTSALPGDGHWLFTVPS

SEQ ID NO: 92318 - protein, 50 aa, Homo sapiens
  Payload ID: 18479
  Gene Name: tripartite motif containing 17
  ENSP ID: ENSP00000429555
MEAVELARKLQEEATCSICLDYFTDPVMTTCGHNFCRACIQLSWEKARGK

SEQ ID NO: 92319 - protein, 267 aa, Homo sapiens
  Payload ID: 18479
  Gene Name: tripartite motif containing 17
  ENSP ID: ENSP00000430468
MTTCGHNFCRACIQLSWEKARGKKGRRKRKGSFPCPECREMSPQRNLLPNRLLTKVAEMAQQHPGLQKQDLCQEHHEPLKLFCQKDQSPICVVCRESREHRLHRVLPAEEAVQGYKLKLEEDMEYLREQITRTGNLQAREEQSLAEWQGKVKERRERIVLEFEKMNLYLVEEEQRLLQALETEEEETASRLRESVACLDRQGHSLELLLLQLEERSTQGPLQMLQDMKEPLSRKNNVSVQCPEVAPPTRPRTVCRVPGQIEVLRGFL

SEQ ID NO: 92320 - protein, 771 aa, Homo sapiens
  Payload ID: 18480
  Gene Name: tripartite motif containing 2
  Uniprot ID: Q9C040
  ENSP ID: ENSP00000339659
MHRSGRYGTQQQRAGSKTAGPPCQWSRMASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQKASIVDDIHSTFDELQKTLNVRKSVLLMELEVNYGLKHKVLQSQLDTLLQGQESIKSCSNFTAQALNHGTETEVLLVKKQMSEKLNELADQDFPLHPRENDQLDFIVETEGLKKSIHNLGTILTTNAVASETVATGEGLRQTIIGQPMSVTITTKDKDGELCKTGNAYLTAELSTPDGSVADGEILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVGTKGRNKGEFTNLQGVAASTNGKILIADSNNQCVQIFSNDGQFKSRFGIRGRSPGQLQRPTGVAVHPSGDIIIADYDNKWVSIFSSDGKFKTKIGSGKLMGPKGVSVDRNGHIIVVDNKACCVFIFQPNGKIVTRFGSRGNGDRQFAGPHFAAVNSNNEIIITDFHNHSVKVFNQEGEFMLKFGSNGEGNGQFNAPTGVAVDSNGNIIVADWGNSRIQVFDGSGSFLSYINTSADPLYGPQGLALTSDGHVVVADSGNHCFKVYRYLQ

SEQ ID NO: 92321 - protein, 110 aa, Homo sapiens
  Payload ID: 18480
  Gene Name: tripartite motif containing 2
  ENSP ID: ENSP00000400375
MDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQ

SEQ ID NO: 92322 - protein, 138 aa, Homo sapiens
  Payload ID: 18480
  Gene Name: tripartite motif containing 2
  ENSP ID: ENSP00000400879
MASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMC

SEQ ID NO: 92323 - protein, 744 aa, Homo sapiens
  Payload ID: 18480
  Gene Name: tripartite motif containing 2
  Uniprot ID: Q9C040
  ENSP ID: ENSP00000415812
MASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQKASIVDDIHSTFDELQKTLNVRKSVLLMELEVNYGLKHKVLQSQLDTLLQGQESIKSCSNFTAQALNHGTETEVLLVKKQMSEKLNELADQDFPLHPRENDQLDFIVETEGLKKSIHNLGTILTTNAVASETVATGEGLRQTIIGQPMSVTITTKDKDGELCKTGNAYLTAELSTPDGSVADGEILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVGTKGRNKGEFTNLQGVAASTNGKILIADSNNQCVQIFSNDGQFKSRFGIRGRSPGQLQRPTGVAVHPSGDIIIADYDNKWVSIFSSDGKFKTKIGSGKLMGPKGVSVDRNGHIIVVDNKACCVFIFQPNGKIVTRFGSRGNGDRQFAGPHFAAVNSNNEIIITDFHNHSVKVFNQEGEFMLKFGSNGEGNGQFNAPTGVAVDSNGNIIVADWGNSRIQVFDGSGSFLSYINTSADPLYGPQGLALTSDGHVVVADSGNHCFKVYRYLQ

SEQ ID NO: 92324 - protein, 136 aa, Homo sapiens
  Payload ID: 18480
  Gene Name: tripartite motif containing 2
  ENSP ID: ENSP00000487750
MASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVSGWDGRYCPGA

SEQ ID NO: 92325 - protein, 136 aa, Homo sapiens; identical to SEQ ID NO: 92324
  Payload ID: 18480
  Gene Name: tripartite motif containing 2
  ENSP ID: ENSP00000487836

SEQ ID NO: 92326 - protein, 526 aa, Homo sapiens
  Payload ID: 18480
  Gene Name: tripartite motif containing 2
  ENSP ID: ENSP00000488229
MASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQKASIVDDIHSTFDELQKTLNVRKSVLLMELEVNYGLKHKVLQSQLDTLLQGQESIKSCSNFTAQALNHGTETEVLLVKKQMSEKLNELADQDFPLHPRENDQLDFIVETEGLKKSIHNLGTILTTNAVASETVATGEGLRQTIIGQPMSVTITTKDKDGELCKTGNAYLTAELSTPDGSVADGEILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVDGVLQAEVQWHDLSPLQPLPPGFKQFSCLGLLSSWDYRHAPPCSANFLYF

SEQ ID NO: 92327 - protein, 44 aa, Homo sapiens
  Payload ID: 18480
  Gene Name: tripartite motif containing 2
  ENSP ID: ENSP00000488602
MASEGTNIPSPVVRQIDKQFLICSICLERYKNPKVLPCLHTFCE

SEQ ID NO: 92328 - protein, 114 aa, Homo sapiens
  Payload ID: 18480
  Gene Name: tripartite motif containing 2
  ENSP ID: ENSP00000488751
  MOD_RES (1)..(1): Any amino acid
XKIGSGKLMGPKGVSVDRNGHIIVVDNKACCVFIFQPNGKIVTRFGSRGNGDRQFAGPHFAAVNSNNEIIITDFHNHSVKVLQAHELLLTFNCFYGEIGLRENNAILTYGTKGS

SEQ ID NO: 92329 - protein, 475 aa, Homo sapiens [sequence omitted]

SEQ ID NO: 92330 - protein, 90 aa, Homo sapiens
  Payload ID: 18481
  Gene Name: tripartite motif containing 21
  ENSP ID: ENSP00000434053
  MOD_RES (1)..(1): Any amino acid
XGLKKMLRTCAVHITLDPDTANPWLILSEDRRQVRLGDTQQSIPGNEERFDSYPMVLGAQHFHSGKHYWEDLCGPSSVLVSMMEEKTQPL

SEQ ID NO: 92331 - protein, 498 aa, Homo sapiens
  Payload ID: 18482
  Gene Name: tripartite motif containing 22
  Uniprot ID: Q8IYM9
  ENSP ID: ENSP00000369299
MDFSVKVDIEKEVTCPICLELLTEPLSLDCGHSFCQACITAKIKESVIISRGESSCPVCQTRFQPGNLRPNRHLANIVERVKEVKMSPQEGQKRDVCEHHGKKLQIFCKEDGKVICWVCELSQEHQGHQTFRINEVVKECQEKLQVALQRLIKEDQEAEKLEDDIRQERTAWKNYIQIERQKILKGFNEMRVILDNEEQRELQKLEEGEVNVLDNLAAATDQLVQQRQDASTLISDLQRRLRGSSVEMLQDVIDVMKRSESWTLKKPKSVSKKLKSVFRVPDLSGMLQVLKELTDVQYYWVDVMLNPGSATSNVAISVDQRQVKTVRTCTFKNSNPCDFSAFGVFGCQYFSSGKYYWEVDVSGKIAWILGVHSKISSLNKRKSSGFAFDPSVNYSKVYSRYRPQYGYWVIGLQNTCEYNAFEDSSSSDPKVLTLFMAVPPCRIGVFLDYEAGIVSFFNVTNHGALIYKFSGCRFSRPAYPYFNPWNCLVPMTVCPPSS

SEQ ID NO: 92332 - protein, 143 aa, Homo sapiens
  Payload ID: 18482
  Gene Name: tripartite motif containing 22
  ENSP ID: ENSP00000388994
  MOD_RES (1)..(1): Any amino acid
XGQKRDVCEHHGKKLQIFCKEDGKVICWVCELSQEHQGHQTFRINEVVKECQEKLQVALQRLIKEDQEAEKLEDDIRQERTAWKNYIQIERQKILKGFNEMRVILDNEEQRELQKLEEGCQHAHLRSPAEVEGIVSRDAAGCD

SEQ ID NO: 92333 - protein, 305 aa, Homo sapiens
  Payload ID: 18482
  Gene Name: tripartite motif containing 22
  ENSP ID: ENSP00000393250
MDFSVKVDIEKEVTCPICLELLTEPLSLDCGHSFCQACITAKIKESVIISRGESSCPVCQTRFQPGNLRPNRHLANIVERVKEVKMSPQEGQKRDVCEHHGKKLQIFCKEDGKVICWVCELSQEHQGHQTFRINEVVKECQNYIQIERQKILKGFNEMRVILDNEEQRELQKLEEGEVNVLDNLAAATDQLVQQRQDASTLISDLQRRLRGSSVEMLQDVIDVMKRSESWTLKKPKSVSKKLKSVFRVPDLSGMLQVLKELTDVQYYWVDVMLNPGSATSNVAISVDQRQVKTVRTCTFKNSNPC

SEQ ID NO: 92334 - protein, 227 aa, Homo sapiens
  Payload ID: 18482
  Gene Name: tripartite motif containing 22
  ENSP ID: ENSP00000396849
MDFSVKVDIEKEVTCPICLELLTEPLSLDCGHSFCQACITAKIKESVIISRGESSCPVCQTRFQPGNLRPNRHLANIVERVKEVKMSPQEGQKRDVCEHHGKKLQIFCKEDGKVICWVCELSQEHQGHQTFRINEVVKECQEKLQVALQRLIKEDQEAEKLEDDIRQERTAWKNYIQIERQKILKGFNEMRVILDNEEQRELQKLEEGEVNVLDNLAAATDQLVQQR

SEQ ID NO: 92335 - protein, 203 aa, Homo sapiens
  Payload ID: 18482
  Gene Name: tripartite motif containing 22
  ENSP ID: ENSP00000400417
MDFSVKVDIEKEVTCPICLELLTEPLSLDCGHSFCQACITAKIKESVIISRGESSCPVCQTRFQPGNLRPNRHLANIVERVKEVKMSPQEGQKRDVCEHHGKKLQIFCKEDGKVICWVCELSQEHQGHQTFRINEVVKECQEKLQVALQRLIKEDQEAEKLEDDIRQERTAWKNYIQIERQKILKGFNEMRVILDNEEQRELQ

SEQ ID NO: 92336 - protein, 38 aa, Homo sapiens
  Payload ID: 18482
  Gene Name: tripartite motif containing 22
  ENSP ID: ENSP00000404204
  MOD_RES (1)..(1): Any amino acid
XSKKLKSVFRVPDLSGMLQVLKELTDVQYYWVENFCHA

SEQ ID NO: 92337 - protein, 63 aa, Homo sapiens
  Payload ID: 18482
  Gene Name: tripartite motif containing 22
  ENSP ID: ENSP00000406412
DVIDVMKRSESWTLKKPKSVSKKLKSVFRVPDLSGMLQVLKELTDVQYYWVYHQRILQTPLWK

SEQ ID NO: 92338 - protein, 37 aa, Homo sapiens
  Payload ID: 18482
  Gene Name: tripartite motif containing 22
  ENSP ID: ENSP00000409991
  MOD_RES (1)..(1): Any amino acid
XSKKLKSVFRVPDLSGMLQVLKELTDVQYYWENFCHA

SEQ ID NO: 92339 - protein, 574 aa, Homo sapiens
  Payload ID: 18483
  Gene Name: tripartite motif containing 23
  Uniprot ID: P36406
  ENSP ID: ENSP00000231524
MATLVVNKLGAGVDSGRQGSRGTAVVKVLECGVCEDVFSLQGDKVPRLLLCGHTVCHDCLTRLPLHGRAIRCPFDRQVTDLGDSGVWGLKKNFALLELLERLQNGPIGQYGAAEESIGISGESIIRCDEDEAHLASVYCTVCATHLCSECSQVTHSTKTLAKHRRVPLADKPHEKTMCSQHQVHAIEFVCLEEGCQTSPLMCCVCKEYGKHQGHKHSVLEPEANQIRASILDMAHCIRTFTEEISDYSRKLVGIVQHIEGGEQIVEDGIGMAHTEHVPGTAENARSCIRAYFYDLHETLCRQEEMALSVVDAHVREKLIWLRQQQEDMTILLSEVSAACLHCEKTLQQDDCRVVLAKQEITRLLETLQKQQQQFTEVADHIQLDASIPVTFTKDNRVHIGPKMEIRVVTLGLDGAGKTTILFKLKQDEFMQPIPTIGFNVETVEYKNLKFTIWDVGGKHKLRPLWKHYYLNTQAVVFVVDSSHRDRISEAHSELAKLLTEKELRDALLLIFANKQDVAGALSVEEITELLSLHKLCCGRSWYIQGCDARSGMGLYEGLDWLSRQLVAAGVLDVA

SEQ ID NO: 92340 - protein, 546 aa, Homo sapiens
  Payload ID: 18483
  Gene Name: tripartite motif containing 23
  Uniprot ID: P36406
  ENSP ID: ENSP00000274327
MATLVVNKLGAGVDSGRQGSRGTAVVKVLECGVCEDVFSLQGDKVPRLLLCGHTVCHDCLTRLPLHGRAIRCPFDRQVTDLGDSGVWGLKKNFALLELLERLQNGPIGQYGAAEESIGISGESIIRCDEDEAHLASVYCTVCATHLCSECSQVTHSTKTLAKHRRVPLADKPHEKTMCSQHQVHAIEFVCLEEGCQTSPLMCCVCKEYGKHQGHKHSVLEPEANQIRASILDMAHCIRTFTEEISDYSRKLVGIVQHIEGGEQIVEDGIGMAHTEHVPGTAENARSCIRAYFYDLHETLCRQEEMALSVVDAHVREKLIWLRQQQEDMTILLSEVSAACLHCEKTLQQDDCRVVLAKQEITRLLETLQKQQQQFTEVADHIQLDASIPVTFTKDNRVHIGPKMEIRVVTLGLDGAGKTTILFKLKQDEFMQPIPTIGFNVETVEYKNLKFTIWDVGGKHKLRPLWKHYYLNTQAVVFVVDSSHRDRISEAHSELAKLLTEKELRDALLLIFANKQDVAGALSVEEITELLSLHKLCCGRSCFSDNM

SEQ ID NO: 92341 - protein, 569 aa, Homo sapiens
  Payload ID: 18483
  Gene Name: tripartite motif containing 23
  Uniprot ID: P36406
  ENSP ID: ENSP00000370406
MATLVVNKLGAGVDSGRQGSRGTAVVKVLECGVCEDVFSLQGDKVPRLLLCGHTVCHDCLTRLPLHGRAIRCPFDRQVTDLGDSGVWGLKKNFALLELLERLQNGPIGQYGAAEESIGISGESIIRCDEDEAHLASVYCTVCATHLCSECSQVTHSTKTLAKHRRVPLADKPHEKTMCSQHQVHAIEFVCLEEGCQTSPLMCCVCKEYGKHQGHKHSVLEPEANQIRASILDMAHCIRTFTEEISDYSRKLVGIVQHIEGGEQIVEDGIGMAHTEHVPGTAENARSCIRAYFYDLHETLCRQEEMALSVVDAHVREKLIWLRQQQEDMTILLSEVSAACLHCEKTLQQDDCRVVLAKQEITRLLETLQKQQQQFTEVADHIQLDASIPVTFTKDNRVHIGPKMEIRVVTLGLDGAGKTTILFKLKQDEFMQPIPTIGFNVETVEYKNLKFTIWDVGGKHKLRPLWKHYYLNTQAVVFVVDSSHRDRISEAHSELAKLLTEKELRDALLLIFANKQDVAGALSVEEITELLSLHKLCCGRSWYIQGCDARSVFQIICDQYTGKEVVTEKG

SEQ ID NO: 92342 - protein, 35 aa, Homo sapiens
  Payload ID: 18483
  Gene Name: tripartite motif containing 23
  ENSP ID: ENSP00000422144
MATLVVNKLGAGVDSGRQGSRGTAVVKVLECGVCE

SEQ ID NO: 92343 - protein, 126 aa, Homo sapiens
  Payload ID: 18483
  Gene Name: tripartite motif containing 23
  ENSP ID: ENSP00000424044
MATLVVNKLGAGVDSGRQGSRGTAVVKVLECGVCEDVFSLQGDKVPRLLLCGHTVCHDCLTRLPLHGRAIRCPFDRQVTDLGDSGVWGLKKNFALLELLERLQNGPIGQYGAAEESIGISGEFYQE

SEQ ID NO: 92344 - protein, 34 aa, Homo sapiens
  Payload ID: 18483
  Gene Name: tripartite motif containing 23
  ENSP ID: ENSP00000427103
MATLVVNKLGAGVDSGRQGSRGTAVVKVIQVSGD

SEQ ID NO: 92345 - protein, 1050 aa, Homo sapiens
  Payload ID: 18484
  Gene Name: tripartite motif containing 24
  Uniprot ID: O15164
  ENSP ID: ENSP00000340507
MEVAVEKAVAAAAAASAAASGGPSAAPSGENEAESRQGPDSERGGEAARLNLLDTCAVCHQNIQSRAPKLLPCLHSFCQRCLPAPQRYLMLPAPMLGSAETPPPVPAPGSPVSGSSPFATQVGVIRCPVCSQECAERHIIDNFFVKDTTEVPSSTVEKSNQVCTSCEDNAEANGFCVECVEWLCKTCIRAHQRVKFTKDHTVRQKEEVSPEAVGVTSQRPVFCPFHKKEQLKLYCETCDKLTCRDCQLLEHKEHRYQFIEEAFQNQKVIIDTLITKLMEKTKYIKFTGNQIQNRIIEVNQNQKQVEQDIKVAIFTLMVEINKKGKALLHQLESLAKDHRMKLMQQQQEVAGLSKQLEHVMHFSKWAVSSGSSTALLYSKRLITYRLRHLLRARCDASPVTNNTIQFHCDPSFWAQNIINLGSLVIEDKESQPQMPKQNPVVEQNSQPPSGLSSNQLSKFPTQISLAQLRLQHMQQQVMAQRQQVQRRPAPVGLPNPRMQGPIQQPSISHQQPPPRLINFQNHSPKPNGPVLPPHPQQLRYPPNQNIPRQAIKPNPLQMAFLAQQAIKQWQISSGQGTPSTTNSTSSTPSSPTITSAAGYDGKAFGSPMIDLSSPVGGSYNLPSLPDIDCSSTIMLDNIVRKDTNIDHGQPRPPSNRTVQSPNSSVPSPGLAGPVTMTSVHPPIRSPSASSVGSRGSSGSSSKPAGADSTHKVPVVMLEPIRIKQENSGPPENYDFPVVIVKQESDEESRPQNANYPRSILTSLLLNSSQSSTSEETVLRSDAPDSTGDQPGLHQDNSSNGKSEWLDPSQKSPLHVGETRKEDDPNEDWCAVCQNGGELLCCEKCPKVFHLSCHVPTLTNFPSGEWICTFCRDLSKPEVEYDCDAPSHNSEKKKTEGLVKLTPIDKRKCERLLLFLYCHEMSLAFQDPVPLTVPDYYKIIKNPMDLSTIKKRLQEDYSMYSKPEDFVADFRLIFQNCAEFNEPDSEVANAGIKLENYFEELLKNLYPEKRFPKPEFRNESEDNKFSDDSDDDFVQPRKKRLKSIEERQLLK

SEQ ID NO: 92346 - protein, 1016 aa, Homo sapiens
  Payload ID: 18484
  Gene Name: tripartite motif containing 24
  Uniprot ID: O15164
  ENSP ID: ENSP00000390829
MEVAVEKAVAAAAAASAAASGGPSAAPSGENEAESRQGPDSERGGEAARLNLLDTCAVCHQNIQSRAPKLLPCLHSFCQRCLPAPQRYLMLPAPMLGSAETPPPVPAPGSPVSGSSPFATQVGVIRCPVCSQECAERHIIDNFFVKDTTEVPSSTVEKSNQVCTSCEDNAEANGFCVECVEWLCKTCIRAHQRVKFTKDHTVRQKEEVSPEAVGVTSQRPVFCPFHKKEQLKLYCETCDKLTCRDCQLLEHKEHRYQFIEEAFQNQKVIIDTLITKLMEKTKYIKFTGNQIQNRIIEVNQNQKQVEQDIKVAIFTLMVEINKKGKALLHQLESLAKDHRMKLMQQQQEVAGLSKQLEHVMHFSKWAVSSGSSTALLYSKRLITYRLRHLLRARCDASPVTNNTIQFHCDPSFWAQNIINLGSLVIEDKESQPQMPKQNPVVEQNSQPPSGLSSNQLSKFPTQISLAQLRLQHMQQQQPPPRLINFQNHSPKPNGPVLPPHPQQLRYPPNQNIPRQAIKPNPLQMAFLAQQAIKQWQISSGQGTPSTTNSTSSTPSSPTITSAAGYDGKAFGSPMIDLSSPVGGSYNLPSLPDIDCSSTIMLDNIVRKDTNIDHGQPRPPSNRTVQSPNSSVPSPGLAGPVTMTSVHPPIRSPSASSVGSRGSSGSSSKPAGADSTHKVPVVMLEPIRIKQENSGPPENYDFPVVIVKQESDEESRPQNANYPRSILTSLLLNSSQSSTSEETVLRSDAPDSTGDQPGLHQDNSSNGKSEWLDPSQKSPLHVGETRKEDDPNEDWCAVCQNGGELLCCEKCPKVFHLSCHVPTLTNFPSGEWICTFCRDLSKPEVEYDCDAPSHNSEKKKTEGLVKLTPIDKRKCERLLLFLYCHEMSLAFQDPVPLTVPDYYKIIKNPMDLSTIKKRLQEDYSMYSKPEDFVADFRLIFQNCAEFNEPDSEVANAGIKLENYFEELLKNLYPEKRFPKPEFRNESEDNKFSDDSDDDFVQPRKKRLKSIEERQLLK

SEQ ID NO: 92347 - protein, 1012 aa, Homo sapiens
  Payload ID: 18484
  Gene Name: tripartite motif containing 24
  ENSP ID: ENSP00000484482
MEVAVEKAVAAAARLGCPPGGPRGSGENEAESRQGPDSERGGEAARLNLLDTCAVCHQNIQSRAPKLLPCLHSFCQRCLPAPQRYLMLPAPMLGSAETPPPVPAPARRSASSPFATQVGVIRCPVCSQECAERHIIDNFFVKDTTEVPSSTVEKSNQVCTSCEDNAEANGFCVECVEWLCKTCIRAHQRVKFTKDHTVRQKEEVSPEAVGVTSQRPVFCPFHKKEQLKLYCETCDKLTCRDCQLLEHKEHRYQFIEEAFQNQKVIIDTLITKLMEKTKYIKFTGNQIQNRIIEVNQNQKQVEQDIKVAIFTLMVEINKKGKALLHQLESLAKDHRMKLMQQQQEVAGLSKQLEHVMHFSKWAVSSGSSTALLYSKRLITYRLRHLLRARCDASPVTNNTIQFHCDPSFWAQNIINLGSLVIEDKESQPQMPKQNPVVEQNSQPPSGLSSNQLSKFPTQISLAQLRLQHMQQQQPPPRLINFQNHSPKPNGPVLPPHPQQLRYPPNQNIPRQAIKPNPLQMAFLAQQAIKQWQISSGQGTPSTTNSTSSTPSSPTITSAAGYDGKAFGSPMIDLSSPVGGSYNLPSLPDIDCSSTIMLDNIVRKDTNIDHGQPRPPSNRTVQSPNSSVPSPGLAGPVTMTSVHPPIRSPSASSVGSRGSSGSSSKPAGADSTHKVPVVMLEPIRIKQENSGPPENYDFPVVIVKQESDEESRPQNANYPRSILTSLLLNSSQSSTSEETVLRSDAPDSTGDQPGLHQDNSSNGKSEWLDPSQKSPLHVGETRKEDDPNEDWCAVCQNGGELLCCEKCPKVFHLSCHVPTLTNFPSGEWICTFCRDLSKPEVEYDCDAPSHNSEKKKTEGLVKLTPIDKRKCERLLLFLYCHEMSLAFQDPVPLTVPDYYKIIKNPMDLSTIKKRLQEDYSMYSKPEDFVADFRLIFQNCAEFNEPDSEVANAGIKLENYFEELLKNLYPEKRFPKPEFRNESEDNKFSDDSDDDFVQPRKKRLKSIEERQLLK

SEQ ID NO: 92348 - protein, 630 aa, Homo sapiens
  Payload ID: 18485
  Gene Name: tripartite motif containing 25
  Uniprot ID: Q14258
  ENSP ID: ENSP00000323889
MAELCPLAEELSCSICLEPFKEPVTTPCGHNFCGSCLNETWAVQGSPYLCPQCRAVYQARPQLHKNTVLCNVVEQFLQADLAREPPADVWTPPARASAPSPNAQVACDHCLKEAAVKTCLVCMASFCQEHLQPHFDSPAFQDHPLQPPVRDLLRRKCSQHNRLREFFCPEHSECICHICLVEHKTCSPASLSQASADLEATLRHKLTVMYSQINGASRALDDVRNRQQDVRMTANRKVEQLQQEYTEMKALLDASETTSTRKIKEEEKRVNSKFDTIYQILLKKKSEIQTLKEEIEQSLTKRDEFEFLEKASKLRGISTKPVYIPEVELNHKLIKGIHQSTIDLKNELKQCIGRLQEPTPSSGDPGEHDPASTHKSTRPVKKVSKEEKKSKKPPPVPALPSKLPTFGAPEQLVDLKQAGLEAAAKATSSHPNSTSLKAKVLETFLAKSRPELLEYYIKVILDYNTAHNKVALSECYTVASVAEMPQNYRPHPQRFTYCSQVLGLHCYKKGIHYWEVELQKNNFCGVGICYGSMNRQGPESRLGRNSASWCVEWFNTKISAWHNNVEKTLPSTKATRVGVLLNCDHGFVIFFAVADKVHLMYKFRVDFTEALYPAFWVFSAGATLSICSPK

SEQ ID NO: 92349 - protein, 630 aa, Homo sapiens; identical to SEQ ID NO: 92348
  Payload ID: 18485
  Gene Name: tripartite motif containing 25
  Uniprot ID: Q14258
  ENSP ID: ENSP00000445961

SEQ ID NO: 92350 - protein, 43 aa, Homo sapiens
  Payload ID: 18485
  Gene Name: tripartite motif containing 25
  ENSP ID: ENSP00000459980
ECICHICLVEHKTCSPASLSQASADLEHLQGEQDPSSCCQRRQ

SEQ ID NO: 92351 - protein, 539 aa, Homo sapiens
  Payload ID: 18486
  Gene Name: tripartite motif containing 26
  Uniprot ID: Q12899
  ENSP ID: ENSP00000331131
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCVMCRESREHRPHTAVLMEKAAQPHREKILNHLSTLRRDRDKIQGFQAKGEADILAALKKLQDQRQYIVAEFEQGHQFLREREEHLLEQLAKLEQELTEGREKFKSRGVGELARLALVISELEGKAQQPAAELMQDTRDFLNRYPRKKFWVGKPIARVVKKKTGEFSDKLLSLQRGLREFQGKLLRDLEYKTVSVTLDPQSASGYLQLSEDWKCVTYTSLYKSAYLHPQQFDCEPGVLGSKGFTWGKVYWEVEVEREGWSEDEEEGDEEEEGEEEEEEEEAGYGDGYDDWETDEDEESLGDEEEEEEEEEEEVLESCMVGVARDSVKRKGDLSLRPEDGVWALRLSSSGIWANTSPEAELFPALRPRRVGIALDYEGGTVTFTNAESQELIYTFTATFTRRLVPFLWLKWPGTRLLLRP

SEQ ID NO: 92352 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000373102

SEQ ID NO: 92353 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000379806

SEQ ID NO: 92354 - protein, 157 aa, Homo sapiens
  Payload ID: 18486
  Gene Name: tripartite motif containing 26
  ENSP ID: ENSP00000387530
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCVMCRESREHRPHTAVLMEKAAQPHREKILNHLSTLR

SEQ ID NO: 92355 - protein, 122 aa, Homo sapiens
  Payload ID: 18486
  Gene Name: tripartite motif containing 26
  ENSP ID: ENSP00000388005
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCV

SEQ ID NO: 92356 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000389203

SEQ ID NO: 92357 - protein, 248 aa, Homo sapiens
  Payload ID: 18486
  Gene Name: tripartite motif containing 26
  ENSP ID: ENSP00000389386
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCVMCRESREHRPHTAVLMEKAAQPHREKILNHLSTLRRDRDKIQGFQAKGEADILAALKKLQDQRQYIVAEFEQGHQFLREREEHLLEQLAKLEQELTEGREKFKSRGVGELARLALVISELEGKAQQ

SEQ ID NO: 92358 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000390258

SEQ ID NO: 92359 - protein, 248 aa, Homo sapiens; identical to SEQ ID NO: 92357
  Payload ID: 18486
  Gene Name: tripartite motif containing 26
  ENSP ID: ENSP00000390908

SEQ ID NO: 92360 - protein, 157 aa, Homo sapiens; identical to SEQ ID NO: 92354
  Payload ID: 18486
  Gene Name: tripartite motif containing 26
  ENSP ID: ENSP00000391031

SEQ ID NO: 92361 - protein, 248 aa, Homo sapiens; identical to SEQ ID NO: 92357
  Payload ID: 18486
  Gene Name: tripartite motif containing 26
  ENSP ID: ENSP00000391602

SEQ ID NO: 92362 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000391879

SEQ ID NO: 92363 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000392805

SEQ ID NO: 92364 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000393011

SEQ ID NO: 92365 - protein, 159 aa, Homo sapiens
  Payload ID: 18486
  Gene Name: tripartite motif containing 26
  ENSP ID: ENSP00000393753
MATSAPLRSLEEEVTCSICLDYLRDPVTIDCGHVFCRSCTTDVRPISGSRPVCPLCKKPFKKENIRPVWQLEKILNHLSTLRRDRDKIQGFQAKGEADILAALKKLQDQRQYIVAEFEQGHQFLREREEHLLEQLAKLEQELTEGREKFKSRGVGELAR

SEQ ID NO: 92366 - protein, 122 aa, Homo sapiens; identical to SEQ ID NO: 92355
  Payload ID: 18486
  Gene Name: tripartite motif containing 26
  ENSP ID: ENSP00000393827

SEQ ID NO: 92367 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000394371

SEQ ID NO: 92368 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000394421

SEQ ID NO: 92369 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000395491

SEQ ID NO: 92370 - protein, 248 aa, Homo sapiens; identical to SEQ ID NO: 92357
  Payload ID: 18486
  Gene Name: tripartite motif containing 26
  ENSP ID: ENSP00000395820

SEQ ID NO: 92371 - protein, 122 aa, Homo sapiens; identical to SEQ ID NO: 92355
  Payload ID: 18486
  Gene Name: tripartite motif containing 26
  ENSP ID: ENSP00000396089

SEQ ID NO: 92372 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000396188

SEQ ID NO: 92373 - protein, 248 aa, Homo sapiens; identical to SEQ ID NO: 92357
  Payload ID: 18486
  Gene Name: tripartite motif containing 26
  ENSP ID: ENSP00000397048

SEQ ID NO: 92374 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000398545

SEQ ID NO: 92375 - protein, 159 aa, Homo sapiens; identical to SEQ ID NO: 92365
  Payload ID: 18486
  Gene Name: tripartite motif containing 26
  ENSP ID: ENSP00000400655

SEQ ID NO: 92376 - protein, 122 aa, Homo sapiens; identical to SEQ ID NO: 92355
  Payload ID: 18486
  Gene Name: tripartite motif containing 26
  ENSP ID: ENSP00000400920

SEQ ID NO: 92377 - protein, 248 aa, Homo sapiens; identical to SEQ ID NO: 92357
  Payload ID: 18486
  Gene Name: tripartite motif containing 26
  ENSP ID: ENSP00000402135

SEQ ID NO: 92378 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000402395

SEQ ID NO: 92379 - protein, 159 aa, Homo sapiens; identical to SEQ ID NO: 92365
  Payload ID: 18486
  Gene Name: tripartite motif containing 26
  ENSP ID: ENSP00000402684

SEQ ID NO: 92380 - protein, 157 aa, Homo sapiens; identical to SEQ ID NO: 92354
  Payload ID: 18486
  Gene Name: tripartite motif containing 26
  ENSP ID: ENSP00000402990

SEQ ID NO: 92381 - protein, 159 aa, Homo sapiens; identical to SEQ ID NO: 92365
  Payload ID: 18486
  Gene Name: tripartite motif containing 26
  ENSP ID: ENSP00000403395

SEQ ID NO: 92382 - protein, 122 aa, Homo sapiens; identical to SEQ ID NO: 92355
  Payload ID: 18486
  Gene Name: tripartite motif containing 26
  ENSP ID: ENSP00000403765

SEQ ID NO: 92383 - protein, 122 aa, Homo sapiens; identical to SEQ ID NO: 92355
  Payload ID: 18486
  Gene Name: tripartite motif containing 26
  ENSP ID: ENSP00000403887

SEQ ID NO: 92384 - protein, 122 aa, Homo sapiens; identical to SEQ ID NO: 92355
  Payload ID: 18486
  Gene Name: tripartite motif containing 26
  ENSP ID: ENSP00000405526

SEQ ID NO: 92385 - protein, 157 aa, Homo sapiens; identical to SEQ ID NO: 92354
  Payload ID: 18486
  Gene Name: tripartite motif containing 26
  ENSP ID: ENSP00000405710

SEQ ID NO: 92386 - protein, 159 aa, Homo sapiens; identical to SEQ ID NO: 92365
  Payload ID: 18486
  Gene Name: tripartite motif containing 26
  ENSP ID: ENSP00000405791

SEQ ID NO: 92387 - protein, 122 aa, Homo sapiens; identical to SEQ ID NO: 92355
  Payload ID: 18486
  Gene Name: tripartite motif containing 26
  ENSP ID: ENSP00000405923

SEQ ID NO: 92388 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000406707

SEQ ID NO: 92389 - protein, 157 aa, Homo sapiens; identical to SEQ ID NO: 92354
  Payload ID: 18486
  Gene Name: tripartite motif containing 26
  ENSP ID: ENSP00000407035

SEQ ID NO: 92390 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000407294

SEQ ID NO: 92391 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000407876

SEQ ID NO: 92392 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000408233

SEQ ID NO: 92393 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000409182

SEQ ID NO: 92394 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000410446

SEQ ID NO: 92395 - protein, 157 aa, Homo sapiens; identical to SEQ ID NO: 92354
  Payload ID: 18486
  Gene Name: tripartite motif containing 26
  ENSP ID: ENSP00000412165

SEQ ID NO: 92396 - protein, 157 aa, Homo sapiens; identical to SEQ ID NO: 92354
  Payload ID: 18486
  Gene Name: tripartite motif containing 26
  ENSP ID: ENSP00000412641

SEQ ID NO: 92397 - protein, 248 aa, Homo sapiens; identical to SEQ ID NO: 92357
  Payload ID: 18486
  Gene Name: tripartite motif containing 26
  ENSP ID: ENSP00000412838

SEQ ID NO: 92398 - protein, 248 aa, Homo sapiens; identical to SEQ ID NO: 92357
  Payload ID: 18486
  Gene Name: tripartite motif containing 26
  ENSP ID: ENSP00000413673

SEQ ID NO: 92399 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000414248

SEQ ID NO: 92400 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000415328

SEQ ID NO: 92401 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000415755

SEQ ID NO: 92402 - protein, 159 aa, Homo sapiens; identical to SEQ ID NO: 92365
  Payload ID: 18486
  Gene Name: tripartite motif containing 26
  ENSP ID: ENSP00000416276

SEQ ID NO: 92403 - protein, 157 aa, Homo sapiens; identical to SEQ ID NO: 92354
  Payload ID: 18486
  Gene Name: tripartite motif containing 26
  ENSP ID: ENSP00000416664

SEQ ID NO: 92404 - protein, 539 aa, Homo sapiens; identical to SEQ ID NO: 92351
  Payload ID: 18486
  Gene Name: tripartite motif containing 26
  Uniprot ID: Q12899
  ENSP ID: ENSP00000416737

SEQ ID NO: 92405 - protein, 358 aa, Homo sapiens
  Payload ID: 18487
  Gene Name: tripartite motif containing 27
  Uniprot ID: P14373
  ENSP ID: ENSP00000366399
MASGSVAECLQQETTCPVCLQYFAEPMMLDCGHNICCACLARCWGTAETNVSCPQCRETFPQRHMRPNRHLANVTQLVKQLRTERPSGPGGEMGVCEKHREPLKLYCEEDQMPICVVCDRSREHRGHSVLPLEEAVEGFKEQIQNQLDHLKRVKDLKKRRRAQGEQARAELLSLTQMEREKIVWEFEQLYHSLKEHEYRLLARLEELDLAIYNSINGAITQFSCNISHLSSLIAQLEEKQQQPTRELLQDIGDTLSRAERIRIPEPWITPPDLQEKIHIFAQKCLFLTESLKQFTEKMQSDMEKIQELREAQLYSVDVTLDPDTAYPSLILSDNLRQVRYSYLQQDLPDNPERSPSTT

SEQ ID NO: 92406 - protein, 513 aa, Homo sapiens
  Payload ID: 18487
  Gene Name: tripartite motif containing 27
  Uniprot ID: P14373
  ENSP ID: ENSP00000366404
MASGSVAECLQQETTCPVCLQYFAEPMMLDCGHNICCACLARCWGTAETNVSCPQCRETFPQRHMRPNRHLANVTQLVKQLRTERPSGPGGEMGVCEKHREPLKLYCEEDQMPICVVCDRSREHRGHSVLPLEEAVEGFKEQIQNQLDHLKRVKDLKKRRRAQGEQARAELLSLTQMEREKIVWEFEQLYHSLKEHEYRLLARLEELDLAIYNSINGAITQFSCNISHLSSLIAQLEEKQQQPTRELLQDIGDTLSRAERIRIPEPWITPPDLQEKIHIFAQKCLFLTESLKQFTEKMQSDMEKIQELREAQLYSVDVTLDPDTAYPSLILSDNLRQVRYSYLQQDLPDNPERFNLFPCVLGSPCFIAGRHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 92407 - protein, 513 aa, Homo sapiens; identical to SEQ ID NO: 92406
  Payload ID: 18487
  Gene Name: tripartite motif containing 27
  Uniprot ID: P14373
  ENSP ID: ENSP00000383555

SEQ ID NO: 92408 - protein, 358 aa, Homo sapiens; identical to SEQ ID NO: 92405
  Payload ID: 18487
  Gene Name: tripartite motif containing 27
  Uniprot ID: P14373
  ENSP ID: ENSP00000388622

SEQ ID NO: 92409 - protein, 513 aa, Homo sapiens; identical to SEQ ID NO: 92406
  Payload ID: 18487
  Gene Name: tripartite motif containing 27
  Uniprot ID: P14373
  ENSP ID: ENSP00000392787

SEQ ID NO: 92410 - protein, 248 aa, Homo sapiens
  Payload ID: 18487
  Gene Name: tripartite motif containing 27
  ENSP ID: ENSP00000396425
  MOD_RES (1)..(1): Any amino acid
XLKQFTEKMQSDMEKIQESADSLEGGILDLGSVLSHILPVSELREAQLYSVDVTLDPDTAYPSLILSDNLRQVRYSYLQQDLPDNPERFNLFPCVLGSPCFIAGRHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 92411 - protein, 249 aa, Homo sapiens
  Payload ID: 18487
  Gene Name: tripartite motif containing 27
  ENSP ID: ENSP00000396844
MASGSVAECLQQETTCPVCLQYFAEPMMLDCGHNICCACLARCWGTAETNVSCPQCRETFPQRHMRPNRHLANVTQLVKQLRTERPSGPGGEMGVCEKHREPLKLYCEEDQMPICVVCDRSREHRGHSVLPLEEAVEGFKEQIQNQLDHLKRVKDLKKRRRAQGEQARAELLSLTQMEREKIVWEFEQLYHSLKEHEYRLLARLEELDLAIYNSINGAITQFSCNISHLSSLIAQLEEKQQQPTRELLQ

SEQ ID NO: 92412 - protein, 248 aa, Homo sapiens; identical to SEQ ID NO: 92410
  Payload ID: 18487
  Gene Name: tripartite motif containing 27
  ENSP ID: ENSP00000398020
  MOD_RES (1)..(1): Any amino acid

SEQ ID NO: 92413 - protein, 207 aa, Homo sapiens
  Payload ID: 18487
  Gene Name: tripartite motif containing 27
  ENSP ID: ENSP00000398968
  MOD_RES (1)..(1): Any amino acid
XLREAQLYSVDVTLDPDTAYPSLILSDNLRQVRYSYLQQDLPDNPERFNLFPCVLGSPCFIAGRHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 92414 - protein, 248 aa, Homo sapiens; identical to SEQ ID NO: 92410
  Payload ID: 18487
  Gene Name: tripartite motif containing 27
  ENSP ID: ENSP00000400058
  MOD_RES (1)..(1): Any amino acid

SEQ ID NO: 92415 - protein, 248 aa, Homo sapiens; identical to SEQ ID NO: 92410
  Payload ID: 18487
  Gene Name: tripartite motif containing 27
  ENSP ID: ENSP00000401490
  MOD_RES (1)..(1): Any amino acid

SEQ ID NO: 92416 - protein, 249 aa, Homo sapiens; identical to SEQ ID NO: 92411
  Payload ID: 18487
  Gene Name: tripartite motif containing 27
  ENSP ID: ENSP00000403398

SEQ ID NO: 92417 - protein, 513 aa, Homo sapiens; identical to SEQ ID NO: 92406
  Payload ID: 18487
  Gene Name: tripartite motif containing 27
  Uniprot ID: P14373
  ENSP ID: ENSP00000405229

SEQ ID NO: 92418 - protein, 231 aa, Homo sapiens
  Payload ID: 18487
  Gene Name: tripartite motif containing 27
  ENSP ID: ENSP00000407693
  MOD_RES (1)..(1): Any amino acid
XSADSLEGGILDLGSVLSHILPVSELREAQLYSVDVTLDPDTAYPSLILSDNLRQVRYSYLQQDLPDNPERFNLFPCVLGSPCFIAGRHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 92419 - protein, 249 aa, Homo sapiens; identical to SEQ ID NO: 92411
  Payload ID: 18487
  Gene Name: tripartite motif containing 27
  ENSP ID: ENSP00000407959

SEQ ID NO: 92420 - protein, 52 aa, Homo sapiens
  Payload ID: 18487
  Gene Name: tripartite motif containing 27
  ENSP ID: ENSP00000410163
  MOD_RES (1)..(1): Any amino acid
XLREAQLYSVDVTLDPDTAYPSLILSDNLRQVRYSYLQQDLPDNPERSPSTT

SEQ ID NO: 92421 - protein, 358 aa, Homo sapiens; identical to SEQ ID NO: 92405
  Payload ID: 18487
  Gene Name: tripartite motif containing 27
  Uniprot ID: P14373
  ENSP ID: ENSP00000411026

SEQ ID NO: 92422 - protein, 358 aa, Homo sapiens; identical to SEQ ID NO: 92405
  Payload ID: 18487
  Gene Name: tripartite motif containing 27
  Uniprot ID: P14373
  ENSP ID: ENSP00000412445

SEQ ID NO: 92423 - protein, 513 aa, Homo sapiens; identical to SEQ ID NO: 92406
  Payload ID: 18487
  Gene Name: tripartite motif containing 27
  Uniprot ID: P14373
  ENSP ID: ENSP00000414793

SEQ ID NO: 92424 - protein, 247 aa, Homo sapiens
  Payload ID: 18487
  Gene Name: tripartite motif containing 27
  ENSP ID: ENSP00000414955
LKQFTEKMQSDMEKIQESADSLEGGILDLGSVLSHILPVSELREAQLYSVDVTLDPDTAYPSLILSDNLRQVRYSYLQQDLPDNPERFNLFPCVLGSPCFIAGRHYWEVEVGDKAKWTIGVCEDSVCRKGGVTSAPQNGFWAVSLWYGKEYWALTSPMTALPLRTPLQRVGIFLDYDAGEVSFYNVTERCHTFTFSHATFCGPVRPYFSLSYSGGKSAAPLIICPMSGIDGFSGHVGNHGHSMETSP

SEQ ID NO: 92425 - protein, 358 aa, Homo sapiens; identical to SEQ ID NO: 92405
  Payload ID: 18487
  Gene Name: tripartite motif containing 27
  Uniprot ID: P14373
  ENSP ID: ENSP00000416281

SEQ ID NO: 92426 - protein, 249 aa, Homo sapiens; identical to SEQ ID NO: 92411
  Payload ID: 18487
  Gene Name: tripartite motif containing 27
  ENSP ID: ENSP00000416983

SEQ ID NO: 92427 - protein, 835 aa, Homo sapiens
  Payload ID: 18488
  Gene Name: tripartite motif containing 28
  Uniprot ID: Q13263
  ENSP ID: ENSP00000253024
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTVVDCPVCKQQCFSKDIVENYFMRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQKVTEGQQERLERQHWTMTKIQKHQEHILRFASWALESDNNTALLLSKKLIYFQLHRALKMIVDPVEPHGEMKFQWDLNAWTKSAEAFGKIVAERPGTNSTGPAPMAPPRAPGPLSKQGSGSSQPMEVQEGYGFGSGDDPYSSAEPHVSGVKRSRSGEGEVSGLMRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 92428 - protein, 753 aa, Homo sapiens
  Payload ID: 18488
  Gene Name: tripartite motif containing 28
  Uniprot ID: Q13263
  ENSP ID: ENSP00000342232
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQKVTEGQQERLERQHWTMTKIQKHQEHILRFASWALESDNNTALLLSKKLIYFQLHRALKMIVDPVEPHGEMKFQWDLNAWTKSAEAFGKIVAERPGTNSTGPAPMAPPRAPGPLSKQGSGSSQPMEVQEGYGFGSGDDPYSSAEPHVSGVKRSRSGEGEVSGLMRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 92429 - protein, 61 aa, Homo sapiens
  Payload ID: 18488
  Gene Name: tripartite motif containing 28
  ENSP ID: ENSP00000470503
MRDSGSKAATDAQDANQCCTSCEDNAPATSYCVECSEPLCETCVEAHQRVKYTKDHTVRST

SEQ ID NO: 92430 - protein, 460 aa, Homo sapiens
  Payload ID: 18488
  Gene Name: tripartite motif containing 28
  ENSP ID: ENSP00000471303
IYFQLHRALKMIVDPVEPHGEMKFQWDLNAWTKSAEAFGKIVAERPGTNSTGPAPMAPPRAPGPLSKQGSGSSQPMEVQEGYGFGSEPHVSGVKRSRSGEGEVSGLMRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 92431 - protein, 162 aa, Homo sapiens
  Payload ID: 18488
  Gene Name: tripartite motif containing 28
  ENSP ID: ENSP00000472586
MRLGAQRPASVWSGGGAERGITLYKVVDCPVCKQQCFSKDIVENYFMRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVR

SEQ ID NO: 92432 - protein, 178 aa, Homo sapiens
  Payload ID: 18488
  Gene Name: tripartite motif containing 28
  ENSP ID: ENSP00000473126
MRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRV

SEQ ID NO: 92433 - protein, 588 aa, Homo sapiens
  Payload ID: 18489
  Gene Name: tripartite motif containing 29
  Uniprot ID: Q14134
  ENSP ID: ENSP00000343129
MEAADASRSNGSSPEARDARSPSGPSGSLENGTKADGKDAKTTNGHGGEAAEGKSLGSALKPGEGRSALFAGNEWRRPIIQFVESGDDKNSNYFSMDSMEGKRSPYAGLQLGAAKKPPVTFAEKGELRKSIFSESRKPTVSIMEPGETRRNSYPRADTGLFSRSKSGSEEVLCDSCIGNKQKAVKSCLVCQASFCELHLKPHLEGAAFRDHQLLEPIRDFEARKCPVHGKTMELFCQTDQTCICYLCMFQEHKNHSTVTVEEAKAEKETELSLQKEQLQLKIIEIEDEAEKWQKEKDRIKSFTTNEKAILEQNFRDLVRDLEKQKEEVRAALEQREQDAVDQVKVIMDALDERAKVLHEDKQTREQLHSISDSVLFLQEFGALMSNYSLPPPLPTYHVLLEGEGLGQSLGNFKDDLLNVCMRHVEKMCKADLSRNFIERNHMENGGDHRYVNNYTNSFGGEWSAPDTMKRYSMYLTPKGGVRTSYQPSSPGRFTKETTQKNFNNLYGTKGNYTSRVWEYSSSIQNSDNDLPVVQGSSSFSLKGYPSLMRSQSPKAQPQTWKSGKQTMLSHYRPFYVNKGNGIGSNEAP

SEQ ID NO: 92434 - protein, 38 aa, Homo sapiens
  Payload ID: 18489
  Gene Name: tripartite motif containing 29
  ENSP ID: ENSP00000433084
MEAADASRSNGSSPEARDARSPSGPSGSLENGTKADGK

SEQ ID NO: 92435 - protein, 119 aa, Homo sapiens
  Payload ID: 18489
  Gene Name: tripartite motif containing 29
  ENSP ID: ENSP00000433122
  MOD_RES (1)..(1): Any amino acid
XNYTNSFGGEWSAPDTMKRYSMYLTPKGGVRTSYQPSSPGRFTKETTQKNFNNLYGTKGNYTSRVWEYSSSIQNSDNDLPVVQGSSSFSLKGYPSLMRSQSPKAQPQTWKSGKQTMLVV

SEQ ID NO: 92436 - protein, 95 aa, Homo sapiens
  Payload ID: 18489
  Gene Name: tripartite motif containing 29
  ENSP ID: ENSP00000433324
MEAADASRSNGSSPEARDARSPSGPSGSLENGTKADGKDAKTTNGHGGEAAEGKSLGSALKPGEGRSALFAGNEWRRPIIQFVESGDDKNSNYFS

SEQ ID NO: 92437 - protein, 169 aa, Homo sapiens
  Payload ID: 18489
  Gene Name: tripartite motif containing 29
  ENSP ID: ENSP00000433779
MEAADASRSNGSSPEARDARSPSGPSGSLENGTKADGKDAKTTNGHGGEAAEGKSLGSALKPGEEATRYLCRKGRAAQVHFLGVPEAHGVHHGARGDPAEQLPPGRHGPFFTVQVRLRGGAVRLLHRQQAEGGQVLPGVPGLLLRAASQAPPGGRRLPRPPAARAHPGL

SEQ ID NO: 92438 - protein, 97 aa, Homo sapiens
  Payload ID: 18489
  Gene Name: tripartite motif containing 29
  ENSP ID: ENSP00000435600
MEAADASRSNGSSPEARDARSPSGPSGSLENGTKADGKDAKTTNGHGGEAAEGKSLGSALKPGEGRSALFAGNEWRRPIIQFVESGDDKNSNYFSMD

SEQ ID NO: 92439 - protein, 121 aa, Homo sapiens
  Payload ID: 18489
  Gene Name: tripartite motif containing 29
  ENSP ID: ENSP00000435696
MKRYSMYLTPKGGVRTSYQPSSPGRFTKETTQKNFNNLYGTKGNYTSRVWEYSSSIQNSDNDLPVVQGSSSFSLKGYPSLMRSQSPKAQPQTWKSGKQTMLSHYRPFYVNKGNGIGSNEAP

SEQ ID NO: 92440 - protein, 327 aa, Homo sapiens
  Payload ID: 18489
  Gene Name: tripartite motif containing 29
  ENSP ID: ENSP00000436015
MVPGISETELSLQKEQLQLKIIEIEDEAEKWQKEKDRIKSFTTNEKAILEQNFRDLVRDLEKQKEEVRAALEQREQDAVDQVKVIMDALDERAKVLHEDKQTREQLHSISDSVLFLQEFGALMSNYSLPPPLPTYHVLLEGEGLGQSLGNFKDDLLNVCMRHVEKMCKADLSRNFIERNHMENGGDHRYVNNYTNSFGGEWSAPDTMKRYSMYLTPKGGVRTSYQPSSPGRFTKETTQKNFNNLYGTKGNYTSRVWEYSSSIQNSDNDLPVVQGSSSFSLKGYPSLMRSQSPKAQPQTWKSGKQTMLSHYRPFYVNKGNGIGSNEAP

SEQ ID NO: 92441 - protein, 94 aa, Homo sapiens
  Payload ID: 18489
  Gene Name: tripartite motif containing 29
  ENSP ID: ENSP00000436279
MSDPKDFSQWWNPGGVRTSYQPSSPGRFTKETTQKNFNNLYGTKGNYTSRVWEYSSSIQNSDNDLPVVQGSSSFSLKGYPSLMRSQSPKAQPQT

SEQ ID NO: 92442 - protein, 89 aa, Homo sapiens
  Payload ID: 18489
  Gene Name: tripartite motif containing 29
  ENSP ID: ENSP00000436567
MEAADASRSNGSSPEARDARSPSGPSGSLENGTKADGKDAKTTNGHGGEAAEGKSLGSALKPGEGRSALFAGNEWRRPIIQFVESGDDK

SEQ ID NO: 92443 - protein, 169 aa, Homo sapiens
  Payload ID: 18489
  Gene Name: tripartite motif containing 29
  ENSP ID: ENSP00000437078
NYTNSFGGEWSAPDTMKRYSMYLTPKGGVRTSYQPSSPGRFTKETTQKNFNNLYGTKGNYTSRVWEYSSSIQNSDNDLPVVQGSSSFSLKGTGKTPYQFTTLGQATAEFSKPLGRSGLSKNNPGYPSLMRSQSPKAQPQTWKSGKQTMLSHYRPFYVNKGNGIGSNEAP

SEQ ID NO: 92444 - protein, 169 aa, Homo sapiens; identical to SEQ ID NO: 92437
  Payload ID: 18489
  Gene Name: tripartite motif containing 29
  ENSP ID: ENSP00000485773

SEQ ID NO: 92445 - protein, 744 aa, Homo sapiens
  Payload ID: 18490
  Gene Name: tripartite motif containing 3
  Uniprot ID: O75382
  ENSP ID: ENSP00000340797
MAKREDSPGPEVQPMDKQFLVCSICLDRYQCPKVLPCLHTFCERCLQNYIPAQSLTLSCPVCRQTSILPEQGVSALQNNFFISSLMEAMQQAPDGAHDPEDPHPLSVVAGRPLSCPNHEGKTMEFYCEACETAMCGECRAGEHREHGTVLLRDVVEQHKAALQRQLEAVRGRLPQLSAAIALVGGISQQLQERKAEALAQISAAFEDLEQALQQRKQALVSDLETICGAKQKVLQSQLDTLRQGQEHIGSSCSFAEQALRLGSAPEVLLVRKHMRERLAALAAQAFPERPHENAQLELVLEVDGLRRSVLNLGALLTTSATAHETVATGEGLRQALVGQPASLTVTTKDKDGRLVRTGSAELRAEITGPDGTRLPVPVVDHKNGTYELVYTARTEGELLLSVLLYGQPVRGSPFRVRALRPGDLPPSPDDVKRRVKSPGGPGSHVRQKAVRRPSSMYSTGGKRKDNPIEDELVFRVGSRGREKGEFTNLQGVSAASSGRIVVADSNNQCIQVFSNEGQFKFRFGVRGRSPGQLQRPTGVAVDTNGDIIVADYDNRWVSIFSPEGKFKTKIGAGRLMGPKGVAVDRNGHIIVVDNKSCCVFTFQPNGKLVGRFGGRGATDRHFAGPHFVAVNNKNEIVVTDFHNHSVKVYSADGEFLFKFGSHGEGNGQFNAPTGVAVDSNGNIIVADWGNSRIQVFDSSGSFLSYINTSAEPLYGPQGLALTSDGHVVVADAGNHCFKAYRYLQ

SEQ ID NO: 92446 - protein, 744 aa, Homo sapiens; identical to SEQ ID NO: 92445
  Payload ID: 18490
  Gene Name: tripartite motif containing 3
  Uniprot ID: O75382
  ENSP ID: ENSP00000352508

SEQ ID NO: 92447 - protein, 260 aa, Homo sapiens
  Payload ID: 18490
  Gene Name: tripartite motif containing 3
  ENSP ID: ENSP00000433070
MAKREDSPGPEVQPMDKQFLVCSICLDRYQCPKVLPCLHTFCERCLQNYIPAQSLTLSCPVCRQTSILPEQGVSALQNNFFISSLMEAMQQAPDGAHDPEDPHPLSVVAGRPLSCPNHEGKTMEFYCEACETAMCGECRAGEHREHGTVLLRDVVEQHKAALQRQLEAVRGRLPQLSAAIALVGGISQQLQERKAEALAQISAAFEDLEQALQQRKQALVSDLETICGAKQKVLQSQLDTLRQGQEHIGSSCSFAEQALR

SEQ ID NO: 92448 - protein, 744 aa, Homo sapiens; identical to SEQ ID NO: 92445
  Payload ID: 18490
  Gene Name: tripartite motif containing 3
  Uniprot ID: O75382
  ENSP ID: ENSP00000433102

SEQ ID NO: 92449 - protein, 96 aa, Homo sapiens
  Payload ID: 18490
  Gene Name: tripartite motif containing 3
  ENSP ID: ENSP00000437283
MAKREDSPGPEVQPMDKQFLVCSICLDRYQCPKVLPCLHTFCERCLQNYIPAQSLTLSCPVCRQTSILPEQGVSALQNNFFISSLMEAMQQAPDGA

SEQ ID NO: 92450 - protein, 625 aa, Homo sapiens
  Payload ID: 18490
  Gene Name: tripartite motif containing 3
  Uniprot ID: O75382
  ENSP ID: ENSP00000445460
MKTMEFYCEACETAMCGECRAGEHREHGTVLLRDVVEQHKAALQRQLEAVRGRLPQLSAAIALVGGISQQLQERKAEALAQISAAFEDLEQALQQRKQALVSDLETICGAKQKVLQSQLDTLRQGQEHIGSSCSFAEQALRLGSAPEVLLVRKHMRERLAALAAQAFPERPHENAQLELVLEVDGLRRSVLNLGALLTTSATAHETVATGEGLRQALVGQPASLTVTTKDKDGRLVRTGSAELRAEITGPDGTRLPVPVVDHKNGTYELVYTARTEGELLLSVLLYGQPVRGSPFRVRALRPGDLPPSPDDVKRRVKSPGGPGSHVRQKAVRRPSSMYSTGGKRKDNPIEDELVFRVGSRGREKGEFTNLQGVSAASSGRIVVADSNNQCIQVFSNEGQFKFRFGVRGRSPGQLQRPTGVAVDTNGDIIVADYDNRWVSIFSPEGKFKTKIGAGRLMGPKGVAVDRNGHIIVVDNKSCCVFTFQPNGKLVGRFGGRGATDRHFAGPHFVAVNNKNEIVVTDFHNHSVKVYSADGEFLFKFGSHGEGNGQFNAPTGVAVDSNGNIIVADWGNSRIQVFDSSGSFLSYINTSAEPLYGPQGLALTSDGHVVVADAGNHCFKAYRYLQ

SEQ ID NO: 92451 - protein, 425 aa, Homo sapiens [sequence omitted]

SEQ ID NO: 92452 - protein, 425 aa, Homo sapiens
  Payload ID: 18491
  Gene Name: tripartite motif containing 31
  Uniprot ID: Q9BZY9
  ENSP ID: ENSP00000365924
MASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLVDSLKTKQNMPPRQLLEDIKVVLCRSEEFQFLNPTPVPLELEKKLSEAKSRHDSITGSLKKFKDQLQADRKKDENRFFKSMNKNDMKSWGLLQKNNHKMNKTSEPGSSSAGGRTTSGPPNHHSSAPSHSLFRASSAGKVTFPVCLLASYDEISGQGASSQDTKTFDVALSEELHAALSEWLTAIRAWFCEVPSS

SEQ ID NO: 92453 - protein, 425 aa, Homo sapiens [sequence omitted]

SEQ ID NO: 92454 - protein, 425 aa, Homo sapiens; identical to SEQ ID NO: 92452
  Payload ID: 18491
  Gene Name: tripartite motif containing 31
  Uniprot ID: Q9BZY9
  ENSP ID: ENSP00000391685

SEQ ID NO: 92455 - protein, 425 aa, Homo sapiens; identical to SEQ ID NO: 92452
  Payload ID: 18491
  Gene Name: tripartite motif containing 31
  Uniprot ID: Q9BZY9
  ENSP ID: ENSP00000398677

SEQ ID NO: 92456 - protein, 248 aa, Homo sapiens
  Payload ID: 18491
  Gene Name: tripartite motif containing 31
  ENSP ID: ENSP00000404933
MASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLVDSLKTKQNMPPRQLLE

SEQ ID NO: 92457 - protein, 425 aa, Homo sapiens; identical to SEQ ID NO: 92452
  Payload ID: 18491
  Gene Name: tripartite motif containing 31
  Uniprot ID: Q9BZY9
  ENSP ID: ENSP00000409501

SEQ ID NO: 92458 - protein, 425 aa, Homo sapiens
  Payload ID: 18491
  Gene Name: tripartite motif containing 31
  ENSP ID: ENSP00000411879
MASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLIDSLKTKQNMPPRQLLEDIKVVLCRSEEFQFLNPTPVPLELEKKLSEAKSRHDSITGSLKKFKDQLQADRKKDENRFFKSMNKNDMKSWGLLQKNNHKMNKTSEPGSSSAGGRTTSGPPNHHSSAPSHSLFRASSAGKVTFPVCLLASYDEISGQGASSQDTKTFDVALSEELHAALSEWLTAIRAWFCKVPSS

SEQ ID NO: 92459 - protein, 653 aa, Homo sapiens
  Payload ID: 18492
  Gene Name: tripartite motif containing 32
  Uniprot ID: Q13049
  ENSP ID: ENSP00000363095
MAAAAASHLNLDALREVLECPICMESFTEEQLRPKLLHCGHTICRQCLEKLLASSINGVRCPFCSKITRITSLTQLTDNLTVLKIIDTAGLSEAVGLLMCRSCGRRLPRQFCRSCGLVLCEPCREADHQPPGHCTLPVKEAAEERRRDFGEKLTRLRELMGELQRRKAALEGVSKDLQARYKAVLQEYGHEERRVQDELARSRKFFTGSLAEVEKSNSQVVEEQSYLLNIAEVQAVSRCDYFLAKIKQADVALLEETADEEEPELTASLPRELTLQDVELLKVGHVGPLQIGQAVKKPRTVNVEDSWAMEATASAASTSVTFREMDMSPEEVVASPRASPAKQRGPEAASNIQQCLFLKKMGAKGSTPGMFNLPVSLYVTSQGEVLVADRGNYRIQVFTRKGFLKEIRRSPSGIDSFVLSFLGADLPNLTPLSVAMNCQGLIGVTDSYDNSLKVYTLDGHCVACHRSQLSKPWGITALPSGQFVVTDVEGGKLWCFTVDRGSGVVKYSCLCSAVRPKFVTCDAEGTVYFTQGLGLNLENRQNEHHLEGGFSIGSVGPDGQLGRQISHFFSENEDFRCIAGMCVDARGDLIVADSSRKEILHFPKGGGYSVLIREGLTCPVGIALTPKGQLLVLDCWDHCIKIYSYHLRRYSTP

SEQ ID NO: 92460 - protein, 653 aa, Homo sapiens; identical to SEQ ID NO: 92459
  Payload ID: 18492
  Gene Name: tripartite motif containing 32
  Uniprot ID: Q13049
  ENSP ID: ENSP00000408292

SEQ ID NO: 92461 - protein, 172 aa, Homo sapiens
  Payload ID: 18492
  Gene Name: tripartite motif containing 32
  ENSP ID: ENSP00000412603
MAAAAASHLNLDALREVLECPICMESFTEEQLRPKLLHCGHTICRQCLEKLLASSINGVRCPFCSKITRITSLTQLTDNLTVLKIIDTAGLSEAVGLLMCRSCGRRLPRQFCRSCGLVLCEPCREADHQPPGHCTLPVKEAAEERRRDFGEKLTRLRELMGELQRRKAALEG

SEQ ID NO: 92462 - protein, 1127 aa, Homo sapiens
  Payload ID: 18493
  Gene Name: tripartite motif containing 33
  Uniprot ID: Q9UPN9
  ENSP ID: ENSP00000351250
MAENKGGGEAESGGGGSGSAPVTAGAAGPAAQEAEPPLTAVLVEEEEEEGGRAGAEGGAAGPDDGGVAAASSGSAQAASSPAASVGTGVAGGAVSTPAPAPASAPAPGPSAGPPPGPPASLLDTCAVCQQSLQSRREAEPKLLPCLHSFCLRCLPEPERQLSVPIPGGSNGDIQQVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKIEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEMMKVVQVYADTQEINLKADSEVAQAGKAVALYFEDKLTEIYSDRTFAPLPEFEQEEDDGEVTEDSDEDFIQPRRKRLKSDERPVHIK

SEQ ID NO: 92463 - protein, 1110 aa, Homo sapiens
  Payload ID: 18493
  Gene Name: tripartite motif containing 33
  Uniprot ID: Q9UPN9
  ENSP ID: ENSP00000358556
MAENKGGGEAESGGGGSGSAPVTAGAAGPAAQEAEPPLTAVLVEEEEEEGGRAGAEGGAAGPDDGGVAAASSGSAQAASSPAASVGTGVAGGAVSTPAPAPASAPAPGPSAGPPPGPPASLLDTCAVCQQSLQSRREAEPKLLPCLHSFCLRCLPEPERQLSVPIPGGSNGDIQQVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKIEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEADSEVAQAGKAVALYFEDKLTEIYSDRTFAPLPEFEQEEDDGEVTEDSDEDFIQPRRKRLKSDERPVHIK

SEQ ID NO: 92464 - protein, 888 aa, Homo sapiens
  Payload ID: 18493
  Gene Name: tripartite motif containing 33
  ENSP ID: ENSP00000402333
  MOD_RES (1)..(1): Any amino acid
XSVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQANVVPMMHSWYEFGAREKTQDQNVLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKIEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEMMKVVQVYADTQEINLKADSEVAQAGKAVALYFEDKLTEIYSDRTFAPLPEFEQEEDDGEVTEDSDEDFIQPRRKRLKSDERPVHIK

SEQ ID NO: 92465 - protein, 1119 aa, Homo sapiens
  Payload ID: 18493
  Gene Name: tripartite motif containing 33
  ENSP ID: ENSP00000412077
MAENKGGGEAESGGGGSGSAPVTAGAAGPAAQEAEPPLTAVLVEEEEEEGGRAGAEGGAAGPDDGGVAAASSGSAQAASSPAASVGTGVAGGAVSTPAPAPASAPAPGPSAGPPPGPPASLLDTCAVCQQSLQSRREAEPKLLPCLHSFCLRCLPEPERQLSVPIPGGSNGDIQQVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKIEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEMMKVVQVYADTQEINLKADSEVAQAGKAVALYFEDKLTEIYSDRTFAPLPEFEQEEDDGEVTEDSDEDFIQPRRTPKVR

SEQ ID NO: 92466 - protein, 488 aa, Homo sapiens
  Payload ID: 18494
  Gene Name: tripartite motif containing 34
  Uniprot ID: Q9BYJ4
  ENSP ID: ENSP00000402595
MASKILLNVQEEVTCPICLELLTEPLSLDCGHSLCRACITVSNKEAVTSMGGKSSCPVCGISYSFEHLQANQHLANIVERLKEVKLSPDNGKKRDLCDHHGEKLLLFCKEDRKVICWLCERSQEHRGHHTVLTEEVFKECQEKLQAVLKRLKKEEEEAEKLEADIREEKTSWKYQVQTERQRIQTEFDQLRSILNNEEQRELQRLEEEEKKTLDKFAEAEDELVQQKQLVRELISDVECRSQWSTMELLQDMSGIMKWSEIWRLKKPKMVSKKLKTVFHAPDLSRMLQMFRELTAVRCYWVDVTLNSVNLNLNLVLSEDQRQVISVPIWPFQCYNYGVLGSQYFSSGKHYWEVDVSKKTAWILGVYCRTYSRHMKYVVRRCANRQNLYTKYRPLFGYWVIGLQNKCKYGVFEESLSSDPEVLTLSMAVPPCRVGVFLDYEAGIVSFFNVTSHGSLIYKFSKCCFSQPVYPYFNPWNCPAPMTLCPPSS

SEQ ID NO: 92467 - protein, 488 aa, Homo sapiens; identical to SEQ ID NO: 92466
  Payload ID: 18494
  Gene Name: tripartite motif containing 34
  Uniprot ID: Q9BYJ4
  ENSP ID: ENSP00000422947

SEQ ID NO: 92468 - protein, 493 aa, Homo sapiens
  Payload ID: 18495
  Gene Name: tripartite motif containing 35
  Uniprot ID: Q9UPQ4
  ENSP ID: ENSP00000301924
MERSPDVSPGPSRSFKEELLCAVCYDPFRDAVTLRCGHNFCRGCVSRCWEVQVSPTCPVCKDRASPADLRTNHTLNNLVEKLLREEAEGARWTSYRFSRVCRLHRGQLSLFCLEDKELLCCSCQADPRHQGHRVQPVKDTAHDFRAKCRNMEHALREKAKAFWAMRRSYEAIAKHNQVEAAWLEGRIRQEFDKLREFLRVEEQAILDAMAEETRQKQLLADEKMKQLTEETEVLAHEIERLQMEMKEDDVSFLMKHKSRKRRLFCTMEPEPVQPGMLIDVCKYLGSLQYRVWKKMLASVESVPFSFDPNTAAGWLSVSDDLTSVTNHGYRVQVENPERFSSAPCLLGSRVFSQGSHAWEVALGGLQSWRVGVVRVRQDSGAEGHSHSCYHDTRSGFWYVCRTQGVEGDHCVTSDPATSPLVLAIPRRLRVELECEEGELSFYDAERHCHLYTFHARFGEVRPYFYLGGARGAGPPEPLRICPLHISVKEELDG

SEQ ID NO: 92469 - protein, 266 aa, Homo sapiens
  Payload ID: 18495
  Gene Name: tripartite motif containing 35
  ENSP ID: ENSP00000428770
MERSPDVSPGPSRSFKEELLCAVCYDPFRDAVTLRCGHNFCRGCVSRCWEVQVSPTCPVCKDRASPADLRTNHTLNNLVEKLLREEAEGARWTSYRFSRVCRLHRGQLSLFCLEDKELLCCSCQADPRHQGHRVQPVKDTAHDFRVEAAWLEGRIRQEFDKLREFLRVEEQAILDAMAEETRQKQLLADEKMKQLTEETEVLAHEIERLQMEMKEDDVSFLMTLLHHGARASPARHAYRCLQVPGLPAVPRLEEDACICGICTLQL

SEQ ID NO: 92470 - protein, 100 aa, Homo sapiens
  Payload ID: 18495
  Gene Name: tripartite motif containing 35
  ENSP ID: ENSP00000429356
  MOD_RES (1)..(1): Any amino acid
XEIERLQMEMKEDDVSFLMKHKSRKRRLFCTMEPEPVQPGMLIDVCKYLGSLQYRVWKKMLASVESVPFSFDPNTAAGWLSVSDDLTSVTNHGYRVQEQC

SEQ ID NO: 92471 - protein, 728 aa, Homo sapiens
  Payload ID: 18496
  Gene Name: tripartite motif containing 36
  Uniprot ID: Q9NQ86
  ENSP ID: ENSP00000282369
MSESGEMSEFGYIMELIAKGKVTIKNIERELICPACKELFTHPLILPCQHSICHKCVKELLLTLDDSFNDVGSDNSNQSSPRLRLPSPSMDKIDRINRPGWKRNSLTPRTTVFPCPGCEHDVDLGERGINGLFRNFTLETIVERYRQAARAATAIMCDLCKPPPQESTKSCMDCSASYCNECFKIHHPWGTIKAQHEYVGPTTNFRPKILMCPEHETERINMYCELCRRPVCHLCKLGGNHANHRVTTMSSAYKTLKEKLSKDIDYLIGKESQVKSQISELNLLMKETECNGERAKEEAITHFEKLFEVLEERKSSVLKAIDSSKKLRLDKFQTQMEEYQGLLENNGLVGYAQEVLKETDQSCFVQTAKQLHLRIQKATESLKSFRPAAQTSFEDYVVNTSKQTELLGELSFFSSGIDVPEINEEQSKVYNNALINWHHPEKDKADSYVLEYRKINRDDEMSWNEIEVCGTSKIIQDLENSSTYAFRVRAYKGSICSPCSRELILHTPPAPVFSFLFDEKCGYNNEHLLLNLKRDRVESRAGFNLLLAAERIQVGYYTSLDYIIGDTGITKGKHFWAFRVEPYSYLVKVGVASSDKLQEWLRSPRDAVSPRYEQDSGHDSGSEDACFDSSQPFTLVTIGMQKFFIPKSPTSSNEPENRVLPMPTSIGIFLDCDKGKVDFYDMDQMKCLYERQVDCSHTLYPAFALMGSGGIQLEEPITAKYLEYQEDM

SEQ ID NO: 92472 - protein, 61 aa, Homo sapiens
  Payload ID: 18496
  Gene Name: tripartite motif containing 36
  Uniprot ID: Q9NQ86
  ENSP ID: ENSP00000368937
MSESGEMSEFGYIMELIAKGKASAMGLQQTHEHSRLTSKGGEARCPFEISEVGKQSLPRRT

SEQ ID NO: 92473 - protein, 60 aa, Homo sapiens
  Payload ID: 18496
  Gene Name: tripartite motif containing 36
  Uniprot ID: Q9NQ86
  ENSP ID: ENSP00000368938
MSESGEMSEFGYIMELIAKGKMPDWRRGYRCRQGCGKTTELATATDFSQTGNKSGKHFKT

SEQ ID NO: 92474 - protein, 716 aa, Homo sapiens
  Payload ID: 18496
  Gene Name: tripartite motif containing 36
  Uniprot ID: Q9NQ86
  ENSP ID: ENSP00000423934
MEGDGSDSPVTIKNIERELICPACKELFTHPLILPCQHSICHKCVKELLLTLDDSFNDVGSDNSNQSSPRLRLPSPSMDKIDRINRPGWKRNSLTPRTTVFPCPGCEHDVDLGERGINGLFRNFTLETIVERYRQAARAATAIMCDLCKPPPQESTKSCMDCSASYCNECFKIHHPWGTIKAQHEYVGPTTNFRPKILMCPEHETERINMYCELCRRPVCHLCKLGGNHANHRVTTMSSAYKTLKEKLSKDIDYLIGKESQVKSQISELNLLMKETECNGERAKEEAITHFEKLFEVLEERKSSVLKAIDSSKKLRLDKFQTQMEEYQGLLENNGLVGYAQEVLKETDQSCFVQTAKQLHLRIQKATESLKSFRPAAQTSFEDYVVNTSKQTELLGELSFFSSGIDVPEINEEQSKVYNNALINWHHPEKDKADSYVLEYRKINRDDEMSWNEIEVCGTSKIIQDLENSSTYAFRVRAYKGSICSPCSRELILHTPPAPVFSFLFDEKCGYNNEHLLLNLKRDRVESRAGFNLLLAAERIQVGYYTSLDYIIGDTGITKGKHFWAFRVEPYSYLVKVGVASSDKLQEWLRSPRDAVSPRYEQDSGHDSGSEDACFDSSQPFTLVTIGMQKFFIPKSPTSSNEPENRVLPMPTSIGIFLDCDKGKVDFYDMDQMKCLYERQVDCSHTLYPAFALMGSGGIQLEEPITAKYLEYQEDM

SEQ ID NO: 92475 - protein, 573 aa, Homo sapiens
  Payload ID: 18496
  Gene Name: tripartite motif containing 36
  ENSP ID: ENSP00000424259
MCDLCKPPPQESTKSCMDCSASYCNECFKIHHPWGTIKAQHEYVGPTTNFRPKILMCPEHETERINMYCELCRRPVCHLCKLGGNHANHRVTTMSSAYKTLKEKLSKDIDYLIGKESQVKSQISELNLLMKETECNGERAKEEAITHFEKLFEVLEERKSSVLKAIDSSKKLRLDKFQTQMEEYQGLLENNGLVGYAQEVLKETDQSCFVQTAKQLHLRIQKATESLKSFRPAAQTSFEDYVVNTSKQTELLGELSFFSSGIDVPEINEEQSKVYNNALINWHHPEKDKADSYVLEYRKINRDDEMSWNEIEVCGTSKIIQDLENSSTYAFRVRAYKGSICSPCSRELILHTPPAPVFSFLFDEKCGYNNEHLLLNLKRDRVESRAGFNLLLAAERIQVGYYTSLDYIIGDTGITKGKHFWAFRVEPYSYLVKVGVASSDKLQEWLRSPRDAVSPRYEQDSGHDSGSEDACFDSSQPFTLVTIGMQKFFIPKSPTSSNEPENRVLPMPTSIGIFLDCDKGKVDFYDMDQMKCLYERQVDCSHTLYPAFALMGSGGIQLEEPITAKYLEYQEDM

SEQ ID NO: 92476 - protein, 170 aa, Homo sapiens
  Payload ID: 18496
  Gene Name: tripartite motif containing 36
  ENSP ID: ENSP00000424743
MEGDGSDSPVTIKNIERELICPACKELFTHPLILPCQHSICHKCVKELLLTLDDSFNDVGSDNSNQSSPRLRLPSPSMDKIDRINRPASQRRSVGWRGWKRNSLTPRTTVFPCPGCEHDVDLGERGINGLFRNFTLETIVERYRQAARAATAIMCDLCKPPPQESTKSCM

SEQ ID NO: 92477 - protein, 964 aa, Homo sapiens
  Payload ID: 18497
  Gene Name: tripartite motif containing 37
  Uniprot ID: O94972
  ENSP ID: ENSP00000262294
MDEQSVESIAEVFRCFICMEKLRDARLCPHCSKLCCFSCIRRWLTEQRAQCPHCRAPLQLRELVNCRWAEEVTQQLDTLQLCSLTKHEENEKDKCENHHEKLSVFCWTCKKCICHQCALWGGMHGGHTFKPLAEIYEQHVTKVNEEVAKLRRRLMELISLVQEVERNVEAVRNAKDERVREIRNAVEMMIARLDTQLKNKLITLMGQKTSLTQETELLESLLQEVEHQLRSCSKSELISKSSEILMMFQQVHRKPMASFVTTPVPPDFTSELVPSYDSATFVLENFSTLRQRADPVYSPPLQVSGLCWRLKVYPDGNGVVRGYYLSVFLELSAGLPETSKYEYRVEMVHQSCNDPTKNIIREFASDFEVGECWGYNRFFRLDLLANEGYLNPQNDTVILRFQVRSPTFFQKSRDQHWYITQLEAAQTSYIQQINNLKERLTIELSRTQKSRDLSPPDNHLSPQNDDALETRAKKSACSDMLLEGGPTTASVREAKEDEEDEEKIQNEDYHHELSDGDLDLDLVYEDEVNQLDGSSSSASSTATSNTEENDIDEETMSGENDVEYNNMELEEGELMEDAAAAGPAGSSHGYVGSSSRISRRTHLCSAATSSLLDIDPLILIHLLDLKDRSSIENLWGLQPRPPASLLQPTASYSRKDKDQRKQQAMWRVPSDLKMLKRLKTQMAEVRCMKTDVKNTLSEIKSSSAASGDMQTSLFSADQAALAACGTENSGRLQDLGMELLAKSSVANCYIRNSTNKKSNSPKPARSSVAGSLSLRRAVDPGENSRSKGDCQTLSEGSPGSSQSGSRHSSPRALIHGSIGDILPKTEDRQCKALDSDAVVVAVFSGLPAVEKRRKMVTLGANAKGGHLEGLQMTDLENNSETGELQPVLPEGASAAPEEGMSSDSDIECDTENEEQEEHTSVGGFHDSFMVMTQPPDEDTHSSFPDGEQIGPEDLSFNTDENSGR

SEQ ID NO: 92478 - protein, 930 aa, Homo sapiens
  Payload ID: 18497
  Gene Name: tripartite motif containing 37
  Uniprot ID: O94972
  ENSP ID: ENSP00000376784
MDEQSVERWLTEQRAQCPHCRAPLQLRELVNCRWAEEVTQQLDTLQLCSLTKHEENEKDKCENHHEKLSVFCWTCKKCICHQCALWGGMHGGHTFKPLAEIYEQHVTKVNEEVAKLRRRLMELISLVQEVERNVEAVRNAKDERVREIRNAVEMMIARLDTQLKNKLITLMGQKTSLTQETELLESLLQEVEHQLRSCSKSELISKSSEILMMFQQVHRKPMASFVTTPVPPDFTSELVPSYDSATFVLENFSTLRQRADPVYSPPLQVSGLCWRLKVYPDGNGVVRGYYLSVFLELSAGLPETSKYEYRVEMVHQSCNDPTKNIIREFASDFEVGECWGYNRFFRLDLLANEGYLNPQNDTVILRFQVRSPTFFQKSRDQHWYITQLEAAQTSYIQQINNLKERLTIELSRTQKSRDLSPPDNHLSPQNDDALETRAKKSACSDMLLEGGPTTASVREAKEDEEDEEKIQNEDYHHELSDGDLDLDLVYEDEVNQLDGSSSSASSTATSNTEENDIDEETMSGENDVEYNNMELEEGELMEDAAAAGPAGSSHGYVGSSSRISRRTHLCSAATSSLLDIDPLILIHLLDLKDRSSIENLWGLQPRPPASLLQPTASYSRKDKDQRKQQAMWRVPSDLKMLKRLKTQMAEVRCMKTDVKNTLSEIKSSSAASGDMQTSLFSADQAALAACGTENSGRLQDLGMELLAKSSVANCYIRNSTNKKSNSPKPARSSVAGSLSLRRAVDPGENSRSKGDCQTLSEGSPGSSQSGSRHSSPRALIHGSIGDILPKTEDRQCKALDSDAVVVAVFSGLPAVEKRRKMVTLGANAKGGHLEGLQMTDLENNSETGELQPVLPEGASAAPEEGMSSDSDIECDTENEEQEEHTSVGGFHDSFMVMTQPPDEDTHSSFPDGEQIGPEDLSFNTDENSGR

SEQ ID NO: 92479 - protein, 964 aa, Homo sapiens; identical to SEQ ID NO: 92477
  Payload ID: 18497
  Gene Name: tripartite motif containing 37
  Uniprot ID: O94972
  ENSP ID: ENSP00000376785

SEQ ID NO: 92480 - protein, 67 aa, Homo sapiens
  Payload ID: 18497
  Gene Name: tripartite motif containing 37
  ENSP ID: ENSP00000462340
MDEQSVESIAEVFRCFICMEKLRDARLCPHCSKLCCFSCIRRWLTEQRAQCPHCRVSLCRPGRSAMA

SEQ ID NO: 92481 - protein, 54 aa, Homo sapiens
  Payload ID: 18497
  Gene Name: tripartite motif containing 37
  ENSP ID: ENSP00000462778
  MOD_RES (1)..(1): Any amino acid
XTDLENNSETGELQPVLPEGASAAPEEDTHSSFPDGEQIGPEDLSFNTDENSGR

SEQ ID NO: 92482 - protein, 194 aa, Homo sapiens
  Payload ID: 18497
  Gene Name: tripartite motif containing 37
  ENSP ID: ENSP00000462863
VNEEVAKLRRRLMELISLVQEVERNVEAVRNAKDERVREIRNAVEMMIARLDTQLKNKLITLMGQKTSLTQETELLESLLQEVEHQGASCFWKKWCQGRIYTLRSCSKSELISKSSEILMMFQQVHRKPMASFVTTPVPPDFTSELVPSYDSATFVLENFSTLRQRADPVYSPPLQVSGLCWRLKVYPDGNGVV

SEQ ID NO: 92483 - protein, 103 aa, Homo sapiens
  Payload ID: 18497
  Gene Name: tripartite motif containing 37
  ENSP ID: ENSP00000464263
MDEQSVESIAEVFRCFICMEKLRDARLCPHCSKLCCFSCIRRWLTEQRAQCPHCRAPLQLRELVNCRWAEEVTQQLDTLQLCSLTKHEENEKDKYVLNFFVQY

SEQ ID NO: 92484 - protein, 58 aa, Homo sapiens
  Payload ID: 18497
  Gene Name: tripartite motif containing 37
  ENSP ID: ENSP00000464590
MDEQSVESIAEVFRCFICMEKLRDARLCPHCSKLCCFSCIRRWLTEQRAQCPHCRKGM

SEQ ID NO: 92485 - protein, 117 aa, Homo sapiens
  Payload ID: 18497
  Gene Name: tripartite motif containing 37
  ENSP ID: ENSP00000464666
TLGANAKGGHLEGLQMTDLENNSETGELQPVLPEGASAAPEEETCSPSFLPGMSSDSDIECDTENEEQEEHTSVGGFHDSFMVMTQPPDEDTHSSFPDGEQIGPEDLSFNTDENSGR

SEQ ID NO: 92486 - protein, 113 aa, Homo sapiens
  Payload ID: 18497
  Gene Name: tripartite motif containing 37
  ENSP ID: ENSP00000464688
  MOD_RES (1)..(1): Any amino acid
XDEQSVESIAEVFRCFICMEKLRDARLCPHCSKLCCFSCIRRWLTEQRAQCPHCRAPLQLRELVNCRWAEEVTQQLDTLQLCSLTKHEENEKDNMADIPLNLWQKFMSNTSLK

SEQ ID NO: 92487 - protein, 67 aa, Homo sapiens; identical to SEQ ID NO: 92480
  Payload ID: 18497
  Gene Name: tripartite motif containing 37
  ENSP ID: ENSP00000485901

SEQ ID NO: 92488 - protein, 465 aa, Homo sapiens
  Payload ID: 18498
  Gene Name: tripartite motif containing 38
  Uniprot ID: O00635
  ENSP ID: ENSP00000349596
MASTTSTKKMMEEATCSICLSLMTNPVSINCGHSYCHLCITDFFKNPSQKQLRQETFCCPQCRAPFHMDSLRPNKQLGSLIEALKETDQEMSCEEHGEQFHLFCEDEGQLICWRCERAPQHKGHTTALVEDVCQGYKEKLQKAVTKLKQLEDRCTEQKLSTAMRITKWKEKVQIQRQKIRSDFKNLQCFLHEEEKSYLWRLEKEEQQTLSRLRDYEAGLGLKSNELKSHILELEEKCQGSAQKLLQNVNDTLSRSWAVKLETSEAVSLELHTMCNVSKLYFDVKKMLRSHQVSVTLDPDTAHHELILSEDRRQVTRGYTQENQDTSSRRFTAFPCVLGCEGFTSGRRYFEVDVGEGTGWDLGVCMENVQRGTGMKQEPQSGFWTLRLCKKKGYVALTSPPTSLHLHEQPLLVGIFLDYEAGVVSFYNGNTGCHIFTFPKASFSDTLRPYFQVYQYSPLFLPPPGD

SEQ ID NO: 92489 - protein, 518 aa, Homo sapiens
  Payload ID: 18499
  Gene Name: tripartite motif containing 39
  Uniprot ID: Q9HCM9
  ENSP ID: ENSP00000365844
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKDVKSTLEKNIPRKFGGSLSTICPRDHKALLGLVKEINRCEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEVGDKTHWAVGVCRDSVSRKGELTPLPETGYWRVRLWNGDKYAATTTPFTPLHIKVKPKRVGIFLDYEAGTLSFYNVTDRSHIYTFTDTFTEKLWPLFYPGIRAGRKNAAPLTIRPPTDWE

SEQ ID NO: 92490 - protein, 488 aa, Homo sapiens
  Payload ID: 18499
  Gene Name: tripartite motif containing 39
  Uniprot ID: Q9HCM9
  ENSP ID: ENSP00000365847
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKDVKSTLEKCEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEVGDKTHWAVGVCRDSVSRKGELTPLPETGYWRVRLWNGDKYAATTTPFTPLHIKVKPKRVGIFLDYEAGTLSFYNVTDRSHIYTFTDTFTEKLWPLFYPGIRAGRKNAAPLTIRPPTDWE

SEQ ID NO: 92491 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000373095

SEQ ID NO: 92492 - protein, 518 aa, Homo sapiens; identical to SEQ ID NO: 92489
  Payload ID: 18499
  Gene Name: tripartite motif containing 39
  Uniprot ID: Q9HCM9
  ENSP ID: ENSP00000373096

SEQ ID NO: 92493 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000373097

SEQ ID NO: 92494 - protein, 518 aa, Homo sapiens; identical to SEQ ID NO: 92489
  Payload ID: 18499
  Gene Name: tripartite motif containing 39
  Uniprot ID: Q9HCM9
  ENSP ID: ENSP00000379796

SEQ ID NO: 92495 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000379797

SEQ ID NO: 92496 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000379800

SEQ ID NO: 92497 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000383486

SEQ ID NO: 92498 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000387445

SEQ ID NO: 92499 - protein, 227 aa, Homo sapiens
  Payload ID: 18499
  Gene Name: tripartite motif containing 39
  ENSP ID: ENSP00000388149
  MOD_RES (1)..(1): Any amino acid
XTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKDVKSTLEKCEKVKTMEVTSTTPCTSLHSEINDNVRGR

SEQ ID NO: 92500 - protein, 227 aa, Homo sapiens; identical to SEQ ID NO: 92499
  Payload ID: 18499
  Gene Name: tripartite motif containing 39
  ENSP ID: ENSP00000388224
  MOD_RES (1)..(1): Any amino acid

SEQ ID NO: 92501 - protein, 48 aa, Homo sapiens
  Payload ID: 18499
  Gene Name: tripartite motif containing 39
  ENSP ID: ENSP00000388852
MAETSLLEAGASAASTAAALENLQVEASCSVCLEYLKEPVIIECGHNF

SEQ ID NO: 92502 - protein, 260 aa, Homo sapiens
  Payload ID: 18499
  Gene Name: tripartite motif containing 39
  ENSP ID: ENSP00000388969
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLK

SEQ ID NO: 92503 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000389198

SEQ ID NO: 92504 - protein, 260 aa, Homo sapiens; identical to SEQ ID NO: 92502
  Payload ID: 18499
  Gene Name: tripartite motif containing 39
  ENSP ID: ENSP00000389389

SEQ ID NO: 92505 - protein, 74 aa, Homo sapiens
  Payload ID: 18499
  Gene Name: tripartite motif containing 39
  ENSP ID: ENSP00000389675
MAETSLLEAGASAASTAAALENLQVEASCSVCLEYLKEPVIIECGHNFCKACITRWWEDLERDFPCPVCRKTSR

SEQ ID NO: 92506 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000389852

SEQ ID NO: 92507 - protein, 227 aa, Homo sapiens; identical to SEQ ID NO: 92499
  Payload ID: 18499
  Gene Name: tripartite motif containing 39
  ENSP ID: ENSP00000390947
  MOD_RES (1)..(1): Any amino acid

SEQ ID NO: 92508 - protein, 59 aa, Homo sapiens
  Payload ID: 18499
  Gene Name: tripartite motif containing 39
  ENSP ID: ENSP00000391222
MAETSLLEAGASAASTAAALENLQVEASCSVCLEYLKEPVIIECGHNFCKACITRWWED

SEQ ID NO: 92509 - protein, 518 aa, Homo sapiens; identical to SEQ ID NO: 92489
  Payload ID: 18499
  Gene Name: tripartite motif containing 39
  Uniprot ID: Q9HCM9
  ENSP ID: ENSP00000391917

SEQ ID NO: 92510 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000392130

SEQ ID NO: 92511 - protein, 59 aa, Homo sapiens; identical to SEQ ID NO: 92508
  Payload ID: 18499
  Gene Name: tripartite motif containing 39
  ENSP ID: ENSP00000393186

SEQ ID NO: 92512 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000394353

SEQ ID NO: 92513 - protein, 144 aa, Homo sapiens
  Payload ID: 18499
  Gene Name: tripartite motif containing 39
  ENSP ID: ENSP00000394599
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLD

SEQ ID NO: 92514 - protein, 74 aa, Homo sapiens; identical to SEQ ID NO: 92505
  Payload ID: 18499
  Gene Name: tripartite motif containing 39
  ENSP ID: ENSP00000394768

SEQ ID NO: 92515 - protein, 74 aa, Homo sapiens; identical to SEQ ID NO: 92505
  Payload ID: 18499
  Gene Name: tripartite motif containing 39
  ENSP ID: ENSP00000395224

SEQ ID NO: 92516 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000396986

SEQ ID NO: 92517 - protein, 518 aa, Homo sapiens; identical to SEQ ID NO: 92489
  Payload ID: 18499
  Gene Name: tripartite motif containing 39
  Uniprot ID: Q9HCM9
  ENSP ID: ENSP00000397043

SEQ ID NO: 92518 - protein, 59 aa, Homo sapiens; identical to SEQ ID NO: 92508
  Payload ID: 18499
  Gene Name: tripartite motif containing 39
  ENSP ID: ENSP00000397665

SEQ ID NO: 92519 - protein, 48 aa, Homo sapiens; identical to SEQ ID NO: 92501
  Payload ID: 18499
  Gene Name: tripartite motif containing 39
  ENSP ID: ENSP00000397952

SEQ ID NO: 92520 - protein, 518 aa, Homo sapiens; identical to SEQ ID NO: 92489
  Payload ID: 18499
  Gene Name: tripartite motif containing 39
  Uniprot ID: Q9HCM9
  ENSP ID: ENSP00000398355

SEQ ID NO: 92521 - protein, 48 aa, Homo sapiens; identical to SEQ ID NO: 92501
  Payload ID: 18499
  Gene Name: tripartite motif containing 39
  ENSP ID: ENSP00000398442

SEQ ID NO: 92522 - protein, 59 aa, Homo sapiens; identical to SEQ ID NO: 92508
  Payload ID: 18499
  Gene Name: tripartite motif containing 39
  ENSP ID: ENSP00000398453

SEQ ID NO: 92523 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000398956

SEQ ID NO: 92524 - protein, 74 aa, Homo sapiens; identical to SEQ ID NO: 92505
  Payload ID: 18499
  Gene Name: tripartite motif containing 39
  ENSP ID: ENSP00000399106

SEQ ID NO: 92525 - protein, 227 aa, Homo sapiens; identical to SEQ ID NO: 92499
  Payload ID: 18499
  Gene Name: tripartite motif containing 39
  ENSP ID: ENSP00000399123
  MOD_RES (1)..(1): Any amino acid

SEQ ID NO: 92526 - protein, 227 aa, Homo sapiens; identical to SEQ ID NO: 92499
  Payload ID: 18499
  Gene Name: tripartite motif containing 39
  ENSP ID: ENSP00000400222
  MOD_RES (1)..(1): Any amino acid

SEQ ID NO: 92527 - protein, 144 aa, Homo sapiens; identical to SEQ ID NO: 92513
  Payload ID: 18499
  Gene Name: tripartite motif containing 39
  ENSP ID: ENSP00000400243

SEQ ID NO: 92528 - protein, 260 aa, Homo sapiens; identical to SEQ ID NO: 92502
  Payload ID: 18499
  Gene Name: tripartite motif containing 39
  ENSP ID: ENSP00000400264

SEQ ID NO: 92529 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000401071

SEQ ID NO: 92530 - protein, 74 aa, Homo sapiens; identical to SEQ ID NO: 92505
  Payload ID: 18499
  Gene Name: tripartite motif containing 39
  ENSP ID: ENSP00000401123

SEQ ID NO: 92531 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000401184

SEQ ID NO: 92532 - protein, 74 aa, Homo sapiens; identical to SEQ ID NO: 92505
  Payload ID: 18499
  Gene Name: tripartite motif containing 39
  ENSP ID: ENSP00000401848

SEQ ID NO: 92533 - protein, 48 aa, Homo sapiens; identical to SEQ ID NO: 92501
  Payload ID: 18499
  Gene Name: tripartite motif containing 39
  ENSP ID: ENSP00000403073

SEQ ID NO: 92534 - protein, 59 aa, Homo sapiens; identical to SEQ ID NO: 92508
  Payload ID: 18499
  Gene Name: tripartite motif containing 39
  ENSP ID: ENSP00000404333

SEQ ID NO: 92535 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000404340

SEQ ID NO: 92536 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000404904

SEQ ID NO: 92537 - protein, 48 aa, Homo sapiens; identical to SEQ ID NO: 92501
  Payload ID: 18499
  Gene Name: tripartite motif containing 39
  ENSP ID: ENSP00000405274

SEQ ID NO: 92538 - protein, 59 aa, Homo sapiens; identical to SEQ ID NO: 92508
  Payload ID: 18499
  Gene Name: tripartite motif containing 39
  ENSP ID: ENSP00000405498

SEQ ID NO: 92539 - protein, 144 aa, Homo sapiens; identical to SEQ ID NO: 92513
  Payload ID: 18499
  Gene Name: tripartite motif containing 39
  ENSP ID: ENSP00000405928

SEQ ID NO: 92540 - protein, 260 aa, Homo sapiens; identical to SEQ ID NO: 92502
  Payload ID: 18499
  Gene Name: tripartite motif containing 39
  ENSP ID: ENSP00000406019

SEQ ID NO: 92541 - protein, 144 aa, Homo sapiens; identical to SEQ ID NO: 92513
  Payload ID: 18499
  Gene Name: tripartite motif containing 39
  ENSP ID: ENSP00000406034

SEQ ID NO: 92542 - protein, 227 aa, Homo sapiens; identical to SEQ ID NO: 92499
  Payload ID: 18499
  Gene Name: tripartite motif containing 39
  ENSP ID: ENSP00000406770
  MOD_RES (1)..(1): Any amino acid

SEQ ID NO: 92543 - protein, 74 aa, Homo sapiens; identical to SEQ ID NO: 92505
  Payload ID: 18499
  Gene Name: tripartite motif containing 39
  ENSP ID: ENSP00000406918

SEQ ID NO: 92544 - protein, 144 aa, Homo sapiens; identical to SEQ ID NO: 92513
  Payload ID: 18499
  Gene Name: tripartite motif containing 39
  ENSP ID: ENSP00000406984

SEQ ID NO: 92545 - protein, 48 aa, Homo sapiens; identical to SEQ ID NO: 92501
  Payload ID: 18499
  Gene Name: tripartite motif containing 39
  ENSP ID: ENSP00000407661

SEQ ID NO: 92546 - protein, 260 aa, Homo sapiens; identical to SEQ ID NO: 92502
  Payload ID: 18499
  Gene Name: tripartite motif containing 39
  ENSP ID: ENSP00000407903

SEQ ID NO: 92547 - protein, 227 aa, Homo sapiens; identical to SEQ ID NO: 92499
  Payload ID: 18499
  Gene Name: tripartite motif containing 39
  ENSP ID: ENSP00000409819
  MOD_RES (1)..(1): Any amino acid

SEQ ID NO: 92548 - protein, 518 aa, Homo sapiens; identical to SEQ ID NO: 92489
  Payload ID: 18499
  Gene Name: tripartite motif containing 39
  Uniprot ID: Q9HCM9
  ENSP ID: ENSP00000409902

SEQ ID NO: 92549 - protein, 144 aa, Homo sapiens; identical to SEQ ID NO: 92513
  Payload ID: 18499
  Gene Name: tripartite motif containing 39
  ENSP ID: ENSP00000411500

SEQ ID NO: 92550 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000411582

SEQ ID NO: 92551 - protein, 518 aa, Homo sapiens; identical to SEQ ID NO: 92489
  Payload ID: 18499
  Gene Name: tripartite motif containing 39
  Uniprot ID: Q9HCM9
  ENSP ID: ENSP00000411949

SEQ ID NO: 92552 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000412743

SEQ ID NO: 92553 - protein, 59 aa, Homo sapiens; identical to SEQ ID NO: 92508
  Payload ID: 18499
  Gene Name: tripartite motif containing 39
  ENSP ID: ENSP00000413846

SEQ ID NO: 92554 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000414525

SEQ ID NO: 92555 - protein, 488 aa, Homo sapiens; identical to SEQ ID NO: 92490
  Payload ID: 18499
  Gene Name: tripartite motif containing 39
  Uniprot ID: Q9HCM9
  ENSP ID: ENSP00000415259

SEQ ID NO: 92556 - protein, 260 aa, Homo sapiens; identical to SEQ ID NO: 92502
  Payload ID: 18499
  Gene Name: tripartite motif containing 39
  ENSP ID: ENSP00000415414

SEQ ID NO: 92557 - protein, 144 aa, Homo sapiens; identical to SEQ ID NO: 92513
  Payload ID: 18499
  Gene Name: tripartite motif containing 39
  ENSP ID: ENSP00000415671

SEQ ID NO: 92558 - protein, 48 aa, Homo sapiens; identical to SEQ ID NO: 92501
  Payload ID: 18499
  Gene Name: tripartite motif containing 39
  ENSP ID: ENSP00000415953

SEQ ID NO: 92559 - protein, 260 aa, Homo sapiens; identical to SEQ ID NO: 92502
  Payload ID: 18499
  Gene Name: tripartite motif containing 39
  ENSP ID: ENSP00000416850

SEQ ID NO: 92560 - protein, 503 aa, Homo sapiens; identical to SEQ ID NO: 92170
  Payload ID: 18499
  Gene Name: tripartite motif containing 39
  ENSP ID: ENSP00000446632

SEQ ID NO: 92561 - protein, 503 aa, Homo sapiens; identical to SEQ ID NO: 92170
  Payload ID: 18499
  Gene Name: tripartite motif containing 39
  ENSP ID: ENSP00000446993

SEQ ID NO: 92562 - protein, 503 aa, Homo sapiens
  Payload ID: 18499
  Gene Name: tripartite motif containing 39
  ENSP ID: ENSP00000447432
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKDVKSTLEKCEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEAAHCVLAQDPENQALARFYCYTERTIAKRLVLRRDPSVKRTLCRGCSSLLVPGLTCTHRQRRCRGQRWTVQTCLTCQRSQRFLNDPGHLLWGDRPEAQLGSQADSKPLQPLPNTAHSISDRLPEEKMQTQGSSNQ

SEQ ID NO: 92563 - protein, 518 aa, Homo sapiens; identical to SEQ ID NO: 92489
  Payload ID: 18499
  Gene Name: tripartite motif containing 39
  Uniprot ID: Q9HCM9
  ENSP ID: ENSP00000447835

SEQ ID NO: 92564 - protein, 503 aa, Homo sapiens; identical to SEQ ID NO: 92562
  Payload ID: 18499
  Gene Name: tripartite motif containing 39
  ENSP ID: ENSP00000448191

SEQ ID NO: 92565 - protein, 518 aa, Homo sapiens; identical to SEQ ID NO: 92489
  Payload ID: 18499
  Gene Name: tripartite motif containing 39
  Uniprot ID: Q9HCM9
  ENSP ID: ENSP00000448462

SEQ ID NO: 92566 - protein, 503 aa, Homo sapiens
  Payload ID: 18499
  Gene Name: tripartite motif containing 39
  ENSP ID: ENSP00000448485
MAETSLLEAGASAASTAAALENLQVEASCSVCLEYLKEPVIIECGHNFCKACITRWWEDLERDFPCPVCRKTSRYRSLRPNRQLGSMVEIAKQLQAVKRKIRDESLCPQHHEALSLFCYEDQEAVCLICAISHTHRAHTVVPLDDATQEYKEKLQKCLEPLEQKLQEITRCKSSEEKKPGELKRLVESRRQQILREFEELHRRLDEEQQVLLSRLEEEEQDILQRLRENAAHLGDKRRDLAHLAAEVEGKCLQSGFEMLKDVKSTLEKCEKVKTMEVTSVSIELEKNFSNFPRQYFALRKILKQLIADVTLDPETAHPNLVLSEDRKSVKFVETRLRDLPDTPRRFTFYPCVLATEGFTSGRHYWEVEAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTKGSSNQ

SEQ ID NO: 92567 - protein, 518 aa, Homo sapiens; identical to SEQ ID NO: 92489
  Payload ID: 18499
  Gene Name: tripartite motif containing 39
  Uniprot ID: Q9HCM9
  ENSP ID: ENSP00000448572

SEQ ID NO: 92568 - protein, 518 aa, Homo sapiens; identical to SEQ ID NO: 92489
  Payload ID: 18499
  Gene Name: tripartite motif containing 39
  Uniprot ID: Q9HCM9
  ENSP ID: ENSP00000449272

SEQ ID NO: 92569 - protein, 503 aa, Homo sapiens; identical to SEQ ID NO: 92562
  Payload ID: 18499
  Gene Name: tripartite motif containing 39
  ENSP ID: ENSP00000449807

SEQ ID NO: 92570 - protein, 518 aa, Homo sapiens; identical to SEQ ID NO: 92489
  Payload ID: 18499
  Gene Name: tripartite motif containing 39
  Uniprot ID: Q9HCM9
  ENSP ID: ENSP00000449847

SEQ ID NO: 92571 - protein, 518 aa, Homo sapiens; identical to SEQ ID NO: 92489
  Payload ID: 18499
  Gene Name: tripartite motif containing 39
  Uniprot ID: Q9HCM9
  ENSP ID: ENSP00000450288

SEQ ID NO: 92572 - protein, 474 aa, Homo sapiens
  Payload ID: 18500
  Gene Name: tripartite motif containing 4
  Uniprot ID: Q9C037
  ENSP ID: ENSP00000275736
MEAEDIQEELTCPICLDYFQDPVSIECGHNFCRGCLHRNWAPGGGPFPCPECRHPSAPAALRPNWALARLTEKTQRRRLGPVPPGLCGRHWEPLRLFCEDDQRPVCLVCRESQEHQTHAMAPIDEAFESYREKLLKSQRNLVAKMKKVMHLQDVEVKNATQWKDKIKSQRMRISTEFSKLHNFLVEEEDLFLQRLNKEEEETKKKLNENTLKLNQTIASLKKLILEVGEKSQAPTLELLQNPKEVLTRSEIQDVNYSLEAVKVKTVCQIPLMKEMLKRFQVAVNLAEDTAHPKLVFSQEGRYVKNTASASSWPVFSSAWNYFAGWRNPQKTAFVERFQHLPCVLGKNVFTSGKHYWEVESRDSLEVAVGVCREDVMGITDRSKMSPDVGIWAIYWSAAGYWPLIGFPGTPTQQEPALHRVGVYLDRGTGNVSFYSAVDGVHLHTFSCSSVSRLRPFFWLSPLASLVIPPVTDRK

SEQ ID NO: 92573 - protein, 294 aa, Homo sapiens
  Payload ID: 18500
  Gene Name: tripartite motif containing 4
  Uniprot ID: Q9C037
  ENSP ID: ENSP00000346186
MEAEDIQEELTCPICLDYFQDPVSIECGHNFCRGCLHRNWAPGGGPFPCPECRHPSAPAALRPNWALARLTEKTQRRRLGPVPPGLCGRHWEPLRLFCEDDQRPVCLVCRESQEHQTHAMAPIDEAFESYREKLLKSQRNLVAKMKKVMHLQDVEVKNATQWKDKIKSQRMRISTEFSKLHNFLVEEEDLFLQRLNKEEEETKKKLNENTLKLNQTIASLKKLILEVGEKSQAPTLELLQNPKEVLTRSEIQDVNYSLEAVKVKTVCQIPLMKEMLKRFQATKIKTQKQNRHNM

SEQ ID NO: 92574 - protein, 500 aa, Homo sapiens
  Payload ID: 18500
  Gene Name: tripartite motif containing 4
  Uniprot ID: Q9C037
  ENSP ID: ENSP00000348216
MEAEDIQEELTCPICLDYFQDPVSIECGHNFCRGCLHRNWAPGGGPFPCPECRHPSAPAALRPNWALARLTEKTQRRRLGPVPPGLCGRHWEPLRLFCEDDQRPVCLVCRESQEHQTHAMAPIDEAFESYRTGNFDIHVDEWKRRLIRLLLYHFKQEEKLLKSQRNLVAKMKKVMHLQDVEVKNATQWKDKIKSQRMRISTEFSKLHNFLVEEEDLFLQRLNKEEEETKKKLNENTLKLNQTIASLKKLILEVGEKSQAPTLELLQNPKEVLTRSEIQDVNYSLEAVKVKTVCQIPLMKEMLKRFQVAVNLAEDTAHPKLVFSQEGRYVKNTASASSWPVFSSAWNYFAGWRNPQKTAFVERFQHLPCVLGKNVFTSGKHYWEVESRDSLEVAVGVCREDVMGITDRSKMSPDVGIWAIYWSAAGYWPLIGFPGTPTQQEPALHRVGVYLDRGTGNVSFYSAVDGVHLHTFSCSSVSRLRPFFWLSPLASLVIPPVTDRK

SEQ ID NO: 92575 - protein, 202 aa, Homo sapiens
  Payload ID: 18500
  Gene Name: tripartite motif containing 4
  ENSP ID: ENSP00000396229
  MOD_RES (1)..(1): Any amino acid
XDDQRPVCLVCRESQEHQTHAMAPIDEAFESYREKLLKSQRNLVAKMKKVMHLQDVEVKNATQWKDKIKSQRMRISTEFSKLHNFLVEEEDLFLQRLNKEEEETKKKLNENTLKLNQTIASLKKLILEVGEKSQAPTLELLQNPKEVLTRSEIQDVNYSLEAVKVKTVCQIPLMKEMLKRFQGIEKGDNVAEESDLSGRLHP

SEQ ID NO: 92576 - protein, 229 aa, Homo sapiens
  Payload ID: 18501
  Gene Name: tripartite motif containing 40
  Uniprot ID: Q6P9F5
  ENSP ID: ENSP00000308310
MIPLQKDNQEEGVCPICQESLKEAVSTNCGHLFCRVCLTQHVEKASASGVFCCPLCRKPCSEEVLGTGYICPNHQKRVCRFCEESRLLLCVECLVSPEHMSHHELTIENALSHYKERLNRRSRKLRKDIAELQRLKAQQEKKLQALQQWLGQLEHMPAEAARILDISRAVTQLRSLVIDLERTAKELDTNTLKNAGDLLNRSAPQKLEVIYPQLEKGVSELLLQPPQKL

SEQ ID NO: 92577 - protein, 258 aa, Homo sapiens
  Payload ID: 18501
  Gene Name: tripartite motif containing 40
  Uniprot ID: Q6P9F5
  ENSP ID: ENSP00000365914
MIPLQKDNQEEGVCPICQESLKEAVSTNCGHLFCRVCLTQHVEKASASGVFCCPLCRKPCSEEVLGTGYICPNHQKRVCRFCEESRLLLCVECLVSPEHMSHHELTIENALSHYKERLNRRSRKLRKDIAELQRLKAQQEKKLQALQFQVDHGNHRLEAGPESQHQTREQLGALPQQWLGQLEHMPAEAARILDISRAVTQLRSLVIDLERTAKELDTNTLKNAGDLLNRSAPQKLEVIYPQLEKGVSELLLQPPQKL

SEQ ID NO: 92578 - protein, 258 aa, Homo sapiens; identical to SEQ ID NO: 92577
  Payload ID: 18501
  Gene Name: tripartite motif containing 40
  Uniprot ID: Q6P9F5
  ENSP ID: ENSP00000373105

SEQ ID NO: 92579 - protein, 258 aa, Homo sapiens; identical to SEQ ID NO: 92577
  Payload ID: 18501
  Gene Name: tripartite motif containing 40
  Uniprot ID: Q6P9F5
  ENSP ID: ENSP00000379826

SEQ ID NO: 92580 - protein, 229 aa, Homo sapiens; identical to SEQ ID NO: 92576
  Payload ID: 18501
  Gene Name: tripartite motif containing 40
  Uniprot ID: Q6P9F5
  ENSP ID: ENSP00000383492

SEQ ID NO: 92581 - protein, 258 aa, Homo sapiens; identical to SEQ ID NO: 92577
  Payload ID: 18501
  Gene Name: tripartite motif containing 40
  Uniprot ID: Q6P9F5
  ENSP ID: ENSP00000388460

SEQ ID NO: 92582 - protein, 258 aa, Homo sapiens; identical to SEQ ID NO: 92577
  Payload ID: 18501
  Gene Name: tripartite motif containing 40
  Uniprot ID: Q6P9F5
  ENSP ID: ENSP00000389607

SEQ ID NO: 92583 - protein, 229 aa, Homo sapiens; identical to SEQ ID NO: 92576
  Payload ID: 18501
  Gene Name: tripartite motif containing 40
  Uniprot ID: Q6P9F5
  ENSP ID: ENSP00000393674

SEQ ID NO: 92584 - protein, 229 aa, Homo sapiens
  Payload ID: 18501
  Gene Name: tripartite motif containing 40
  ENSP ID: ENSP00000394748
MIPLQKDNQEEGVCPICQESLKEAVSTNCGHLFCRVCLTQHVEKASASGVFCCPLCRKPCSEEVLGTGYICPNHQKRVCRFCEESRLLLCVECLVSPEHMSHHELTIENALSHYKERLNRRSRKLRKDIAELQRLKAQQEKKLQALQQWLGQLEHMPAEAARILDISRAVTQLRSLVIDLERMAKELDTNTLKNAGDLLNRSAPQKLEVIYPQLKKGVSELLLQPPQKL

SEQ ID NO: 92585 - protein, 229 aa, Homo sapiens
  Payload ID: 18501
  Gene Name: tripartite motif containing 40
  ENSP ID: ENSP00000399450
MIPLQKDNQEEGVCPICQESLKEAVSTNCGHLFCRVCLTQHVEKASASGVFCCPLCRKPCSEEVLGTGYICPNHQKRVCRFCEESRLLLCVECLVSPEHMSHHELTIENALSHCKERLNRRSRKLRKDIAELQRLKAQQEKKLQALQQWLGQLEHMPAEAARILDISRAVTQLRSLVIDLERTAKELDTNTLKNAGDLLNRSAPQKLEVIYPQLEKGVSELLLQPPQKL

SEQ ID NO: 92586 - protein, 258 aa, Homo sapiens
  Payload ID: 18501
  Gene Name: tripartite motif containing 40
  ENSP ID: ENSP00000402617
MIPLQKDNQEEGVCPICQESLKEAVSTNCGHLFCRVCLTQHVEKASASGVFCCPLCRKPCSEEVLGTGYICPNHQKRVCRFCEESRLLLCVECLVSPEHMSHHELTIENALSHCKERLNRRSRKLRKDIAELQRLKAQQEKKLQALQFQVDHGNHRLEAGPESQHQTREQLGALPQQWLGQLEHMPAEAARILDISRAVTQLRSLVIDLERTAKELDTNTLKNAGDLLNRSAPQKLEVIYPQLEKGVSELLLQPPQKL

SEQ ID NO: 92587 - protein, 229 aa, Homo sapiens; identical to SEQ ID NO: 92576
  Payload ID: 18501
  Gene Name: tripartite motif containing 40
  Uniprot ID: Q6P9F5
  ENSP ID: ENSP00000403025

SEQ ID NO: 92588 - protein, 258 aa, Homo sapiens
  Payload ID: 18501
  Gene Name: tripartite motif containing 40
  ENSP ID: ENSP00000414258
MIPLQKDNQEEGVCPICQESLKEAVSTNCGHLFCRVCLTQHVEKASASGVFCCPLCRKPCSEEVLGTGYICPNHQKRVCRFCEESRLLLCVECLVSPEHMSHHELTIENALSHYKERLNRRSRKLRKDIAELQRLKAQQEKKLQALQFQVDHGNHRLEAGPESQHQTREQLGALPQQWLGQLEHMPAEAARILDISRAVTQLRSLVIDLERMAKELDTNTLKNAGDLLNRSAPQKLEVIYPQLKKGVSELLLQPPQKL

SEQ ID NO: 92589 - protein, 258 aa, Homo sapiens; identical to SEQ ID NO: 92588
  Payload ID: 18501
  Gene Name: tripartite motif containing 40
  ENSP ID: ENSP00000414769

SEQ ID NO: 92590 - protein, 229 aa, Homo sapiens; identical to SEQ ID NO: 92584
  Payload ID: 18501
  Gene Name: tripartite motif containing 40
  ENSP ID: ENSP00000415169

SEQ ID NO: 92591 - protein, 229 aa, Homo sapiens; identical to SEQ ID NO: 92576
  Payload ID: 18501
  Gene Name: tripartite motif containing 40
  Uniprot ID: Q6P9F5
  ENSP ID: ENSP00000416663

SEQ ID NO: 92592 - protein, 258 aa, Homo sapiens; identical to SEQ ID NO: 92577
  Payload ID: 18501
  Gene Name: tripartite motif containing 40
  Uniprot ID: Q6P9F5
  ENSP ID: ENSP00000416950

SEQ ID NO: 92593 - protein, 258 aa, Homo sapiens; identical to SEQ ID NO: 92577
  Payload ID: 18501
  Gene Name: tripartite motif containing 40
  Uniprot ID: Q6P9F5
  ENSP ID: ENSP00000446663

SEQ ID NO: 92594 - protein, 258 aa, Homo sapiens; identical to SEQ ID NO: 92577
  Payload ID: 18501
  Gene Name: tripartite motif containing 40
  Uniprot ID: Q6P9F5
  ENSP ID: ENSP00000447016

SEQ ID NO: 92595 - protein, 258 aa, Homo sapiens; identical to SEQ ID NO: 92586
  Payload ID: 18501
  Gene Name: tripartite motif containing 40
  ENSP ID: ENSP00000448384

SEQ ID NO: 92596 - protein, 258 aa, Homo sapiens; identical to SEQ ID NO: 92577
  Payload ID: 18501
  Gene Name: tripartite motif containing 40
  Uniprot ID: Q6P9F5
  ENSP ID: ENSP00000448967

SEQ ID NO: 92597 - protein, 258 aa, Homo sapiens; identical to SEQ ID NO: 92588
  Payload ID: 18501
  Gene Name: tripartite motif containing 40
  ENSP ID: ENSP00000479007

SEQ ID NO: 92598 - protein, 258 aa, Homo sapiens; identical to SEQ ID NO: 92588
  Payload ID: 18501
  Gene Name: tripartite motif containing 40
  ENSP ID: ENSP00000480009

SEQ ID NO: 92599 - protein, 258 aa, Homo sapiens; identical to SEQ ID NO: 92577
  Payload ID: 18501
  Gene Name: tripartite motif containing 40
  Uniprot ID: Q6P9F5
  ENSP ID: ENSP00000483120

SEQ ID NO: 92600 - protein, 630 aa, Homo sapiens
  Payload ID: 18502
  Gene Name: tripartite motif containing 41
  Uniprot ID: Q8WV44
  ENSP ID: ENSP00000320869
MAAVAMTPNPVQTLQEEAVCAICLDYFTDPVSIGCGHNFCRVCVTQLWGGEDEEDRDELDREEEEEDGEEEEVEAVGAGAGWDTPMRDEDYEGDMEEEVEEEEEGVFWTSGMSRSSWDNMDYVWEEEDEEEDLDYYLGDMEEEDLRGEDEEDEEEVLEEVEEEDLDPVTPLPPPPAPRRCFTCPQCRKSFPRRSFRPNLQLANMVQVIRQMHPTPGRGSRVTDQGICPKHQEALKLFCEVDEEAICVVCRESRSHKQHSVVPLEEVVQEYKAKLQGHVEPLRKHLEAVQKMKAKEERRVTELKSQMKSELAAVASEFGRLTRFLAEEQAGLERRLREMHEAQLGRAGAAASRLAEQAAQLSRLLAEAQERSQQGGLRLLQDIKETFNRCEEVQLQPPEVWSPDPCQPHSHDFLTDAIVRKMSRMFCQAARVDLTLDPDTAHPALMLSPDRRGVRLAERRQEVADHPKRFSADCCVLGAQGFRSGRHYWEVEVGGRRGWAVGAARESTHHKEKVGPGGSSVGSGDASSSRHHHRRRRLHLPQQPLLQREVWCVGTNGKRYQAQSSTEQTLLSPSEKPRRFGVYLDYEAGRLGFYNAETLAHVHTFSAAFLGERVFPFFRVLSKGTRIKLCP

SEQ ID NO: 92601 - protein, 518 aa, Homo sapiens
  Payload ID: 18502
  Gene Name: tripartite motif containing 41
  Uniprot ID: Q8WV44
  ENSP ID: ENSP00000336749
MAAVAMTPNPVQTLQEEAVCAICLDYFTDPVSIGCGHNFCRVCVTQLWGGEDEEDRDELDREEEEEDGEEEEVEAVGAGAGWDTPMRDEDYEGDMEEEVEEEEEGVFWTSGMSRSSWDNMDYVWEEEDEEEDLDYYLGDMEEEDLRGEDEEDEEEVLEEVEEEDLDPVTPLPPPPAPRRCFTCPQCRKSFPRRSFRPNLQLANMVQVIRQMHPTPGRGSRVTDQGICPKHQEALKLFCEVDEEAICVVCRESRSHKQHSVVPLEEVVQEYKAKLQGHVEPLRKHLEAVQKMKAKEERRVTELKSQMKSELAAVASEFGRLTRFLAEEQAGLERRLREMHEAQLGRAGAAASRLAEQAAQLSRLLAEAQERSQQGGLRLLQDIKETFNRCEEVQLQPPEVWSPDPCQPHSHDFLTDAIVRKMSRMFCQAARVDLTLDPDTAHPALMLSPDRRGVRLAERRQEVADHPKRFSADCCVLGAQGFRSGRHYWEEPKEPSWPPAQPSLTYYVCPTDRPEFSFT

SEQ ID NO: 92602 - protein, 362 aa, Homo sapiens
  Payload ID: 18502
  Gene Name: tripartite motif containing 41
  ENSP ID: ENSP00000424979
  MOD_RES (1)..(1): Any amino acid
XAICLDYFTDPVSIGCGHNFCRVCVTQLWGGEDEEDRDELDREEEEEDGEEEEVEAVGAGAGWDTPMRDEDYEGDMEEEVEEEEEGVFWTSGMSRSSWDNMDYVWEEEDEEEDLDYYLGDMEEEDLRGEDEEDEEEVLEEVEEEDLDPVTPLPPPPAPRRCFTCPQCRKSFPRRSFRPNLQLANMVQVIRQMHPTPGRGSRVTDQGICPKHQEALKLFCEVDEEAICVVCRESRSHKQHSVVPLEEVVQEYKAKLQGHVEPLRKHLEAVQKMKAKEERRVTELKSQMKSELAAVASEFGRLTRFLAEEQAGLERRLREMHEAQLGRAGAAASRLAEQAAQLSRLLAEAQERSQQGGLRLLQV

SEQ ID NO: 92603 - protein, 116 aa, Homo sapiens
  Payload ID: 18502
  Gene Name: tripartite motif containing 41
  ENSP ID: ENSP00000426790
  MOD_RES (1)..(1): Any amino acid
XQDIKETFNRCEEVQLQPPEVWSPDPCQPHSHDFLTDAIVRKMSRMFCQAARVDLTLDPDTAHPALMLSPDRRGVRLAERRQEVADHPKRFSADCCVLGAQGFRSGRHYWEVCMGP

SEQ ID NO: 92604 - protein, 191 aa, Homo sapiens
  Payload ID: 18502
  Gene Name: tripartite motif containing 41
  ENSP ID: ENSP00000426803
MKAKEERRVTELKSQMKSELAAVASEFGRLTRFLAEEQAGLERRLREMHEAQLGRAGAAASRLAEQAAQLSRLLAEAQERSQQGGLRLLQDIKETFNRCEEVQLQPPEVWSPDPCQPHSHDFLTDAIVRKMSRMFCQAARVDLTLDPDTAHPALMLSPDRRGVRLAERRQEVADHPKRFSADCCVLGAQGF

SEQ ID NO: 92605 - protein, 150 aa, Homo sapiens
  Payload ID: 18502
  Gene Name: tripartite motif containing 41
  ENSP ID: ENSP00000483672
LQEEAVCAICLDYFTDPVSIGCGHNFCRVCVTQLWGRRGGGSGGYPVTPLPPPPAPRRCFTCPQCRKSFPRRSFRPNLQLANMVQVIRQMHPTPGRGSRVTDQGICPKHQEALKLFCEVDEEAICVVCRESRSHKQHSVVPLEEVVQEYK

SEQ ID NO: 92606 - protein, 723 aa, Homo sapiens
  Payload ID: 18503
  Gene Name: tripartite motif containing 42
  Uniprot ID: Q8IWZ5
  ENSP ID: ENSP00000286349
METAMCVCCPCCTWQRCCPQLCSCLCCKFIFTSERNCTCFPCPYKDERNCQFCHCTCSESPNCHWCCCSWANDPNCKCCCTASSNLNCYYYESRCCRNTIITFHKGRLRSIHTSSKTALRTGSSDTQVDEVKSIPANSHLVNHLNCPMCSRLRLHSFMLPCNHSLCEKCLRQLQKHAEVTENFFILICPVCDRSHCMPYSNKMQLPENYLHGRLTKRYMQEHGYLKWRFDRSSGPILCQVCRNKRIAYKRCITCRLNLCNDCLKAFHSDVAMQDHVFVDTSAEEQDEKICIHHPSSRIIEYCRNDNKLLCTFCKFSFHNGHDTISLIDACSERAASLFSAIAKFKAVRYEIDNDLMEFNILKNSFKADKEAKRKEIRNGFLKLRSILQEKEKIIMEQIENLEVSRQKEIEKYVYVTTMKVNEMDGLIAYSKEALKETGQVAFLQSAKILVDQIEDGIQTTYRPDPQLRLHSINYVPLDFVELSSAIHELFPTGPKKVRSSGDSLPSPYPVHSETMIARKVTFSTHSLGNQHIYQRSSSMLSFSNTDKKAKVGLEACGRAQSATPAKPTDGLYTYWSAGADSQSVQNSSSFHNWYSFNDGSVKTPGPIVIYQTLVYPRAAKVYWTCPAEDVDSFEMEFYEVITSPPNNVQMELCGQIRDIMQQNLELHNLTPNTEYVFKVRAINDNGPGQWSDICKVVTPDGHGKNRAKWGLLKNIQSALQKHF

SEQ ID NO: 92607 - protein, 446 aa, Homo sapiens
  Payload ID: 18504
  Gene Name: tripartite motif containing 43
  Uniprot ID: Q96BQ3
  ENSP ID: ENSP00000272395
MDSDFSHAFQKELTCVICLNYLVDPVTICCGHSFCRPCLCLSWEEAQSPANCPACREPSPKMDFKTNILLKNLVTIARKASLWQFLSSEKQICGTHRQTKKMFCDMDKSLLCLLCSNSQEHGAHKHHPIEEAAEEHREKLLKQMRILWKKIQENQRNLYEEGRTAFLWRGNVVLRAQMIRNEYRKLHPVLHKEEKQHLERLNKEYQEIFQQLQRSWVKMDQKSKHLKEMYQELMEMCHKPDVELLQDLGDIVARSESVLLHMPQPVNPELTAGPITGLVYRLNRFRVEISFHFEVTNHNIRLFEDVRSWMFRRGPLNSDRSDYFAAWGARVFSFGKHYWELDVDNSCDWALGVCNNSWIRKNSTMVNSEDIFLLLCLKVDNHFNLLTTSPVFPHYIEKPLGRVGVFLDFESGSVSFLNVTKSSLIWSYPAGSLTFPVRPFFYTGHR

SEQ ID NO: 92608 - protein, 344 aa, Homo sapiens
  Payload ID: 18505
  Gene Name: tripartite motif containing 44
  Uniprot ID: Q96DX7
  ENSP ID: ENSP00000299413
MASGVGAAFEELPHDGTCDECEPDEAPGAEEVCRECGFCYCRRHAEAHRQKFLSHHLAEYVHGSQAWTPPADGEGAGKEEAEVKVEQEREIESEAGEESESEEESESEEESETEEESEDESDEESEEDSEEEMEDEQESEAEEDNQEEGESEAEGETEAESEFDPEIEMEAERVAKRKCPDHGLDLSTYCQEDRQLICVLCPVIGAHQGHQLSTLDEAFEELRSKDSGGLKAAMIELVERLKFKSSDPKVTRDQMKMFIQQEFKKVQKVIADEEQKALHLVDIQEAMATAHVTEILADIQSHMDRLMTQMAQAKEQLDTSNESAEPKAEGDEEGPSGASEEEDT

SEQ ID NO: 92609 - protein, 580 aa, Homo sapiens
  Payload ID: 18506
  Gene Name: tripartite motif containing 45
  Uniprot ID: Q9H8W5
  ENSP ID: ENSP00000256649
MSENRKPLLGFVSKLTSGTALGNSGKTHCPLCLGLFKAPRLLPCLHTVCTTCLEQLEPFSVVDIRGGDSDTSSEGSIFQELKPRSLQSQIGILCPVCDAQVDLPMGGVKALTIDHLAVNDVMLESLRGEGQGLVCDLCNDREVEKRCQTCKANLCHFCCQAHRRQKKTTYHTMVDLKDLKGYSRIGKPILCPVHPAEELRLFCEFCDRPVCQDCVVGEHREHPCDFTSNVIHKHGDSVWELLKGTQPHVEALEEALAQIHIINSALQKRVEAVAADVRTFSEGYIKAIEEHRDKLLKQLEDIRAQKENSLQLQKAQLEQLLADMRTGVEFTEHLLTSGSDLEILITKRVVVERLRKLNKVQYSTRPGVNDKIRFCPQEKAGQCRGYEIYGTINTKEVDPAKCVLQGEDLHRAREKQTASFTLLCKDAAGEIMGRGGDNVQVAVVPKDKKDSPVRTMVQDNKDGTYYISYTPKEPGVYTVWVCIKEQHVQGSPFTVMVRRKHRPHSGVFHCCTFCSSGGQKTARCACGGTMPGGYLGCGHGHKGHPGHPHWSCCGKFNEKSECTWTGGQSAPRSLLRTVAL

SEQ ID NO: 92610 - protein, 523 aa, Homo sapiens
  Payload ID: 18506
  Gene Name: tripartite motif containing 45
  ENSP ID: ENSP00000358473
MLSGVTLEGGGARSGEGRRSRTELKPRSLQSQIGILCPVCDAQVDLPMGGVKALTIDHLAVNDVMLESLRGEGQGLVCDLCNDREVEKRCQTCKANLCHFCCQAHRRQKKTTYHTMVDLKDLKGYSRIGKPILCPVHPAEELRLFCEFCDRPVCQDCVVGEHREHPCDFTSNVIHKHGDSVWELLKGTQPHVEALEEALAQIHIINSALQKRVEAVAADVRTFSEGYIKAIEEHRDKLLKQLEDIRAQKENSLQLQKAQLEQLLADMRTGVEFTEHLLTSGSDLEILITKRVVVERLRKLNKVQYSTRPGVNDKIRFCPQEKAGQCRGYEIYGTINTKEVDPAKCVLQGEDLHRAREKQTASFTLLCKDAAGEIMGRGGDNVQVAVVPKDKKDSPVRTMVQDNKDGTYYISYTPKEPGVYTVWVCIKEQHVQGSPFTVMVRRKHRPHSGVFHCCTFCSSGGQKTARCACGGTMPGGYLGCGHGHKGHPGHPHWSCCGKFNEKSECTWTGGQSAPRSLLRTVAL

SEQ ID NO: 92611 - protein, 562 aa, Homo sapiens
  Payload ID: 18506
  Gene Name: tripartite motif containing 45
  Uniprot ID: Q9H8W5
  ENSP ID: ENSP00000358476
MSENRKPLLGFVSKLTSGTALGNSGKTHCPLCLGLFKAPRLLPCLHTVCTTCLEQLEPFSVVDIRGGDSDTSSEGSIFQELKPRSLQSQIGILCPVCDAQVDLPMGGVKALTIDHLAVNDVMLESLRGEGQGLVCDLCNDREVEKRCQTCKANLCHFCCQAHRRQKKTTYHTMVDLKDLKGYSRIGKPILCPVHPAEELRLFCEFCDRPVCQDCVVGEHREHPCDFTSNVIHKHGDSVWELLKGTQPHVEALEEALAQIHIINSALQKRVEAVAADVRTFSEGYIKAIEEHRDKLLKQLEDIRAQKENSLQLQKAQLEQLLADMRTGVEFTEHLLTSGSDLEILITKRVVVERLRKLNKVQYSTRPGVNDKIRFCPQEKAGQCRGYEIYDLHRAREKQTASFTLLCKDAAGEIMGRGGDNVQVAVVPKDKKDSPVRTMVQDNKDGTYYISYTPKEPGVYTVWVCIKEQHVQGSPFTVMVRRKHRPHSGVFHCCTFCSSGGQKTARCACGGTMPGGYLGCGHGHKGHPGHPHWSCCGKFNEKSECTWTGGQSAPRSLLRTVAL

SEQ ID NO: 92612 - protein, 104 aa, Homo sapiens
  Payload ID: 18506
  Gene Name: tripartite motif containing 45
  ENSP ID: ENSP00000431261
  MOD_RES (1)..(1): Any amino acid
XTVWVCIKEQHVQGSPFTVMVRRKHRPHSGVFHCCTFCSSGGQKTARCACGGTMPGGYLGCGHGHKGHPGHPHWSCCGKFNEKSECTWTGGQSAPRSLLRTVAL

SEQ ID NO: 92613 - protein, 303 aa, Homo sapiens
  Payload ID: 18506
  Gene Name: tripartite motif containing 45
  ENSP ID: ENSP00000474935
MGGVKALTIDHLAVNDVMLESLRGEGQGLVCDLCNDREVEKRCQTCKANLCHFCCQAHRRQKKTTYHTMVDLKDLKGYSRIGKPILCPVHPAEELRLFCEFCDRPVCQDCVVGEHREHPCDFTSNVIHKHGDSVWELLKGTQPHVEALEEALAQIHIINSALQKRVEAVAADVRTFSEGYIKAIEEHRDKLLKQLEDIRAQKENSLQLQKAQLEQLLADMRTGVEFTEHLLTSGSDLEILITKRVVVERLRKLNKVQYSTRPGVNDKIRFCPQEKAGQCRGYEIYGTINTKEVDPAKCVLQGE

SEQ ID NO: 92614 - protein, 759 aa, Homo sapiens
  Payload ID: 18507
  Gene Name: tripartite motif containing 46
  Uniprot ID: Q7Z4K8
  ENSP ID: ENSP00000334657
MAEGEDMQTFTSIMDALVRISTSMKNMEKELLCPVCQEMYKQPLVLPCTHNVCQACAREVLGQQGYIGHGGDPSSEPTSPASTPSTRSPRLSRRTLPKPDRLDRLLKSGFGTYPGRKRGALHPQVIMFPCPACQGDVELGERGLAGLFRNLTLERVVERYRQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEAVRHTEVSGQQAKEEVSQLVRGLGAVLEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRVPEAPVIDTQRTFAYDQIFLCWRLPPHSPPAWHYTVEFRRTDVPAQPGPTRWQRREEVRGTSALLENPDTGSVYVLRVRGCNKAGYGEYSEDVHLHTPPAPVLHFFLDSRWGASRERLAISKDQRAVRSVPGLPLLLAADRLLTGCHLSVDVVLGDVAVTQGRSYWACAVDPASYLVKVGVGLESKLQESFQGAPDVISPRYDPDSGHDSGAEDATVEASPPFAFLTIGMGKILLGSGASSNAGLTGRDGPTAGCTVPLPPRLGICLDYERGRVSFLDAVSFRGLLECPLDCSGPVCPAFCFIGGGAVQLQEPVGTKPERKVTIGGFAKLD

SEQ ID NO: 92615 - protein, 736 aa, Homo sapiens
  Payload ID: 18507
  Gene Name: tripartite motif containing 46
  Uniprot ID: Q7Z4K8
  ENSP ID: ENSP00000357366
MKNMEKELLCPVCQEMYKQPLVLPCTHNVCQACAREVLGQQGYIGHGGDPSSEPTSPASTPSTRSPRLSRRTLPKPDRLDRLLKSGFGTYPGRKRGALHPQVIMFPCPACQGDVELGERGLAGLFRNLTLERVVERYRQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEAVRHTEVSGQQAKEEVSQLVRGLGAVLEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRVPEAPVIDTQRTFAYDQIFLCWRLPPHSPPAWHYTVEFRRTDVPAQPGPTRWQRREEVRGTSALLENPDTGSVYVLRVRGCNKAGYGEYSEDVHLHTPPAPVLHFFLDSRWGASRERLAISKDQRAVRSVPGLPLLLAADRLLTGCHLSVDVVLGDVAVTQGRSYWACAVDPASYLVKVGVGLESKLQESFQGAPDVISPRYDPDSGHDSGAEDATVEASPPFAFLTIGMGKILLGSGASSNAGLTGRDGPTAGCTVPLPPRLGICLDYERGRVSFLDAVSFRGLLECPLDCSGPVCPAFCFIGGGAVQLQEPVGTKPERKVTIGGFAKLD

SEQ ID NO: 92616 - protein, 644 aa, Homo sapiens
  Payload ID: 18507
  Gene Name: tripartite motif containing 46
  ENSP ID: ENSP00000357367
MAEGEDMQTFTSIMDALVRISTSMKNMEKELLCPVCQEMYKQPLVLPCTHNVCQACAREVLGQQGYIGHGGDPSSEPTSPASTPSTRSPRLSRRTLPKPDRLDRLLKSGFGTYPGRKRGALHPQVIMFPCPACQGDVELGERGLAGLFRNLTLERVVERYRQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEAVRHTEVSGQQAKEEVSQLVRGLGAVLEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRVPEAPVIDTQRTFAYDQIFLCWRLPPHSPPAWHYTVEFRRTDVPAQPGPTRWQRREEVRGTSALLENPDTGSVYVLRVRGCNKAGYGEYSEDVHLHTPPAPVLHFFLDSRWGASRERLAISKDQRAVRSVPGLPLLLAADRLLTGCHLSVDVVLGDVAVTQGRSYWACAVDPASYLVKVGVGLESKLQESFQGAPDVISPRSDPSGRDGVWGSWWE

SEQ ID NO: 92617 - protein, 551 aa, Homo sapiens
  Payload ID: 18507
  Gene Name: tripartite motif containing 46
  Uniprot ID: Q7Z4K8
  ENSP ID: ENSP00000357369
MAEGEDMQTFTSIMDALVRISTSMKNMEKELLCPVCQEMYKQPLVLPCTHNVCQACAREVLGQQGYIGHGGDPSSEPTSPASTPSTRSPRLSRRTLPKPDRLDRLLKSGFGTYPGRKRGALHPQVIMFPCPACQGDVELGERGLAGLFRNLTLERVVERYRQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEAVRHTEVSGQQAKEEVSQLVRGLGAVLEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRVPEAPVIDTQRTFAYDQIFLCWRLPPHSPPAWHYTVEFRRTDVPAQPGPTRWQRREEVRGTSALLENPDTGSVYVLRVRGCNKAGYGEYSEDVHLHTPPAPGIQNLARRGGACLQFQLLGRLR

SEQ ID NO: 92618 - protein, 717 aa, Homo sapiens
  Payload ID: 18507
  Gene Name: tripartite motif containing 46
  ENSP ID: ENSP00000376245
MAAKRGTKTSMKNMEKELLCPVCQEMYKQPLVLPCTHNVCQACAREVLGQQGYIGHGGDPSSEPTSPASTPSTRSPRLSRRTLPKPDRLDRLLKSGFGTYPGRKRGALHPQVIMFPCPACQGDVELGERGLAGLFRNLTLERVVERYRQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRVPEAPVIDTQRTFAYDQIFLCWRLPPHSPPAWHYTVEFRRTDVPAQPGPTRWQRREEVRGTSALLENPDTGSVYVLRVRGCNKAGYGEYSEDVHLHTPPAPVLHFFLDSRWGASRERLAISKDQRAVRSVPGLPLLLAADRLLTGCHLSVDVVLGDVAVTQGRSYWACAVDPASYLVKVGVGLESKLQESFQGAPDVISPRYDPDSGHDSGAEDATVEASPPFAFLTIGMGKILLGSGASSNAGLTGRDGPTAGCTVPLPPRLGICLDYERGRVSFLDAVSFRGLLECPLDCSGPVCPAFCFIGGGAVQLQEPVGTKPERKVTIGGFAKLD

SEQ ID NO: 92619 - protein, 633 aa, Homo sapiens
  Payload ID: 18507
  Gene Name: tripartite motif containing 46
  ENSP ID: ENSP00000440254
MFPCPACQGDVELGERGLAGLFRNLTLERVVERYRQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEAVRHTEVSGQQAKEEVSQLVRGLGAVLEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRVPEAPVIDTQRTFAYDQIFLCWRLPPHSPPAWHYTVEFRRTDVPAQPGPTRWQRREEVRGTSALLENPDTGSVYVLRVRGCNKAGYGEYSEDVHLHTPPAPVLHFFLDSRWGASRERLAISKDQRAVRSVPGLPLLLAADRLLTGCHLSVDVVLGDVAVTQGRSYWACAVDPASYLVKVGVGLESKLQESFQGAPDVISPRYDPDSGHDSGAEDATVEASPPFAFLTIGMGKILLGSGASSNAGLTGRDGPTAGCTVPLPPRLGICLDYERGRVSFLDAVSFRGLLECPLDCSGPVCPAFCFIGGGAVQLQEPVGTKPERKVTIGGFAKLD

SEQ ID NO: 92620 - protein, 498 aa, Homo sapiens
  Payload ID: 18507
  Gene Name: tripartite motif containing 46
  Uniprot ID: Q7Z4K8
  ENSP ID: ENSP00000442719
MAEGEDMQTFTSIMDALVRISTSMKNMEKELLCPVCQEMYKQPLVLPCTHNVCQACAREVLGQQGYIGHGGDPSSEPTSPASTPSTRSPRLSRRTLPKPDRLDRLLKSGFGTYPGRKRGALHPQVIMFPCPACQGDVELGERGLAGLFRNLTLERVVERYRQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEAVRHTEVSGQQAKEEVSQLVRGLGAVLEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRGCGHRGLCSGAPQCLRPPSLTPSAPLPMIRSSCAGGCPPIHHLPGTIPLSSGARMCLLSQAPPAGSGGRR

SEQ ID NO: 92621 - protein, 746 aa, Homo sapiens
  Payload ID: 18507
  Gene Name: tripartite motif containing 46
  ENSP ID: ENSP00000478669
MGAKGNGLTSMKNMEKELLCPVCQEMYKQPLVLPCTHNVCQACAREVLGQQGYIGHGGDPSSEPTSPASTPSTRSPRLSRRTLPKPDRLDRLLKSGFGTYPGRKRGALHPQVIMFPCPACQGDVELGERGLAGLFRNLTLERVVERYRQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEAVRHTEVSGQQAKEEVSQLVRGLGAVLEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRVPEAPVIDTQRTFAYDQIFLCWRLPPHSPPAWHYTVEFRRTDVPAQPGPTRWQRREEVRGTSALLENPDTGSVYVLRVRGCNKAGYGEYSEDVHLHTPPAPVLHFFLDSRWGASRERLAISKDQRAVRSVPGLPLLLAADRLLTGCHLSVDVVLGDVAVTQGRSYWACAVDPASYLVKVGVGLESKLQESFQGAPDVISPRYDPDSGHDSGAEDATVEASPPFAFLTIGMGKILLGSGASSNAGLTGRDGPTAGCTVPLPPRLGICLDYERGRVSFLDAVSFRGLLECPLDCSGPVCPAFCFIGGGAVQLQEPVGTKPERKVTIGGFAKLD

SEQ ID NO: 92622 - protein, 638 aa, Homo sapiens
  Payload ID: 18508
  Gene Name: tripartite motif containing 47
  Uniprot ID: Q96LD4
  ENSP ID: ENSP00000254816
MDGSGPFSCPICLEPLREPVTLPCGHNFCLACLGALWPHRGASGAGGPGGAARCPLCQEPFPDGLQLRKNHTLSELLQLRQGSGPGSGPGPAPALAPEPSAPSALPSVPEPSAPCAPEPWPAGEEPVRCDACPEGAALPAALSCLSCLASFCPAHLGPHERSPALRGHRLVPPLRRLEESLCPRHLRPLERYCRAERVCLCEACAAQEHRGHELVPLEQERALQEAEQSKVLSAVEDRMDELGAGIAQSRRTVALIKSAAVAERERVSRLFADAAAALQGFQTQVLGFIEEGEAAMLGRSQGDLRRQEEQRSRLSRARQNLSQVPEADSVSFLQELLALRLALEDGCGPGPGPPRELSFTKSSQAVRAVRDMLAVACVNQWEQLRGPGGNEDGPQKLDSEADAEPQDLESTNLLESEAPRDYFLKFAYIVDLDSDTADKFLQLFGTKGVKRVLCPINYPLSPTRFTHCEQVLGEGALDRGTYYWEVEIIEGWVSMGVMAEDFSPQEPYDRGRLGRNAHSCCLQWNGRSFSVWFHGLEAPLPHPFSPTVGVCLEYADRALAFYAVRDGKMSLLRRLKASRPRRGGIPASPIDPFQSRLDSHFAGLFTHRLKPAFFLESVDAHLQIGPLKKSCISVLKRR

SEQ ID NO: 92623 - protein, 122 aa, Homo sapiens
  Payload ID: 18508
  Gene Name: tripartite motif containing 47
  ENSP ID: ENSP00000465010
  MOD_RES (1)..(1): Any amino acid
XPWPAGEEPVRCDACPEGAALPAALSCLSCLASFCPAHLGPHERSPALRGHRLVPPLRRLEESLCPRHLRPLERYCRAERVCLCEACAAQEHRGHELVPLEQERALQEVGSGGTLGLSSPKS

SEQ ID NO: 92624 - protein, 38 aa, Homo sapiens
  Payload ID: 18508
  Gene Name: tripartite motif containing 47
  ENSP ID: ENSP00000465038
MDELGAGIAQSRRTVALIKSAAVAERERVSRLFADAAA

SEQ ID NO: 92625 - protein, 183 aa, Homo sapiens
  Payload ID: 18508
  Gene Name: tripartite motif containing 47
  ENSP ID: ENSP00000467645
  MOD_RES (1)..(1): Any amino acid
XPQEPYDRGRLGRNAHSCCLQWNGRSFSVWFHGLEAPLPHPFSPTVGVCLEYADRALAFYATQACLLPGECGRPLADRAPQEVLHIRAEEEVMPGTGAPAAVSAPGSCLLWALSFVWEGTSMSPTHPAFSFLEASTFLYTQPSLSQAGGPPDPVPLQTSLLGDRATAGTAPSYPNPSFPRFLE

SEQ ID NO: 92626 - protein, 224 aa, Homo sapiens
  Payload ID: 18509
  Gene Name: tripartite motif containing 48
  Uniprot ID: Q8IWZ4
  ENSP ID: ENSP00000402414
MSRRIIVGTLQRTQRNMNSGISQVFQRELTCPICMNYFIDPVTIDCGHSFCRPCFYLNWQDIPILTQCFECIKTIQQRNLKTNIRLKKMASLARKASLWLFLSSEEQMCGIHRETKKMFCEVDRSLLCLLCSSSQEHRYHRHCPAEWAAEEHWEKLLKKMQSLWEKACENQRNLNVETTRISHWKAFGDILYRSESVLLHMPQPLNLALRAGPITGLRDRLNQF

SEQ ID NO: 92627 - protein, 452 aa, Homo sapiens
  Payload ID: 18510
  Gene Name: tripartite motif containing 49
  Uniprot ID: P0CI25
  ENSP ID: ENSP00000327604
MNSGILQVFQGELICPLCMNYFIDPVTIDCGHSFCRPCFYLNWQDIPFLVQCSECTKSTEQINLKTNIHLKKMASLARKVSLWLFLSSEEQMCGTHRETKKIFCEVDRSLLCLLCSSSQEHRYHRHRPIEWAAEEHREKLLQKMQSLWEKACENHRNLNVETTRTRCWKDYVNLRLEAIRAEYQKMPAFHHEEEKHNLEMLKKKGKEIFHRLHLSKAKMAHRMEILRGMYEELNEMCHKPDVELLQAFGDILHRSESVLLHMPQPLNPELSAGPITGLRDRLNQFRVHITLHHEEANNDIFLYEILRSMCIGCDHQDVPYFTATPRSFLAWGVQTFTSGKYYWEVHVGDSWNWAFGVCNMYRKEKNQNEKIDGKAGLFLLGCVKNDIQCSLFTTSPLMLQYIPKPTSRVGLFLDCEAKTVSFVDVNQSSLIYTIPNCSFSPPLRPIFCCIHF

SEQ ID NO: 92628 - protein, 375 aa, Homo sapiens
  Payload ID: 18510
  Gene Name: tripartite motif containing 49
  ENSP ID: ENSP00000431618
MNSGILQVFQGELICPLCMNYFIDPVTIDCGHSFCRPCFYLNWQDIPFLVQCSECTKSTEQINLKTNIHLKKMASLARKVSLWLFLSSEEQMCGTHRETKKIFCEVDRSLLCLLCSSSQEHRYHRHRPIEWAAEEHREKLLQKMQSLWEKACENHRNLNVETTRTRCWKAFGDILHRSESVLLHMPQPLNPELSAGPITGLRDRLNQFRVHITLHHEEANNDIFLYEILRSMCIGCDHQDVPYFTATPRSFLAWGVQTFTSGKYYWEVHVGDSWNWAFGVCNMYRKEKNQNEKIDGKAGLFLLGCVKNDIQCSLFTTSPLMLQYIPKPTSRVGLFLDCEAKTVSFVDVNQSSLIYTIPNCSFSPPLRPIFCCIHF

SEQ ID NO: 92629 - protein, 452 aa, Homo sapiens
  Payload ID: 18511
  Gene Name: tripartite motif containing 49B
  Uniprot ID: A6NDI0
  ENSP ID: ENSP00000330216
MNSGILQVFQRELICPICMNYFIDPVTIDCGHSFCRPCFYLNWKDSPFLVQCSECTKSTGQINLKTNIHFKKMASLARKVSLWLFLSSEEQMCGTHRETKKMFCEVDRSLLCLLCSSSQEHRDHRHCPIESAAEEHQEKLLQKMQSLWEKACENHRNLNVETTRTRCWKDYVNLRLEAIRAEYQKMPAFHHEEEKHNLEMLKKKGKDIFHRLHLSKAKMAHRREILRGMYEELNEMCHKPDVELLQAFGDILHRSESVLLHMPQPLNPELSAGPITGLRDRLNQFRVHITLHHEEANSDIFLCEILRSMCIGCDHQDVPYFTATPRSFLAWGAQTFTSGKYYWEVHVGDSWNWAFGVCNMYWKEKNQNEKIDGEDGLFLLGCVKNDIQRSLFTTSPLLLQYIPRPTSRVGLFLDCEAKTVSFVDVNQSSLIYTIPNCSFSPPLRPIFCCIHF

SEQ ID NO: 92630 - protein, 452 aa, Homo sapiens; identical to SEQ ID NO: 92629
  Payload ID: 18511
  Gene Name: tripartite motif containing 49B
  Uniprot ID: A6NDI0
  ENSP ID: ENSP00000481457

SEQ ID NO: 92631 - protein, 452 aa, Homo sapiens
  Payload ID: 18512
  Gene Name: tripartite motif containing 49C
  Uniprot ID: P0CI26
  ENSP ID: ENSP00000388299
MNSGILQVFQGELICPLCMNYFIDPVTIDCGHSFCRPCFYLNWQDIPFLVQCSECTKSTEQINLKTNIHLKKMASLARKVSLWLFLSSEEQMCGTHRETKKIFCEVDRSLLCLLCSSSQEHRYHRHRPIEWAAEEHREKLLQKMQSLWEKACENHRNLNVETTRTRCWKDYVNLRLEAIRAEYQKMPAFHHEEEKHNLEMLKKKGKEIFHRLHLSKAKMAHRMEILRGMYEELNEMCHKPDVELLQAFGDILHRSESVLLHMPQPLNPELSAGPITGLRDRLNQFRVHITLHHEEANSDIFLYEILRSMCIGCDHQDVPYFTATPRSFLAWGVQTFTSGKYYWEVHVGDSWNWAFGVCNMYRKEKNQNEKIDGKEGLFLLGCIKNDIQCSLFTTSPLMLQYIPKPTSRVGLFLDCEAKTVSFVDVNQSSLIYTIPNCSFSPPLRPIFCCIHF

SEQ ID NO: 92632 - protein, 452 aa, Homo sapiens
  Payload ID: 18513
  Gene Name: tripartite motif containing 49D1
  Uniprot ID: C9J1S8
  ENSP ID: ENSP00000474678
MNSGISQVFQRELTCPICLNYFIDPVTIDCGHSFCRPCFYLNWQDIPILTQCFECLKTTQQRNLKTNIRLKKMASRARKASLWLFLSSEEQMCGTHRETKKIFCEVDRSLLCLLCSSSLEHRYHRHCPAEWAAEEHREKLLKKMQSLWEKVCENQRNLNVETTRISHWKDYVNVRLEAIRAEYQKMPAFHHEEEKHNLEMLKKKGKDIFHRLHLSKAKMAHRREILRGTYAELMKMCHKPDVELLQAFGDILHRSESVLLHMPQPLNLELRAGPITGLRDRLNQFRVDITLPHNEANSHIFRRGDLRSICIGCDRQNAPHITATPTSFLAWGAQTFTSGKYYWEVHVGDSWNWAFGVCNKYWKGTNQNGNIHGEEGLFSLGCVKNDIQCSLFTTSPLTLQYVPRPTNHVGLFLDCEARTVSFVDVNQSSPIHTIPNCSFSPPLRPIFCCVHL

SEQ ID NO: 92633 - protein, 452 aa, Homo sapiens; identical to SEQ ID NO: 92632
  Payload ID: 18513
  Gene Name: tripartite motif containing 49D1
  Uniprot ID: C9J1S8
  ENSP ID: ENSP00000474850

SEQ ID NO: 92634 - protein, 375 aa, Homo sapiens
  Payload ID: 18513
  Gene Name: tripartite motif containing 49D1
  ENSP ID: ENSP00000479562
MNSGISQVFQRELTCPICLNYFIDPVTIDCGHSFCRPCFYLNWQDIPILTQCFECLKTTQQRNLKTNIRLKKMASRARKASLWLFLSSEEQMCGTHRETKKIFCEVDRSLLCLLCSSSLEHRYHRHCPAEWAAEEHREKLLKKMQSLWEKVCENQRNLNVETTRISHWKAFGDILHRSESVLLHMPQPLNLELRAGPITGLRDRLNQFRVDITLPHNEANSHIFRRGDLRSICIGCDRQNAPHITATPTSFLAWGAQTFTSGKYYWEVHVGDSWNWAFGVCNKYWKGTNQNGNIHGEEGLFSLGCVKNDIQCSLFTTSPLTLQYVPRPTNHVGLFLDCEARTVSFVDVNQSSPIHTIPNCSFSPPLRPIFCCVHL

SEQ ID NO: 92635 - protein, 452 aa, Homo sapiens; identical to SEQ ID NO: 92632
  Payload ID: 18514
  Gene Name: tripartite motif containing 49D2
  Uniprot ID: C9J1S8
  ENSP ID: ENSP00000485097

SEQ ID NO: 92636 - protein, 452 aa, Homo sapiens; identical to SEQ ID NO: 92632
  Payload ID: 18514
  Gene Name: tripartite motif containing 49D2
  Uniprot ID: C9J1S8
  ENSP ID: ENSP00000485325

SEQ ID NO: 92637 - protein, 326 aa, Homo sapiens
  Payload ID: 18515
  Gene Name: tripartite motif containing 5
  Uniprot ID: Q9C035
  ENSP ID: ENSP00000369366
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQGVDGVIKRTENVTLKKPETFPKNQRRVFRAPDLKGMLEVFRELTDVRRYWGWSAMARSRFTATSTSQIQAILLPQPPK

SEQ ID NO: 92638 - protein, 493 aa, Homo sapiens
  Payload ID: 18515
  Gene Name: tripartite motif containing 5
  Uniprot ID: Q9C035
  ENSP ID: ENSP00000369373
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQGVDGVIKRTENVTLKKPETFPKNQRRVFRAPDLKGMLEVFRELTDVRRYWVDVTVAPNNISCAVISEDKRQVSSPKPQIIYGARGTRYQTFVNFNYCTGILGSQSITSGKHYWEVDVSKKTAWILGVCAGFQPDAMCNIEKNENYQPKYGYWVIGLEEGVKCSAFQDSSFHTPSVPFIVPLSVIICPDRVGVFLDYEACTVSFFNITNHGFLIYKFSHCSFSQPVFPYLNPRKCGVPMTLCSPSS

SEQ ID NO: 92639 - protein, 347 aa, Homo sapiens
  Payload ID: 18515
  Gene Name: tripartite motif containing 5
  Uniprot ID: Q9C035
  ENSP ID: ENSP00000380058
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQGVDGVIKRTENVTLKKPETFPKNQRRVFRAPDLKGMLEVFRELTDVRRYWGKEKSHYHKPPCGLSLLLSLSFRILCSLLGSCFKIYDSPSKTHITYPSL

SEQ ID NO: 92640 - protein, 209 aa, Homo sapiens
  Payload ID: 18515
  Gene Name: tripartite motif containing 5
  ENSP ID: ENSP00000388031
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEED

SEQ ID NO: 92641 - protein, 72 aa, Homo sapiens
  Payload ID: 18515
  Gene Name: tripartite motif containing 5
  ENSP ID: ENSP00000388150
MASGILVNVKEEVTCPICLELLTQPLSLDCGHSFCQACLTANHKKSMLDKGESSCPVCRISYQPENIRPNRH

SEQ ID NO: 92642 - protein, 271 aa, Homo sapiens
  Payload ID: 18515
  Gene Name: tripartite motif containing 5
  Uniprot ID: Q9C035
  ENSP ID: ENSP00000393052
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQDGERDLEEARNFSKKSKESVSSS

SEQ ID NO: 92643 - protein, 187 aa, Homo sapiens
  Payload ID: 18515
  Gene Name: tripartite motif containing 5
  ENSP ID: ENSP00000398196
  MOD_RES (1)..(1): Any amino acid
XGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQGVDGVIKRADRCPTLLGLECNGTISVHCNLHLSDSSNSPASASQVAGITGAHHHPWLNLYFQ

SEQ ID NO: 92644 - protein, 487 aa, Homo sapiens
  Payload ID: 18516
  Gene Name: tripartite motif containing 50
  Uniprot ID: Q86XT4
  ENSP ID: ENSP00000327994
MAWQVSLPELEDRLQCPICLEVFKEPLMLQCGHSYCKGCLVSLSCHLDAELRCPVCRQAVDGSSSLPNVSLARVIEALRLPGDPEPKVCVHHRNPLSLFCEKDQELICGLCGLLGSHQHHPVTPVSTVYSRMKEELAALISELKQEQKKVDELIAKLVNNRTRIVNESDVFSWVIRREFQELHHLVDEEKARCLEGIGGHTRGLVASLDMQLEQAQGTRERLAQAECVLEQFGNEDHHKFIRKFHSMASRAEMPQARPLEGAFSPISFKPGLHQADIKLTVWKRLFRKVLPAPEPLKLDPATAHPLLELSKGNTVVQCGLLAQRRASQPERFDYSTCVLASRGFSCGRHYWEVVVGSKSDWRLGVIKGTASRKGKLNRSPEHGVWLIGLKEGRVYEAFACPRVPLPVAGHPHRIGLYLHYEQGELTFFDADRPDDLRPLYTFQADFQGKLYPILDTCWHERGSNSLPMVLPPPSGPGPLSPEQPTKL

SEQ ID NO: 92645 - protein, 487 aa, Homo sapiens; identical to SEQ ID NO: 92644
  Payload ID: 18516
  Gene Name: tripartite motif containing 50
  Uniprot ID: Q86XT4
  ENSP ID: ENSP00000413875

SEQ ID NO: 92646 - protein, 297 aa, Homo sapiens
  Payload ID: 18517
  Gene Name: tripartite motif containing 52
  Uniprot ID: Q96A61
  ENSP ID: ENSP00000483005
MAGYATTPSPMQTLQEEAVCAICLDYFKDPVSISCGHNFCRGCVTQLWSKEDEEDQNEEEDEWEEEEDEEAVGAMDGWDGSIREVLYRGNADEELFQDQDDDELWLGDSGITNWDNVDYMWDEEEEEEEEDQDYYLGGLRPDLRIDVYREEEILEAYDEDEDEELYPDIHPPPSLPLPGQFTCPQCRKSFTRRSFRPNLQLANMVQIIRQMCPTPYRGNRSNDQGMCFKHQEALKLFCEVDKEAICVVCRESRSHKQHSVLPLEEVVQEYQEIKLETTLVGILQIEQESIHSKAYNQ

SEQ ID NO: 92647 - protein, 400 aa, Homo sapiens
  Payload ID: 18518
  Gene Name: tripartite motif containing 54
  Uniprot ID: Q9BYV2
  ENSP ID: ENSP00000296098
MNFTVGFKPLLGDAHSMDNLEKQLICPICLEMFSKPVVILPCQHNLCRKCANDVFQASNPLWQSRGSTTVSSGGRFRCPSCRHEVVLDRHGVYGLQRNLLVENIIDIYKQESSRPLHSKAEQHLMCEEHEEEKINIYCLSCEVPTCSLCKVFGAHKDCEVAPLPTIYKRQKKQDLTLLPRLECSGTNTTYCSLDLPSSSDPPILASQNTKIIDSELSDGIAMLVAGNDRVQAVITQMEEVCQTIEDNSRRQKQLLNQRFESLCAVLEERKGELLQALAREQEEKLQRVRGLIRQYGDHLEASSKLVESAIQSMEEPQMALYLQQAKELINKVGAMSKVELAGRPEPGYESMEQFTVRVEHVAEMLRTIDFQPGASGEEEEVAPDGEEGSAGPEEERPDGP

SEQ ID NO: 92648 - protein, 358 aa, Homo sapiens
  Payload ID: 18518
  Gene Name: tripartite motif containing 54
  Uniprot ID: Q9BYV2
  ENSP ID: ENSP00000369415
MNFTVGFKPLLGDAHSMDNLEKQLICPICLEMFSKPVVILPCQHNLCRKCANDVFQASNPLWQSRGSTTVSSGGRFRCPSCRHEVVLDRHGVYGLQRNLLVENIIDIYKQESSRPLHSKAEQHLMCEEHEEEKINIYCLSCEVPTCSLCKVFGAHKDCEVAPLPTIYKRQKSELSDGIAMLVAGNDRVQAVITQMEEVCQTIEDNSRRQKQLLNQRFESLCAVLEERKGELLQALAREQEEKLQRVRGLIRQYGDHLEASSKLVESAIQSMEEPQMALYLQQAKELINKVGAMSKVELAGRPEPGYESMEQFTVRVEHVAEMLRTIDFQPGASGEEEEVAPDGEEGSAGPEEERPDGP

SEQ ID NO: 92649 - protein, 540 aa, Homo sapiens
  Payload ID: 18519
  Gene Name: tripartite motif containing 55
  Uniprot ID: Q9BYV6
  ENSP ID: ENSP00000276573
MSASLNYKSFSKEQQTMDNLEKQLICPICLEMFTKPVVILPCQHNLCRKCASDIFQASNPYLPTRGGTTMASGGRFRCPSCRHEVVLDRHGVYGLQRNLLVENIIDIYKQESTRPEKKSDQPMCEEHEEERINIYCLNCEVPTCSLCKVFGAHKDCQVAPLTHVFQRQKSELSDGIAILVGSNDRVQGVISQLEDTCKTIEECCRKQKQELCEKFDYLYGILEERKNEMTQVITRTQEEKLEHVRALIKKYSDHLENVSKLVESGIQFMDEPEMAVFLQNAKTLLKKISEASKAFQMEKIEHGYENMNHFTVNLNREEKIIREIDFYREDEDEEEEEGGEGEKEGEGEVGGEAVEVEEVENVQTEFPGEDENPEKASELSQVELQAAPGALPVSSPEPPPALPPAADAPVTQGEVVPTGSEQTTESETPVPAAAETADPLFYPSWYKGQTRKATTNPPCTPGSEGLGQIGPPGSEDSNVRKAEVAAAAASERAAVSGKETSAPAATSQELVICLALLAFLILHYIWSQIQCLIFTLMDWI

SEQ ID NO: 92650 - protein, 452 aa, Homo sapiens
  Payload ID: 18519
  Gene Name: tripartite motif containing 55
  Uniprot ID: Q9BYV6
  ENSP ID: ENSP00000297348
MSASLNYKSFSKEQQTMDNLEKQLICPICLEMFTKPVVILPCQHNLCRKCASDIFQASNPYLPTRGGTTMASGGRFRCPSCRHEVVLDRHGVYGLQRNLLVENIIDIYKQESTRPEKKSDQPMCEEHEEERINIYCLNCEVPTCSLCKVFGAHKDCQVAPLTHVFQRQKSELSDGIAILVGSNDRVQGVISQLEDTCKTIEECCRKQKQELCEKFDYLYGILEERKNEMTQVITRTQEEKLEHVRALIKKYSDHLENVSKLVESGIQFMDEPEMAVFLQNAKTLLKKISEASKAFQMEKIEHGYENMNHFTVNLNREEKIIREIDFYREDEDEEEEEGGEGEKEGEGEVGGEAVEVEEVENVQTEFPGEDENPEKASELSQVELQAAPGALPVSSPEPPPALPPAADAPVTQIGFEAPPLQGQAAAPASGSGADSEPARHIFSFSWLNSLNE

SEQ ID NO: 92651 - protein, 548 aa, Homo sapiens
  Payload ID: 18519
  Gene Name: tripartite motif containing 55
  Uniprot ID: Q9BYV6
  ENSP ID: ENSP00000323913
MSASLNYKSFSKEQQTMDNLEKQLICPICLEMFTKPVVILPCQHNLCRKCASDIFQASNPYLPTRGGTTMASGGRFRCPSCRHEVVLDRHGVYGLQRNLLVENIIDIYKQESTRPEKKSDQPMCEEHEEERINIYCLNCEVPTCSLCKVFGAHKDCQVAPLTHVFQRQKSELSDGIAILVGSNDRVQGVISQLEDTCKTIEECCRKQKQELCEKFDYLYGILEERKNEMTQVITRTQEEKLEHVRALIKKYSDHLENVSKLVESGIQFMDEPEMAVFLQNAKTLLKKISEASKAFQMEKIEHGYENMNHFTVNLNREEKIIREIDFYREDEDEEEEEGGEGEKEGEGEVGGEAVEVEEVENVQTEFPGEDENPEKASELSQVELQAAPGALPVSSPEPPPALPPAADAPVTQGEVVPTGSEQTTESETPVPAAAETADPLFYPSWYKGQTRKATTNPPCTPGSEGLGQIGPPGSEDSNVRKAEVAAAAASERAAVSGKETSAPAATSQIGFEAPPLQGQAAAPASGSGADSEPARHIFSFSWLNSLNE

SEQ ID NO: 92652 - protein, 241 aa, Homo sapiens
  Payload ID: 18519
  Gene Name: tripartite motif containing 55
  Uniprot ID: Q9BYV6
  ENSP ID: ENSP00000332302
MSASLNYKSFSKEQQTMDNLEKQLICPICLEMFTKPVVILPCQHNLCRKCASDIFQASNPYLPTRGGTTMASGGRFRCPSCRHEVVLDRHGVYGLQRNLLVENIIDIYKQESTRPEKKSDQPMCEEHEEERINIYCLNCEVPTCSLCKVFGAHKDCQVAPLTHVFQRQKSELSDGIAILVGSNDRVQGVISQLEDTCKTIEIGFEAPPLQGQAAAPASGSGADSEPARHIFSFSWLNSLNE

SEQ ID NO: 92653 - protein, 755 aa, Homo sapiens
  Payload ID: 18520
  Gene Name: tripartite motif containing 56
  Uniprot ID: Q9BRZ2
  ENSP ID: ENSP00000305161
MVSHGSSPSLLEALSSDFLACKICLEQLRAPKTLPCLHTYCQDCLAQLADGGRVRCPECRETVPVPPEGVASFKTNFFVNGLLDLVKARACGDLRAGKPACALCPLVGGTSTGGPATARCLDCADDLCQACADGHRCTRQTHTHRVVDLVGYRAGWYDEEARERQAAQCPQHPGEALRFLCQPCSQLLCRECRLDPHLDHPCLPLAEAVRARRPGLEGLLAGVDNNLVELEAARRVEKEALARLREQAARVGTQVEEAAEGVLRALLAQKQEVLGQLRAHVEAAEEAARERLAELEGREQVARAAAAFARRVLSLGREAEILSLEGAIAQRLRQLQGCPWAPGPAPCLLPQLELHPGLLDKNCHLLRLSFEEQQPQKDGGKDGAGTQGGEESQSRREDEPKTERQGGVQPQAGDGAQTPKEEKAQTTREEGAQTLEEDRAQTPHEDGGPQPHRGGRPNKKKKFKGRLKSISREPSPALGPNLDGSGLLPRPIFYCSFPTRMPGDKRSPRITGLCPFGPREILVADEQNRALKRFSLNGDYKGTVPVPEGCSPCSVAALQSAVAFSASARLYLINPNGEVQWRRALSLSQASHAVAALPSGDRVAVSVAGHVEVYNMEGSLATRFIPGGKASRGLRALVFLTTSPQGHFVGSDWQQNSVVICDGLGQVVGEYKGPGLHGCQPGSVSVDKKGYIFLTLREVNKVVILDPKGSLLGDFLTAYHGLEKPRVTTMVDGRYLVVSLSNGTIHIFRVRSPDS

SEQ ID NO: 92654 - protein, 305 aa, Homo sapiens
  Payload ID: 18520
  Gene Name: tripartite motif containing 56
  ENSP ID: ENSP00000404186
MVSHGSSPSLLEALSSDFLACKICLEQLRAPKTLPCLHTYCQDCLAQLADGGRVRCPECRETVPVPPEGVASFKTNFFVNGLLDLVKARACGDLRAGKPACALCPLVGGTSTGGPATARCLDCADDLCQACADGHRCTRQTHTHRVVDLVGYRAGWYDEEARERQAAQCPQHPGEALRFLCQPCSQLLCRECRLDPHLDHPCLPLAEAVRARRPGLEGLLAGVDNNLVELEAARRVEKEALARLREQAARVGTQVEEAAEGVLRALLAQKQENHLNPGGGSCSELRSHHCTPAWVTRMKLHLKKK

SEQ ID NO: 92655 - protein, 65 aa, Homo sapiens
  Payload ID: 18520
  Gene Name: tripartite motif containing 56
  ENSP ID: ENSP00000486217
MVSHGSSPSLLEALSSDFLACKICLEQLRAPKTLPCLHTYCQDCLAQLADGGRVRCPECRETVPV

SEQ ID NO: 92656 - protein, 486 aa, Homo sapiens
  Payload ID: 18521
  Gene Name: tripartite motif containing 58
  Uniprot ID: Q8NG06
  ENSP ID: ENSP00000355437
MAWAPPGERLREDARCPVCLDFLQEPVSVDCGHSFCLRCISEFCEKSDGAQGGVYACPQCRGPFRPSGFRPNRQLAGLVESVRRLGLGAGPGARRCARHGEDLSRFCEEDEAALCWVCDAGPEHRTHRTAPLQEAAGSYQVKLQMALELMRKELEDALTQEANVGKKTVIWKEKVEMQRQRFRLEFEKHRGFLAQEEQRQLRRLEAEERATLQRLRESKSRLVQQSKALKELADELQERCQRPALGLLEGVRGVLSRSKAVTRLEAENIPMELKTACCIPGRRELLRKFQVDVKLDPATAHPSLLLTADLRSVQDGEPWRDVPNNPERFDTWPCILGLQSFSSGRHYWEVLVGEGAEWGLGVCQDTLPRKGETTPSPENGVWALWLLKGNEYMVLASPSVPLLQLESPRCIGIFLDYEAGEISFYNVTDGSYIYTFNQLFSGLLRPYFFICDATPLILPPTTIAGSGNWASRDHLDPASDVRDDHL

SEQ ID NO: 92657 - protein, 403 aa, Homo sapiens
  Payload ID: 18522
  Gene Name: tripartite motif containing 59
  Uniprot ID: Q8IWR1
  ENSP ID: ENSP00000311219
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQLTDTHWTDLTHLIEKLKEQKSHSEKMIQGDKEAVLQYFKELNDTLEQKKKSFLTALCDVGNLINQEYTPQIERMKEIREQQLELMALTISLQEESPLKFLEKVDDVRQHVQILKQRPLPEVQPVEIYPRVSKILKEEWSRTEIGQIKNVLIPKMKISPKRMSCSWPGKDEKEVEFLKILNIVVVTLISVILMSILFFNQHIITFLSEITLIWFSEASLSVYQSLSNSLHKVKNILCHIFYLLKEFVWKIVSH

SEQ ID NO: 92658 - protein, 177 aa, Homo sapiens
  Payload ID: 18522
  Gene Name: tripartite motif containing 59
  ENSP ID: ENSP00000417081
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQLTDTHWTDLTHLIEKLKEQKSHSEKM

SEQ ID NO: 92659 - protein, 111 aa, Homo sapiens
  Payload ID: 18522
  Gene Name: tripartite motif containing 59
  ENSP ID: ENSP00000417605
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLL

SEQ ID NO: 92660 - protein, 114 aa, Homo sapiens
  Payload ID: 18522
  Gene Name: tripartite motif containing 59
  ENSP ID: ENSP00000418699
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKK

SEQ ID NO: 92661 - protein, 179 aa, Homo sapiens
  Payload ID: 18522
  Gene Name: tripartite motif containing 59
  ENSP ID: ENSP00000418856
MRRRIRIKDSGGVGEECIQPPNHEINKEMHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQ

SEQ ID NO: 92662 - protein, 68 aa, Homo sapiens
  Payload ID: 18522
  Gene Name: tripartite motif containing 59
  ENSP ID: ENSP00000420451
MVQPSLEMHNFEEELTCPICYSIFEDPRVLPCSHTFCRNCLENILQASGNFYIWRPLRIPLKCPNCRS

SEQ ID NO: 92663 - protein, 155 aa, Homo sapiens
  Payload ID: 18522
  Gene Name: tripartite motif containing 59
  ENSP ID: ENSP00000420520
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQLTDT

SEQ ID NO: 92664 - protein, 323 aa, Homo sapiens
  Payload ID: 18522
  Gene Name: tripartite motif containing 59
  ENSP ID: ENSP00000444313
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQLTDTHWTDLTHLIEKLKEQKSHSEKMIQGDKEAVLQYFKELNDTLEQKKKSFLTALCDVGNLINQEYTPQIERMKEIREQQLELMALTISLQEESPLKFLEKVDDVRQHVQILKQRPLPEVQPVEIYPRVSKILKEEWSRTEIGQIKNVLIPKMKISPKRMSCSWPDEGTDK

SEQ ID NO: 92665 - protein, 488 aa, Homo sapiens
  Payload ID: 18523
  Gene Name: tripartite motif containing 6
  Uniprot ID: Q9C030
  ENSP ID: ENSP00000278302
MTSPVLVDIREEVTCPICLELLTEPLSIDCGHSFCQACITPNGRESVIGQEGERSCPVCQTSYQPGNLRPNRHLANIVRRLREVVLGPGKQLKAVLCADHGEKLQLFCQEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWVDVTLNPHTANLNLVLAKNRRQVRFVGAKVSGPSCLEKHYDCSVLGSQHFSSGKHYWEVDVAKKTAWILGVCSNSLGPTFSFNHFAQNHSAYSRYQPQSGYWVIGLQHNHEYRAYEDSSPSLLLSMTVPPRRVGVFLDYEAGTVSFYNVTNHGFPIYTFSKYYFPTTLCPYFNPCNCVIPMTLRRPSS

SEQ ID NO: 92666 - protein, 516 aa, Homo sapiens
  Payload ID: 18523
  Gene Name: tripartite motif containing 6
  Uniprot ID: Q9C030
  ENSP ID: ENSP00000369440
MCGSERILQAGNILEIRVGQAGARRVATMTSPVLVDIREEVTCPICLELLTEPLSIDCGHSFCQACITPNGRESVIGQEGERSCPVCQTSYQPGNLRPNRHLANIVRRLREVVLGPGKQLKAVLCADHGEKLQLFCQEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWVDVTLNPHTANLNLVLAKNRRQVRFVGAKVSGPSCLEKHYDCSVLGSQHFSSGKHYWEVDVAKKTAWILGVCSNSLGPTFSFNHFAQNHSAYSRYQPQSGYWVIGLQHNHEYRAYEDSSPSLLLSMTVPPRRVGVFLDYEAGTVSFYNVTNHGFPIYTFSKYYFPTTLCPYFNPCNCVIPMTLRRPSS

SEQ ID NO: 92667 - protein, 462 aa, Homo sapiens
  Payload ID: 18523
  Gene Name: tripartite motif containing 6
  ENSP ID: ENSP00000369450
MTSPVLVDIREEVTCPICLELLTEPLSIDCGHSFCQACITPNGRESVIGQEGERSCPVCQTSYQPGNLRPNRHLANIVRRLREEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWVDVTLNPHTANLNLVLAKNRRQVRFVGAKVSGPSCLEKHYDCSVLGSQHFSSGKHYWEVDVAKKTAWILGVCSNSLGPTFSFNHFAQNHSAYSRYQPQSGYWVIGLQHNHEYRAYEDSSPSLLLSMTVPPRRVGVFLDYEAGTVSFYNVTNHGFPIYTFSKYYFPTTLCPYFNPCNCVIPMTLRRPSS

SEQ ID NO: 92668 - protein, 313 aa, Homo sapiens
  Payload ID: 18523
  Gene Name: tripartite motif containing 6
  Uniprot ID: Q9C030
  ENSP ID: ENSP00000399215
MEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWVDVTLNPHTANLNLVLAKNRRQVRFVGAKVSGPSCLEKHYDCSVLGSQHFSSGKHYWEVDVAKKTAWILGVCSNSLGPTFSFNHFAQNHSAYSRYQPQSGYWVIGLQHNHEYRAYEDSSPSLLLSMTVPPRRVGVFLDYEAGTVSFYNVTNHGFPIYTFSKYYFPTTLCPYFNPCNCVIPMTLRRPSS

SEQ ID NO: 92669 - protein, 98 aa, Homo sapiens
  Payload ID: 18523
  Gene Name: tripartite motif containing 6
  ENSP ID: ENSP00000414108
MEPERCRIQTEFNQLRNILDRVEQRELKKLEQEEKKGLRIIEEAENDLVHQTQSLRELISDLERRCQGSTMELLQDVSDVTERSEFWTLRKPEALPTK

SEQ ID NO: 92670 - protein, 313 aa, Homo sapiens; identical to SEQ ID NO: 92668
  Payload ID: 18523
  Gene Name: tripartite motif containing 6
  Uniprot ID: Q9C030
  ENSP ID: ENSP00000421079

SEQ ID NO: 92671 - protein, 313 aa, Homo sapiens; identical to SEQ ID NO: 92668
  Payload ID: 18523
  Gene Name: tripartite motif containing 6
  Uniprot ID: Q9C030
  ENSP ID: ENSP00000421802

SEQ ID NO: 92672 - protein, 313 aa, Homo sapiens; identical to SEQ ID NO: 92668
  Payload ID: 18523
  Gene Name: tripartite motif containing 6
  Uniprot ID: Q9C030
  ENSP ID: ENSP00000427704

SEQ ID NO: 92673 - protein, 395 aa, Homo sapiens
  Payload ID: 18523
  Gene Name: tripartite motif containing 6
  ENSP ID: ENSP00000480315
MCGSERPWRKTAALLSGGWEGHLLACERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWVDVTLNPHTANLNLVLAKNRRQVRFVGAKVSGPSCLEKHYDCSVLGSQHFSSGKHYWEVDVAKKTAWILGVCSNSLGPTFSFNHFAQNHSAYSRYQPQSGYWVIGLQHNHEYRAYEDSSPSLLLSMTVPPRRVGVFLDYEAGTVSFYNVTNHGFPIYTFSKYYFPTTLCPYFNPCNCVIPMTLRRPSS

SEQ ID NO: 92674 - protein, 462 aa, Homo sapiens; identical to SEQ ID NO: 92667
  Payload ID: 18523
  Gene Name: tripartite motif containing 6
  ENSP ID: ENSP00000484009

SEQ ID NO: 92675 - protein, 471 aa, Homo sapiens
  Payload ID: 18524
  Gene Name: tripartite motif containing 60
  Uniprot ID: Q495X7
  ENSP ID: ENSP00000343765
MEFVTALVNLQEESSCPICLEYLKDPVTINCGHNFCRSCLSVSWKDLDDTFPCPVCRFCFPYKSFRRNPQLRNLTEIAKQLQIRRSKRKRQKENAMCEKHNQFLTLFCVKDLEILCTQCSFSTKHQKHYICPIKKAASYHREILEGSLEPLRNNIERVEKVIILQGSKSVELKKKVEYKREEINSEFEQIRLFLQNEQEMILRQIQDEEMNILAKLNENLVELSDYVSTLKHLLREVEGKSVQSNLELLTQAKSMHHKYQNLKCPELFSFRLTKYGFSLPPQYSGLDRIIKPFQVDVILDLNTAHPQLLVSEDRKAVRYERKKRNICYDPRRFYVCPAVLGSQRFSSGRHYWEVEVGNKPKWILGVCQDCLLRNWQDQPSVLGGFWAIGRYMKSGYVASGPKTTQLLPVVKPSKIGIFLDYELGDLSFYNMNDRSILYTFNDCFTEAVWPYFYTGTDSEPLKICSVSDSER

SEQ ID NO: 92676 - protein, 471 aa, Homo sapiens; identical to SEQ ID NO: 92675
  Payload ID: 18524
  Gene Name: tripartite motif containing 60
  Uniprot ID: Q495X7
  ENSP ID: ENSP00000421142

SEQ ID NO: 92677 - protein, 90 aa, Homo sapiens
  Payload ID: 18524
  Gene Name: tripartite motif containing 60
  ENSP ID: ENSP00000421784
MEFVTALVNLQEESSCPICLEYLKDPVTINCGHNFCRSCLSVSWKDLDDTFPCPVCRFCFPYKSFRRNPQLRNLTEIAKQLQIRRSKRKR

SEQ ID NO: 92678 - protein, 471 aa, Homo sapiens; identical to SEQ ID NO: 92675
  Payload ID: 18524
  Gene Name: tripartite motif containing 60
  Uniprot ID: Q495X7
  ENSP ID: ENSP00000426496

SEQ ID NO: 92679 - protein, 209 aa, Homo sapiens
  Payload ID: 18525
  Gene Name: tripartite motif containing 61
  Uniprot ID: Q5EBN2
  ENSP ID: ENSP00000332288
MEFVTALADLRAEASCPICLDYLKDPVTISCGHNFCLSCIIMSWKDLHDSFPCPFCHFCCPERKFISNPQLGSLTEIAKQLQIRSKKRKRQEEKHVCKKHNQVLTFFCQKDLELLCPRCSLSTDHQHHCVWPIKKAASYHRKKLEEYNAPWKERVELIEKVITMQTRKSLELKKKMESPSVTRLECSCTISAHFNLRLPGSSDSSASGS

SEQ ID NO: 92680 - protein, 209 aa, Homo sapiens; identical to SEQ ID NO: 92679
  Payload ID: 18525
  Gene Name: tripartite motif containing 61
  Uniprot ID: Q5EBN2
  ENSP ID: ENSP00000482389

SEQ ID NO: 92681 - protein, 475 aa, Homo sapiens
  Payload ID: 18526
  Gene Name: tripartite motif containing 62
  Uniprot ID: Q9BVG3
  ENSP ID: ENSP00000291416
MACSLKDELLCSICLSIYQDPVSLGCEHYFCRRCITEHWVRQEAQGARDCPECRRTFAEPALAPSLKLANIVERYSSFPLDAILNARRAARPCQAHDKVKLFCLTDRALLCFFCDEPALHEQHQVTGIDDAFDELQRELKDQLQALQDSEREHTEALQLLKRQLAETKSSTKSLRTTIGEAFERLHRLLRERQKAMLEELEADTARTLTDIEQKVQRYSQQLRKVQEGAQILQERLAETDRHTFLAGVASLSERLKGKIHETNLTYEDFPTSKYTGPLQYTIWKSLFQDIHPVPAALTLDPGTAHQRLILSDDCTIVAYGNLHPQPLQDSPKRFDVEVSVLGSEAFSSGVHYWEVVVAEKTQWVIGLAHEAASRKGSIQIQPSRGFYCIVMHDGNQYSACTEPWTRLNVRDKLDKVGVFLDYDQGLLIFYNADDMSWLYTFREKFPGKLCSYFSPGQSHANGKNVQPLRINTVRI

SEQ ID NO: 92682 - protein, 354 aa, Homo sapiens
  Payload ID: 18526
  Gene Name: tripartite motif containing 62
  Uniprot ID: Q9BVG3
  ENSP ID: ENSP00000441173
MPEKTAVDQPWTQALRELKDQLQALQDSEREHTEALQLLKRQLAETKSSTKSLRTTIGEAFERLHRLLRERQKAMLEELEADTARTLTDIEQKVQRYSQQLRKVQEGAQILQERLAETDRHTFLAGVASLSERLKGKIHETNLTYEDFPTSKYTGPLQYTIWKSLFQDIHPVPAALTLDPGTAHQRLILSDDCTIVAYGNLHPQPLQDSPKRFDVEVSVLGSEAFSSGVHYWEVVVAEKTQWVIGLAHEAASRKGSIQIQPSRGFYCIVMHDGNQYSACTEPWTRLNVRDKLDKVGVFLDYDQGLLIFYNADDMSWLYTFREKFPGKLCSYFSPGQSHANGKNVQPLRINTVRI

SEQ ID NO: 92683 - protein, 353 aa, Homo sapiens
  Payload ID: 18527
  Gene Name: tripartite motif containing 63, E3 ubiquitin protein ligase
  Uniprot ID: Q969Q1
  ENSP ID: ENSP00000363390
MDYKSSLIQDGNPMENLEKQLICPICLEMFTKPVVILPCQHNLCRKCANDIFQAANPYWTSRGSSVSMSGGRFRCPTCRHEVIMDRHGVYGLQRNLLVENIIDIYKQECSSRPLQKGSHPMCKEHEDEKINIYCLTCEVPTCSMCKVFGIHKACEVAPLQSVFQGQKTELNNCISMLVAGNDRVQTIITQLEDSRRVTKENSHQVKEELSQKFDTLYAILDEKKSELLQRITQEQEKKLSFIEALIQQYQEQLDKSTKLVETAIQSLDEPGGATFLLTAKQLIKSIVEASKGCQLGKTEQGFENMDFFTLDLEHIADALRAIDFGTDEEEEEFIEEEDQEEEESTEGKEEGHQ

SEQ ID NO: 92684 - protein, 449 aa, Homo sapiens
  Payload ID: 18528
  Gene Name: tripartite motif containing 64
  Uniprot ID: A6NGJ6
  ENSP ID: ENSP00000483764
MDSDDLQVFQNELICCICVNYFIDPVTIDCGHSFCRPCLCLCSEEGRAPMRCPSCRKISEKPNFNTNVVLKKLSSLARQTRPQNINSSDNICVLHEETKELFCEADKRLLCGPCSESPEHMAHSHSPIGWAAEECREKLIKEMDYLWEINQETRNNLNQETRTFHSLKDYVSVRKRIITIQYQKMPIFLDEEEQRHLQALEREAEELFQQLQDSQVRMTQHLERMKDMYRELWETCHVPDVELLQDVRNVSARTDLAQMQKPQPVNPELTSWCITGVLDMLNNFRVDSALSTEMIPCYISLSEDVRYVIFGDDHLSAPTDPQGVDSFAVWGAQAFTSGKHYWEVDVTLSSNWILGVCQDSRTADANFVIDSDERFFLISSKRSNHYSLSTNSPPLIQYVQRPLGQVGVFLDYDNGSVSFFDVSKGSLIYGFPPSSFSSPLRPFFCFGCT

SEQ ID NO: 92685 - protein, 449 aa, Homo sapiens
  Payload ID: 18529
  Gene Name: tripartite motif containing 64B
  Uniprot ID: A6NI03
  ENSP ID: ENSP00000332969
MDSDDLQVFQNELICCICVNYFIDPVTIDCGHSFCRPCLCLCSEEGRAPMRCPSCRKTSEKPNFNTNLVLKKLSSLARQTRPQNINSSDNICVLHEETKELFCEADKRLLCGPCSESPEHMAHSHSPIGWAAEECREKLIKEMDYLWEINQETRNNLNQETSTFHSLKDYVSVRKRIITIQYQKMPIFLDEEEQRHLQALEREAEELFQQLQDSQVRMTQHLERMKDMYRELWETCHMPDVVLLQDVRNVSARTDLAQMQKPQPVNPELTSWCITGVLDMLNNFRVDSALSTEMIPCYISLSEDVRYVIFGDDHLSAPTDPQGVDSFAVWGAQAFTSGKHYWEVDVTLSSNWILGVCRDSRTADANFVIDSDERFFLISSKRSNHYSLSTNSPPLIQYVQRPLGRVGVFLDYDNGSVSFFDVSKGSLIYGFPPSSFSSPLRPFFCFGCT

SEQ ID NO: 92686 - protein, 447 aa, Homo sapiens
  Payload ID: 18530
  Gene Name: tripartite motif containing 64C
  ENSP ID: ENSP00000431987
MDSDTLRVFQNELICCICVNYFIDPVTTDCVHSFCRPCLCLCSEEGRAPMRCPLCRKISEKPNFNTNVALKKLASLARQTRPQNINSSDNICVLHEETKELFCEADKRLLCGPCSESPEHMAHSHSPIGWAAEECRVQKLIKEMDYLWKINQETQNNLNQETSKFCSLVEDKRNRIVYRYQKMHIFLDEEEQRHLQALEREAKELFQQLQDSQVRMTQHLEGMKDMYRELWETYHMPDVELLQDVGNISARTDLAQMPKPQPVNPELTSWCITGVLDMLNNFRVDNALSTEMTPCYISLSEDVRRVIFGDDHRSAPMDPQGVESFAVWCAQAFTSGKHYWEVDVTHSSNWILGVCRDSRTADTNIVIDSDKTFFSISSKTSNHYSLSTNSPPLIQYVQRPLGWVGVFLDYDNGSVSFFDVSKGSLIYGFPPSSFSSPLRPFFCFGCT

SEQ ID NO: 92687 - protein, 450 aa, Homo sapiens
  Payload ID: 18530
  Gene Name: tripartite motif containing 64C
  ENSP ID: ENSP00000481815
MDSDTLRVFQNELICCICVNYFIDPVTTDCVHSFCRPCLCLCSEEGRAPMRCPLCRKISEKPNFNTNVALKKLASLARQTRPQNINSSDNICVLHEETKELFCEADKRLLCGPCSESPEHMAHSHSPIGWAAEECRVQKLIKEMDYLWKINQETQNNLNQETSKFCSLVDYVSLRKVIITIQYQKMHIFLDEEEQRHLQALEREAKELFQQLQDSQVRMTQHLEGMKDMYRELWETYHMPDVELLQDVGNISARTDLAQMPKPQPVNPELTSWCITGVLDMLNNFRVDNALSTEMTPCYISLSEDVRRVIFGDDHRSAPMDPQGVESFAVWCAQAFTSGKHYWEVDVTHSSNWILGVCRDSRTADTNIVIDSDKTFFSISSKTSNHYSLSTNSPPLIQYVQRPLGWVGVFLDYDNGSVSFFDVSKGSLIYGFPPSSFSSPLRPFFCFGCT

SEQ ID NO: 92688 - protein, 517 aa, Homo sapiens
  Payload ID: 18531
  Gene Name: tripartite motif containing 65
  Uniprot ID: Q6PJ69
  ENSP ID: ENSP00000269383
MAAQLLEEKLTCAICLGLYQDPVTLPCGHNFCGACIRDWWDRCGKACPECREPFPDGAELRRNVALSGVLEVVRAGPARDPGPDPGPGPDPAARCPRHGRPLELFCRTEGRCVCSVCTVRECRLHERALLDAERLKREAQLRASLEVTQQQATQAEGQLLELRKQSSQIQNSACILASWVSGKFSSLLQALEIQHTTALRSIEVAKTQALAQARDEEQRLRVHLEAVARHGCRIRELLEQVDEQTFLQESQLLQPPGPLGPLTPLQWDEDQQLGDLKQLLSRLCGLLLEEGSHPGAPAKPVDLAPVEAPGPLAPVPSTVCPLRRKLWQNYRNLTFDPVSANRHFYLSRQDQQVKHCRQSRGPGGPGSFELWQVQCAQSFQAGHHYWEVRASDHSVTLGVSYPQLPRCRLGPHTDNIGRGPCSWGLCVQEDSLQAWHNGEAQRLPGVSGRLLGMDLDLASGCLTFYSLEPQTQPLYTFHALFNQPLTPVFWLLEGRTLTLCHQPGAVFPLGPQEEVLS

SEQ ID NO: 92689 - protein, 288 aa, Homo sapiens
  Payload ID: 18531
  Gene Name: tripartite motif containing 65
  ENSP ID: ENSP00000441480
  MOD_RES (1)..(1): Any amino acid
XALLDAERLKREAQLRASLEVTQQQATQAEGQLLELRKQSSQIQNSACILASWVSGKFSSLLQALEIQHTTALRSIEVAKTQALAQARDEEQRLRVHLEAVARHGCRIRELLEQVDEQTFLQESQLLQPPGPLGPLTPLQWDEDQQLGDLKQLLSRLCGLLLEEGSHPGAPAKPVDLAPVDYRNLTFDPVSANRHFYLSRQDQQVKHCRQSRGPGGPGSFELWQVQCAQSFQAGHHYWEVRASDHSVTLGVSYPQLPRCRLGPHTDNIGRGPCSWGLCVQEDSLQAWH

SEQ ID NO: 92690 - protein, 244 aa, Homo sapiens
  Payload ID: 18531
  Gene Name: tripartite motif containing 65
  ENSP ID: ENSP00000444607
  MOD_RES (1)..(1): Any amino acid
XLTCAICLGLYQDPVTLPCGHNFCGACIRDWWDRCGKACPECREPFPDGAELRRNVALSGVLEVVRAGPARDPGPDPGPGPDPAARCPRHGRPLELFCRTEGRCVCSVCTVRECRLHERALLDAERLKREAQLRASLEVTQQQATQAEGQLLELRKQSSQIQNSACILASWVSGKFSSLLQALEIQHTTALRSIEVAKTQALAQARDEEQRLRVHLEAVARHGCRIRELLEQVDEQTFLQIIAI

SEQ ID NO: 92691 - protein, 137 aa, Homo sapiens
  Payload ID: 18531
  Gene Name: tripartite motif containing 65
  ENSP ID: ENSP00000465034
  MOD_RES (1)..(1): Any amino acid
XLLEQVDEQTFLQESQLLQPPGPLGPLTPLQWDEDQQLGDLKQLLSRLCGLLLEEGSHPGAPAKPVDLAPVEAPGPLAPVPSTVCPLRRKLWQNYRNLTFDPVSANRHFYLSRQDQQVESCSLKKTYSDPNPQDLWL

SEQ ID NO: 92692 - protein, 90 aa, Homo sapiens
  Payload ID: 18531
  Gene Name: tripartite motif containing 65
  ENSP ID: ENSP00000466353
PLTPLQWDEDQQLGDLKQLLSRLCGLLLEEGSHPGAPAKPVDLAPVDYRNLTFDPVSANRHFYLSRQDQQVESCSLKKTYSDPNPQDLWL

SEQ ID NO: 92693 - protein, 1216 aa, Homo sapiens
  Payload ID: 18532
  Gene Name: tripartite motif containing 66
  Uniprot ID: O15016
  ENSP ID: ENSP00000299550
MARNCSECKEKRAAHILCTYCNRWLCSSCTEEHRHSPVPGGPFFPRAQKGSPGVNGGPGDFTLYCPLHTQEVLKLFCETCDMLTCHSCLVVEHKEHRCRHVEEVLQNQRMLLEGVTTQVAHKKSSLQTSAKQIEDRIFEVKHQHRKVENQIKMAKMVLMNELNKQANGLIEELEGITNERKRKLEQQLQSIMVLNRQFEHVQNFINWAVCSKTSVPFLFSKELIVFQMQRLLETSCNTDPGSPWSIRFTWEPNFWTKQLASLGCITTEGGQMSRADAPAYGGLQGSSPFYQSHQSPVAQQEALSHPSHKFQSPAVCSSSVCCSHCSPVSPSLKGQVPPPSIHPAHSFRQPPEMVPQQLGSLQCSALLPREKELACSPHPPKLLQPWLETQPPVEQESTSQRLGQQLTSQPVCIVPPQDVQQGAHAQPTLQTPSIQVQFGHHQKLKLSHFQQQPQQQLPPPPPPLPHPPPPLPPPPQQPHPPLPPSQHLASSQHESPPGPACSQNMDIMHHKFELEEMQKDLELLLQAQQPSLQLSQTKSPQHLQQTIVGQINYIVRQPAPVQSQSQEETLQATDEPPASQGSKPALPLDKNTAAALPQASGEETPLSVPPVDSTIQHSSPNVVRKHSTSLSIMGFSNTLEMELSSTRLERPLEPQIQSVSNLTAGAPQAVPSLLSAPPKMVSSLTSVQNQAMPSLTTSHLQTVPSLVHSTFQSMPNLISDSPQAMASLASDHPQAGPSLMSGHTQAVPSLATCPLQSIPPVSDMQPETGSSSSSGRTSGSLCPRDGADPSLENALCKVKLEEPINLSVKKPPLAPVVSTSTALQQYQNPKECENFEQGALELDAKENQSIRAFNSEHKIPYVRLERLKICAASSGEMPVFKLKPQKNDQDGSFLLIIECGTESSSMSIKVSQDRLSEATQAPGLEGRKVTVTSLAGQRPPEVEGTSPEEHRLIPRTPGAKKGPPAPIENEDFCAVCLNGGELLCCDRCPKVFHLSCHVPALLSFPGGEWVCTLCRSLTQPEMEYDCENACYNQPGMRASPGLSMYDQKKCEKLVLSLCCNNLSLPFHEPVSPLARHYYQIIKRPMDLSIIRRKLQKKDPAHYTTPEEVVSDVRLMFWNCAKFNYPDSEVAEAGRCLEVFFEGWLKEIYPEKRFAQPRQEDSDSEEVSSESGCSTPQGFPWPPYMQEGIQPKRRRRHMENERAKRMSFRLANSISQV

SEQ ID NO: 92694 - protein, 1245 aa, Homo sapiens
  Payload ID: 18532
  Gene Name: tripartite motif containing 66
  ENSP ID: ENSP00000384876
MARNCSECKEKRAAHILCTYCNRWLCSSCTEEHRHSPVPGGPFFPRAQKGSPGVNGGPGDFTLYCPLHTQEVLKLFCETCDMLTCHSCLVVEHKEHRHVEEVLQNQRMLLEGVTTQVAHKKSSLQTSAKQIEDRIFEVKHQHRKVENQIKMAKMVLMNELNKQANGLIEELEGITNERKRKLEQQLQSIMVLNRQFEHVQNFINWAVCSKTSVPFLFSKELIVFQMQRLLETSCNTDPGSPWSIRFTWEPNFWTKQLASLGCITTEGGQMSRADAPAYGGLQGSSPFYQSHQSPVAQQEALSHPSHKFQSPAVCSSSVCCSHCSPVSPSLKGQVPPPSIHPAHSFRQPPEMVPQQLGSLQCSALLPREKELACSPHPPKLLQPWLETQPPVEQESTSQRLGQQLTSQPVCIVPPQDVQQGAHAQPTLQTPSIQVQFGHHQKLKLSHFQQQPQQQLPPPPPPLPHPPPPLPPPPQQPHPPLPPSQHLASSQHESPPGPACSQNMDIMHHKFELEEMQKDLELLLQAQQPSLQLSQTKSPQHLQQTIVGQINYIVRQPAPVQSQSQEETLQATDEPPASQGSKPALPLDKNTAAALPQASGEETPLSVPPVDSTIQHSSPNVVRKHSTSLSIMGFSNTLEMELSSTRLERPLEPQIQSVSNLTAGAPQAVPSLLSAPPKMVSSLTSVQNQAMPSLTTSHLQTVPSLVHSTFQSMPNLISDSPQAMASLASDHPQAGPSLMSGHTQAVPSLATCPLQSIPPVSDMQPETGSSSSSGRTSGSLCPRDGADPSLENALCKMESEDSTRFTDLLGQGPIVPGLDAPKDLAIPSELEEPINLSVKKPPLAPVVSTSTALQQYQNPKECENFEQGALELDAKENQSIRAFNSEHKIPYVRLERLKICAASSGEMPVFKLKPQKNDQDGSFLLIIECGTESSSMSIKVSQDRLSEATQAPGLEGRKVTVTSLAGQRPPEVEGTSPEEHRLIPRTPGAKKGPPAPIENEDFCAVCLNGGELLCCDRCPKVFHLSCHVPALLSFPGGEWVCTLCRSLTQPEMEYDCENACYNQPGMRASPGLSMYDQKKCEKLVLSLCCNNLSLPFHEPVSPLARHYYQIIKRPMDLSIIRRKLQKKDPAHYTTPEEVVSDVRLMFWNCAKFNYPDSEVAEAGRCLEVFFEGWLKEIYPEKRFAQPRQEDSDSEEVSSESGCSTPQGFPWPPYMQEGIQPKRRRRHMENERAKRMSFRLANSISQV

SEQ ID NO: 92695 - protein, 286 aa, Homo sapiens
  Payload ID: 18532
  Gene Name: tripartite motif containing 66
  ENSP ID: ENSP00000437234
  MOD_RES (1)..(1): Any amino acid
XLDAKENQSIRAFNSEHKIPYVRLERLKICAASSGEMPVFKLKPQKNDQDGSFLLIIECGTESSSMSIKRPPEVEGTSPEEHRLIPRTPGAKKGPPAPIENEDFCAVCLNGGELLCCDRCPKVFHLSCHVPALLSFPGGEWVCTLCRSLTQPEMEYDCENACYNQPGMRASPGLSMYDQKKCEKLVLSLCCNNLSLPFHEPVSPLARHYYQIIKRPMDLSIIRRKLQKKDPAHYTTPEEVVSDVRLMFWNCAKFNYPDSEVAEAGRCLEVFFEGWLKEIYPEKRFA

SEQ ID NO: 92696 - protein, 783 aa, Homo sapiens
  Payload ID: 18533
  Gene Name: tripartite motif containing 67
  Uniprot ID: Q6ZTA4
  ENSP ID: ENSP00000355613
MEEELKCPVCGSLFREPIILPCSHNVCLPCARTIAVQTPDGEQHLPQPLLLSRGSGLQAGAAAAASLEHDAAAGPACGGAGGSAAGGLGGGAGGGGDHADKLSLYSETDSGYGSYTPSLKSPNGVRVLPMVPAPPGSSAAAARGAACSSLSSSSSSITCPQCHRSASLDHRGLRGFQRNRLLEAIVQRYQQGRGAVPGTSAAAAVAICQLCDRTPPEPAATLCEQCDVLYCSACQLKCHPSRGPFAKHRLVQPPPPPPPPAEAASGPTGTAQGAPSGGGGCKSPGGAGAGATGGSTARKFPTCPEHEMENYSMYCVSCRTPVCYLCLEEGRHAKHEVKPLGAMWKQHKAQLSQALNGVSDKAKEAKEFLVQLKNILQQIQENGLDYEACLVAQCDALVDALTRQKAKLLTKVTKEREHKLKMVWDQINHCTLKLRQSTGLMEYCLEVIKENDPSGFLQISDALIKRVQVSQEQWVKGALEPKVSAEFDLTLDSEPLLQAIHQLDFIQMKCRVPPVPLLQLEKCCTRNNSVTLAWRMPPFTHSPVDGYILELDDGAGGQFREVYVGKETLCTIDGLHFNSTYNARVKAFNSSGVGPYSKTVVLQTSDVAWFTFDPNSGHRDIILSNDNQTATCSSYDDRVVLGTAAFSKGVHYWELHVDRYDNHPDPAFGVARASVVKDMMLGKDDKAWAMYVDNNRSWFMHCNSHTNRTEGGVCKGATVGVLLDLNKHTLTFFINGQQQGPTAFSHVDGVFMPALSLNRNVQVTLHTGLEVPTNLGRPKLSGN

SEQ ID NO: 92697 - protein, 721 aa, Homo sapiens
  Payload ID: 18533
  Gene Name: tripartite motif containing 67
  Uniprot ID: Q6ZTA4
  ENSP ID: ENSP00000400163
MEEELKCPVCGSLFREPIILPCSHNVCLPCARTIAVQTPDGGSAAGGLGGGAGGGGDHADKLSLYSETDSGYGSYTPSLKSPNGVRVLPMVPAPPGSSAAAARGAACSSLSSSSSSITCPQCHRSASLDHRGLRGFQRNRLLEAIVQRYQQGRGAVPGTSAAAAVAICQLCDRTPPEPAATLCEQCDVLYCSACQLKCHPSRGPFAKHRLGAPSGGGGCKSPGGAGAGATGGSTARKFPTCPEHEMENYSMYCVSCRTPVCYLCLEEGRHAKHEVKPLGAMWKQHKAQLSQALNGVSDKAKEAKEFLVQLKNILQQIQENGLDYEACLVAQCDALVDALTRQKAKLLTKVTKEREHKLKMVWDQINHCTLKLRQSTGLMEYCLEVIKENDPSGFLQISDALIKRVQVSQEQWVKGALEPKVSAEFDLTLDSEPLLQAIHQLDFIQMKCRVPPVPLLQLEKCCTRNNSVTLAWRMPPFTHSPVDGYILELDDGAGGQFREVYVGKETLCTIDGLHFNSTYNARVKAFNSSGVGPYSKTVVLQTSDVAWFTFDPNSGHRDIILSNDNQTATCSSYDDRVVLGTAAFSKGVHYWELHVDRYDNHPDPAFGVARASVVKDMMLGKDDKAWAMYVDNNRSWFMHCNSHTNRTEGGVCKGATVGVLLDLNKHTLTFFINGQQQGPTAFSHVDGVFMPALSLNRNVQVTLHTGLEVPTNLGRPKLSGN

SEQ ID NO: 92698 - protein, 781 aa, Homo sapiens
  Payload ID: 18533
  Gene Name: tripartite motif containing 67
  ENSP ID: ENSP00000412124
MEEELKCPVCGSLFREPIILPCSHNVCLPCARTIAVQTPDGEQHLPQPLLLSRGSGLQAGAAAAASLEHDAAAGPACGGAGGSAAGGLGGGAGGGGDHADKLSLYSETDSGYGSYTPSLKSPNGVRVLPMVPAPPGSSAAAARGAACSSLSSSSSSITCPQCHRSASLDHRGLRGFQRNRLLEAIVQRYQQGRGAVPGTSAAAAVAICQLCDRTPPEPAATLCEQCDVLYCSACQLKCHPSRGPFAKHRLVQPPPPPPPPAEAASGPTGTAQGAPSGGGGCKSPGGAGAGATGGSTARKFPTCPEHEMENYSMYCVSCRTPVCYLCLEEGRHAKHEVKPLGAMWKQHKAQLSQALNGVSDKAKEAKEFLVQLKNILQQIQENGLDYEACLVAQCDALVDALTRQKAKLLTKVTKEREHKLKMVWDQINHCTLKLRQSTGLMEYCLEVIKENDPSGFLQISDALIKRVQVSQEQWVKGALEPKVSAEFDLTLDSEPLLQAIHQLDFIQMKLPPVPLLQLEKCCTRNNSVTLAWRMPPFTHSPVDGYILELDDGAGGQFREVYVGKETLCTIDGLHFNSTYNARVKAFNSSGVGPYSKTVVLQTSDVAWFTFDPNSGHRDIILSNDNQTATCSSYDDRVVLGTAAFSKGVHYWELHVDRYDNHPDPAFGVARASVVKDMMLGKDDKAWAMYVDNNRSWFMHCNSHTNRTEGGVCKGATVGVLLDLNKHTLTFFINGQQQGPTAFSHVDGVFMPALSLNRNVQVTLHTGLEVPTNLGRPKLSGN

SEQ ID NO: 92699 - protein, 485 aa, Homo sapiens
  Payload ID: 18534
  Gene Name: tripartite motif containing 68
  Uniprot ID: Q6AZZ1
  ENSP ID: ENSP00000300747
MDPTALVEAIVEEVACPICMTFLREPMSIDCGHSFCHSCLSGLWEIPGESQNWGYTCPLCRAPVQPRNLRPNWQLANVVEKVRLLRLHPGMGLKGDLCERHGEKLKMFCKEDVLIMCEACSQSPEHEAHSVVPMEDVAWEYKWELHEALEHLKKEQEEAWKLEVGERKRTATWKIQVETRKQSIVWEFEKYQRLLEKKQPPHRQLGAEVAAALASLQREAAETMQKLELNHSELIQQSQVLWRMIAELKERSQRPVRWMLQDIQEVLNRSKSWSLQQPEPISLELKTDCRVLGLREILKTYAADVRLDPDTAYSRLIVSEDRKRVHYGDTNQKLPDNPERFYRYNIVLGSQCISSGRHYWEVEVGDRSEWGLGVCKQNVDRKEVVYLSPHYGFWVIRLRKGNEYRAGTDEYPILSLPVPPRRVGIFVDYEAHDISFYNVTDCGSHIFTFPRYPFPGRLLPYFSPCYSIGTNNTAPLAICSLDGED

SEQ ID NO: 92700 - protein, 187 aa, Homo sapiens
  Payload ID: 18534
  Gene Name: tripartite motif containing 68
  ENSP ID: ENSP00000431783
MDPTALVEAIVEEVACPICMTFLREPMSIDCGHSFCHSCLSGLWEIPGESQNWGYTCPLCRAPVQPRNLRPNWQLANVVEKVRLLRLHPGMGLKGDLCERHGEKLKMFCKEDVLIMCEACSQSPEHEAHSVVPMEDVAWEYKWELHEALEHLKKEQEEAWKLEVGERKRTATWKAGGNPKTEYCMGV

SEQ ID NO: 92701 - protein, 142 aa, Homo sapiens
  Payload ID: 18534
  Gene Name: tripartite motif containing 68
  ENSP ID: ENSP00000434681
MQKLELNHSELIQQSQVLWRMIAELKERSQRPVRWMLQDIQEVLNRSKSWSLQQPEPISLELKTDCRVLGLREILKTYAADVRLDPDTAYSRLIVSEDRKRVHYGDTNQKLPDNPERFYRYNIVLGSQCISSGRHYWEVEVG

SEQ ID NO: 92702 - protein, 198 aa, Homo sapiens
  Payload ID: 18534
  Gene Name: tripartite motif containing 68
  ENSP ID: ENSP00000436112
MDPTALVEAIVEEVACPICMTFLREPMSIDCGHSFCHSCLSGLWEIPGESQNWGYTCPLCRAPVQPRNLRPNWQLANVVEKVRLLRLHPGMGLKGDLCERHGEKLKMFCKEDVLIMCEACSQSPEHEAHSVVPMEDVAWEYKIQVETRKQSIVWEFEKYQRLLEKKQPPHRQLGAEVAAALASLQREAAETMQKLELN

SEQ ID NO: 92703 - protein, 500 aa, Homo sapiens
  Payload ID: 18535
  Gene Name: tripartite motif containing 69
  Uniprot ID: Q86WT6
  ENSP ID: ENSP00000332284
MEVSTNPSSNIDPGDYVEMNDSITHLPSKVVIQDITMELHCPLCNDWFRDPLMLSCGHNFCEACIQDFWRLQAKETFCPECKMLCQYNNCTFNPVLDKLVEKIKKLPLLKGHPQCPEHGENLKLFSKPDGKLICFQCKDARLSVGQSKEFLQISDAVHFFTEELAIQQGQLETTLKELQTLRNMQKEAIAAHKENKLHLQQHVSMEFLKLHQFLHSKEKDILTELREEGKALNEEMELNLSQLQEQCLLAKDMLVSIQAKTEQQNSFDFLKDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGGENKEPLHILHPQ

SEQ ID NO: 92704 - protein, 341 aa, Homo sapiens
  Payload ID: 18535
  Gene Name: tripartite motif containing 69
  Uniprot ID: Q86WT6
  ENSP ID: ENSP00000342922
MEEELAIQQGQLETTLKELQTLRNMQKEAIAAHKENKLHLQQHVSMEFLKLHQFLHSKEKDILTELREEGKALNEEMELNLSQLQEQCLLAKDMLVSIQAKTEQQNSFDFLKDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGGENKEPLHILHPQ

SEQ ID NO: 92705 - protein, 130 aa, Homo sapiens
  Payload ID: 18535
  Gene Name: tripartite motif containing 69
  ENSP ID: ENSP00000452739
EQCLLAKDMLDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWT

SEQ ID NO: 92706 - protein, 263 aa, Homo sapiens
  Payload ID: 18535
  Gene Name: tripartite motif containing 69
  ENSP ID: ENSP00000453077
MEEELAIQQGQLETTLKELQTLRNMQKEAIAAHKDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGGENKEPLHILHPQ

SEQ ID NO: 92707 - protein, 500 aa, Homo sapiens; identical to SEQ ID NO: 92703
  Payload ID: 18535
  Gene Name: tripartite motif containing 69
  Uniprot ID: Q86WT6
  ENSP ID: ENSP00000453177

SEQ ID NO: 92708 - protein, 279 aa, Homo sapiens
  Payload ID: 18535
  Gene Name: tripartite motif containing 69
  Uniprot ID: Q86WT6
  ENSP ID: ENSP00000453332
MEFLKLHQFLHSKEKDILTELREEGKALNEEMELNLSQLQEQCLLAKDMLDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGGENKEPLHILHPQ

SEQ ID NO: 92709 - protein, 296 aa, Homo sapiens
  Payload ID: 18535
  Gene Name: tripartite motif containing 69
  Uniprot ID: Q86WT6
  ENSP ID: ENSP00000453549
MEFLKLHQFLHSKEKDILTELREEGKALNEEMELNLSQLQEQCLLAKDMLVSIQAKTEQQNSFDFLKDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGGENKEPLHILHPQ

SEQ ID NO: 92710 - protein, 341 aa, Homo sapiens; identical to SEQ ID NO: 92704
  Payload ID: 18535
  Gene Name: tripartite motif containing 69
  Uniprot ID: Q86WT6
  ENSP ID: ENSP00000479720

SEQ ID NO: 92711 - protein, 500 aa, Homo sapiens
  Payload ID: 18535
  Gene Name: tripartite motif containing 69
  ENSP ID: ENSP00000483739
MEVSTNPSSNINPGDYVEMNDSITHLPSKVVIQDITMELHCPLCNDWFRDPLMLSCGHNFCEACIQDFWRLQAKETFCPECKMLCQYNNCTFNPVLDKLVEKIKKLPLLKGHPQCPEHGENLKLFSKPDGKLICFQCKDARLSVGQSKEFLQISDAVHFFTEELAIQQGQLETTLKELQTLRNMQKEAIAAHKENKLHLQQHVSMEFLKLHQFLHSKEKDILTELREEGKALNEEMELNLSQLQEQCLLAKDMLVSIQAKTEQQNSFDFLKDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGGENKEPLHILHPQ

SEQ ID NO: 92712 - protein, 263 aa, Homo sapiens; identical to SEQ ID NO: 92706
  Payload ID: 18535
  Gene Name: tripartite motif containing 69
  ENSP ID: ENSP00000487832

SEQ ID NO: 92713 - protein, 296 aa, Homo sapiens; identical to SEQ ID NO: 92709
  Payload ID: 18535
  Gene Name: tripartite motif containing 69
  Uniprot ID: Q86WT6
  ENSP ID: ENSP00000488084

SEQ ID NO: 92714 - protein, 500 aa, Homo sapiens; identical to SEQ ID NO: 92711
  Payload ID: 18535
  Gene Name: tripartite motif containing 69
  ENSP ID: ENSP00000488323

SEQ ID NO: 92715 - protein, 279 aa, Homo sapiens; identical to SEQ ID NO: 92708
  Payload ID: 18535
  Gene Name: tripartite motif containing 69
  Uniprot ID: Q86WT6
  ENSP ID: ENSP00000488341

SEQ ID NO: 92716 - protein, 130 aa, Homo sapiens; identical to SEQ ID NO: 92705
  Payload ID: 18535
  Gene Name: tripartite motif containing 69
  ENSP ID: ENSP00000488671

SEQ ID NO: 92717 - protein, 511 aa, Homo sapiens
  Payload ID: 18536
  Gene Name: tripartite motif containing 7
  Uniprot ID: Q9C029
  ENSP ID: ENSP00000274773
MAAVGPRTGPGTGAEALALAAELQGEATCSICLELFREPVSVECGHSFCRACIGRCWERPGAGSVGAATRAPPFPLPCPQCREPARPSQLRPNRQLAAVATLLRRFSLPAAAPGEHGSQAAAARAAAARCGQHGEPFKLYCQDDGRAICVVCDRAREHREHAVLPLDEAVQEAKELLESRLRVLKKELEDCEVFRSTEKKESKELLKQMAAEQEKVGAEFQALRAFLVEQEGRLLGRLEELSREVAQKQNENLAQLGVEITQLSKLSSQIQETAQKPDLDFLQEFKSTLSRCSNVPGPKPTTVSSEMKNKVWNVSLKTFVLKGMLKKFKEDLRGELEKEEKVELTLDPDTANPRLILSLDLKGVRLGERAQDLPNHPCRFDTNTRVLASCGFSSGRHHWEVEVGSKDGWAFGVARESVRRKGLTPFTPEEGVWALQLNGGQYWAVTSPERSPLSCGHLSRVRVALDLEVGAVSFYAVEDMRHLYTFRVNFQERVFPLFSVCSTGTYLRIWP

SEQ ID NO: 92718 - protein, 221 aa, Homo sapiens
  Payload ID: 18536
  Gene Name: tripartite motif containing 7
  Uniprot ID: Q9C029
  ENSP ID: ENSP00000334666
MAAVGPRTGPGTGAEALALAAELQGEATCSICLELFREPVSVECGHSFCRACIGRCWERPGAGSVGAATRAPPFPLPCPQCREPARPSQLRPNRQLAAVATLLRRFSLPAAAPGEHGSQAAAARAAAARCGQHGEPFKLYCQDDGRAICVVCDRAREHREHAVLPLDEAVQEAKELLESRLRVLKKELEDCEVFRSTEKKESKELLVSQAPAGPPWDITEA

SEQ ID NO: 92719 - protein, 303 aa, Homo sapiens
  Payload ID: 18536
  Gene Name: tripartite motif containing 7
  Uniprot ID: Q9C029
  ENSP ID: ENSP00000376991
MAAEQEKVGAEFQALRAFLVEQEGRLLGRLEELSREVAQKQNENLAQLGVEITQLSKLSSQIQETAQKPDLDFLQEFKSTLSRCSNVPGPKPTTVSSEMKNKVWNVSLKTFVLKGMLKKFKEDLRGELEKEEKVELTLDPDTANPRLILSLDLKGVRLGERAQDLPNHPCRFDTNTRVLASCGFSSGRHHWEVEVGSKDGWAFGVARESVRRKGLTPFTPEEGVWALQLNGGQYWAVTSPERSPLSCGHLSRVRVALDLEVGAVSFYAVEDMRHLYTFRVNFQERVFPLFSVCSTGTYLRIWP

SEQ ID NO: 92720 - protein, 329 aa, Homo sapiens
  Payload ID: 18536
  Gene Name: tripartite motif containing 7
  Uniprot ID: Q9C029
  ENSP ID: ENSP00000376994
MTQATGQMLCLHVQVPLQLLLLGQKQMAAEQEKVGAEFQALRAFLVEQEGRLLGRLEELSREVAQKQNENLAQLGVEITQLSKLSSQIQETAQKPDLDFLQEFKSTLSRCSNVPGPKPTTVSSEMKNKVWNVSLKTFVLKGMLKKFKEDLRGELEKEEKVELTLDPDTANPRLILSLDLKGVRLGERAQDLPNHPCRFDTNTRVLASCGFSSGRHHWEVEVGSKDGWAFGVARESVRRKGLTPFTPEEGVWALQLNGGQYWAVTSPERSPLSCGHLSRVRVALDLEVGAVSFYAVEDMRHLYTFRVNFQERVFPLFSVCSTGTYLRIWP

SEQ ID NO: 92721 - protein, 303 aa, Homo sapiens; identical to SEQ ID NO: 92719
  Payload ID: 18536
  Gene Name: tripartite motif containing 7
  Uniprot ID: Q9C029
  ENSP ID: ENSP00000391458

SEQ ID NO: 92722 - protein, 868 aa, Homo sapiens
  Payload ID: 18537
  Gene Name: tripartite motif containing 71, E3 ubiquitin protein ligase
  Uniprot ID: Q2Q1W2
  ENSP ID: ENSP00000373272
MASFPETDFQICLLCKEMCGSPAPLSSNSSASSSSSQTSTSSGGGGGGPGAAARRLHVLPCLHAFCRPCLEAHRLPAAGGGAAGEPLKLRCPVCDQKVVLAEAAGMDALPSSAFLLSNLLDAVVATADEPPPKNGRAGAPAGAGGHSNHRHHAHHAHPRASASAPPLPQAPQPPAPSRSAPGGPAASPSALLLRRPHGCSSCDEGNAASSRCLDCQEHLCDNCVRAHQRVRLTKDHYIERGPPGPGAAAAAQQLGLGPPFPGPPFSILSVFPERLGFCQHHDDEVLHLYCDTCSVPICRECTMGRHGGHSFIYLQEALQDSRALTIQLLADAQQGRQAIQLSIEQAQTVAEQVEMKAKVVQSEVKAVTARHKKALEERECELLWKVEKIRQVKAKSLYLQVEKLRQNLNKLESTISAVQQVLEEGRALDILLARDRMLAQVQELKTVRSLLQPQEDDRVMFTPPDQALYLAIKSFGFVSSGAFAPLTKATGDGLKRALQGKVASFTVIGYDHDGEPRLSGGDLMSAVVLGPDGNLFGAEVSDQQNGTYVVSYRPQLEGEHLVSVTLCNQHIENSPFKVVVKSGRSYVGIGLPGLSFGSEGDSDGKLCRPWGVSVDKEGYIIVADRSNNRIQVFKPCGAFHHKFGTLGSRPGQFDRPAGVACDASRRIVVADKDNHRIQIFTFEGQFLLKFGEKGTKNGQFNYPWDVAVNSEGKILVSDTRNHRIQLFGPDGVFLNKYGFEGALWKHFDSPRGVAFNHEGHLVVTDFNNHRLLVIHPDCQSARFLGSEGTGNGQFLRPQGVAVDQEGRIIVADSRNHRVQMFESNGSFLCKFGAQGSGFGQMDRPSGIAITPDGMIVVVDFGNNRILVF

SEQ ID NO: 92723 - protein, 477 aa, Homo sapiens
  Payload ID: 18538
  Gene Name: tripartite motif containing 72, E3 ubiquitin protein ligase
  Uniprot ID: Q6ZMU5
  ENSP ID: ENSP00000312675
MSAAPGLLHQELSCPLCLQLFDAPVTAECGHSFCRACLGRVAGEPAADGTVLCPCCQAPTRPQALSTNLQLARLVEGLAQVPQGHCEEHLDPLSIYCEQDRALVCGVCASLGSHRGHRLLPAAEAHARLKTQLPQQKLQLQEACMRKEKSVAVLEHQLVEVEETVRQFRGAVGEQLGKMRVFLAALEGSLDREAERVRGEAGVALRRELGSLNSYLEQLRQMEKVLEEVADKPQTEFLMKYCLVTSRLQKILAESPPPARLDIQLPIISDDFKFQVWRKMFRALMPALEELTFDPSSAHPSLVVSSSGRRVECSEQKAPPAGEDPRQFDKAVAVVAHQQLSEGEHYWEVDVGDKPRWALGVIAAEAPRRGRLHAVPSQGLWLLGLREGKILEAHVEAKEPRALRSPERRPTRIGLYLSFGDGVLSFYDASDADALVPLFAFHERLPRPVYPFFDVCWHDKGKNAQPLLLVGPEGAEA

SEQ ID NO: 92724 - protein, 269 aa, Homo sapiens
  Payload ID: 18538
  Gene Name: tripartite motif containing 72, E3 ubiquitin protein ligase
  Uniprot ID: Q6ZMU5
  ENSP ID: ENSP00000481813
MSAAPGLLHQELSCPLCLQLFDAPVTAECGHSFCRACLGRVAGEPAADGTVLCPCCQAPTRPQALSTNLQLARLVEGLAQVPQGHCEEHLDPLSIYCEQDRALVCGVCASLGSHRGHRLLPAAEAHARLKTQLPQQKLQLQEACMRKEKSVAVLEHQLVEVEETVRQFRGAVGEQLGKMRVFLAALEGSLDREAERVRGEAGVALRRELGSLNSYLEQLRQMEKVLEEVADKPQTEFLMKYCLVTSRLQKILAESPPPARLDIQLPIIS

SEQ ID NO: 92725 - protein, 250 aa, Homo sapiens
  Payload ID: 18539
  Gene Name: tripartite motif containing 73
  Uniprot ID: Q86UV7
  ENSP ID: ENSP00000318615
MAWQVSLLELEDRLQCPICLEVFKESLMLQCGHSYCKGCLVSLSYHLDTKVRCPMCWQVVDGSSSLPNVSLAWVIEALRLPGDPEPKVCVHHRNPLSLFCEKDQELICGLCGLLGSHQHHPVTPVSTVCSRMKEELAALFSELKQEQKKVDELIAKLVKNRTRIVNESDVFSWVIRREFQELRHPVDEEKARCLEGIGGHTRGLVASLDMQLEQAQGTRERLAQAECVLEQFGNEDHHEFIWKFHSMASR

SEQ ID NO: 92726 - protein, 119 aa, Homo sapiens
  Payload ID: 18539
  Gene Name: tripartite motif containing 73
  ENSP ID: ENSP00000394718
MKEELAALFSELKQEQKKVDELIAKLVKNRTRIVNESDVFSWVIRREFQELRHPVDEEKARCLEGIGGHTRGLVASLDMQLEQAQGTRERLAQAECVLEQFGNEDHHEFIWKFHSMASR

SEQ ID NO: 92727 - protein, 249 aa, Homo sapiens
  Payload ID: 18539
  Gene Name: tripartite motif containing 73
  ENSP ID: ENSP00000407135
MAWQVSLLELEDRLQCPICLEVFKESLMLQCGHSYCKGCLVSLSYHLDTKVRCPMCWQVVDGSSSLPNVSLAWVIEALRLPGDPEPKVCVHHRNPLSLFCEKDQELICGLCGLLGSHQHHPVTPVSTVCSRMKEELAALFSELKQEQKKVDELIAKLVKNRTRIVNESDVFSWVIRREFQELRHPVDEEKARCLEGIGGHTRGLVASLDMQLEQAQGTRERLAQAECVLEQFGNEDHHEFIWFHSMASR

SEQ ID NO: 92728 - protein, 282 aa, Homo sapiens
  Payload ID: 18539
  Gene Name: tripartite motif containing 73
  ENSP ID: ENSP00000410121
MAWQVSLLELEDRLQCPICLEVFKESLMLQCGHSYCKGCLVSLSYHLDTKVRCPMCWQVVDGSSSLPNVSLAWVIEALRLPGDPEPKVCVHHRNPLSLFCEKDQELICGLCGLLGSHQHHPVTPVSTVCSRMKEELAALFSELKQEQKKVDELIAKLVKNRTRIVNESDVFSWVIRREFQELRHPVDEEKARCLEGIGGHTRGLVASLDMQLEQAQGTRERLAQAECVLEQFGNEDHHEFIWKFHSMASRLTKTEELEKKWRNGLAASHSLPQQVRPQRRTP

SEQ ID NO: 92729 - protein, 250 aa, Homo sapiens; identical to SEQ ID NO: 92725
  Payload ID: 18539
  Gene Name: tripartite motif containing 73
  Uniprot ID: Q86UV7
  ENSP ID: ENSP00000417040

SEQ ID NO: 92730 - protein, 250 aa, Homo sapiens
  Payload ID: 18540
  Gene Name: tripartite motif containing 74
  Uniprot ID: Q86UV6
  ENSP ID: ENSP00000285805
MAWQVSLLELEDWLQCPICLEVFKESLMLQCGHSYCKGCLVSLSYHLDTKVRCPMCWQVVDGSSSLPNVSLAWVIEALRLPGDPEPKVCVHHRNPLSLFCEKDQELICGLCGLLGSHQHHPVTPVSTVCSRMKEELAALFSELKQEQKKVDELIAKLVKNRTRIVNESDVFSWVIRREFQELRHPVDEEKARCLEGIGGHTRGLVASLDMQLEQAQGTRERLAQAECVLEQFGNEDHHEFIWKFHSMASR

SEQ ID NO: 92731 - protein, 249 aa, Homo sapiens
  Payload ID: 18540
  Gene Name: tripartite motif containing 74
  Uniprot ID: Q86UV6
  ENSP ID: ENSP00000378665
MAWQVSLLELEDWLQCPICLEVFKESLMLQCGHSYCKGCLVSLSYHLDTKVRCPMCWQVVDGSSSLPNVSLAWVIEALRLPGDPEPKVCVHHRNPLSLFCEKDQELICGLCGLLGSHQHHPVTPVSTVCSRMKEELAALFSELKQEQKKVDELIAKLVKNRTRIVNESDVFSWVIRREFQELRHPVDEEKARCLEGIGGHTRGLVASLDMQLEQAQGTRERLAQAECVLEQFGNEDHHEFIWFHSMASR

SEQ ID NO: 92732 - protein, 450 aa, Homo sapiens
  Payload ID: 18541
  Gene Name: tripartite motif containing 77
  Uniprot ID: I1YAP6
  ENSP ID: ENSP00000474003
MASAITQCSTSELTCSICTDYLTDPVTICCGHRFCSPCLCLLWEDTLTPNCCPVCREISQQMYFKRIIFAEKQVIPTRESVPCQLSSSAMLICRRHQEIKNLICETDRSLLCFLCSQSPRHATHKHYMTREADEYYRKKLLIQMKSIWKKKQKNQRNLNRETNIIGTWEVFINLRSMMISAEYPKVCQYLREEEQKHVESLAREGRIIFQQLKRSQTRMAKMGILLREMYEKLKEMSCKADVNLPQDLGDVMKRNEFLRLAMPQPVNPQLSAWTITGVSERLNFFRVYITLDRKICSNHKLLFEDLRHLQCSLDDTDMSCNPTSTQYTSSWGAQILSSGKHYWEVDVKDSCNWVIGLCREAWTKRNDMRLDSEGIFLLLCLKVDDHFSLFSTSPLLPHYIPRPQGWLGVFLDYECGIVSFVNVAQSSLICSFLSRIFYFPLRPFICHGSK

SEQ ID NO: 92733 - protein, 235 aa, Homo sapiens
  Payload ID: 18541
  Gene Name: tripartite motif containing 77
  ENSP ID: ENSP00000474353
SPRHATHKHYMTREADEYYRKKLLIQMKSIWKKKQKNQRNLNRETNIIGTWEDLGDVMKRNEFLRLAMPQPVNPQLSAWTITGVSERLNFFRVYITLDRKICSNHKLLFEDLRHLQCSLDDTDMSCNPTSTQYTSSWGAQILSSGKHYWEVDVKDSCNWVIGLCREAWTKRNDMRLDSEGIFLLLCLKVDDHFSLFSTSPLLPHYIPRPQGWLGVFLDYECGIVSFVNVAQSSLI

SEQ ID NO: 92734 - protein, 551 aa, Homo sapiens
  Payload ID: 18542
  Gene Name: tripartite motif containing 8
  Uniprot ID: Q9BZR9
  ENSP ID: ENSP00000302120
MAENWKNCFEEELICPICLHVFVEPVQLPCKHNFCRGCIGEAWAKDSGLVRCPECNQAYNQKPGLEKNLKLTNIVEKFNALHVEKPPAALHCVFCRRGPPLPAQKVCLRCEAPCCQSHVQTHLQQPSTARGHLLVEADDVRAWSCPQHNAYRLYHCEAEQVAVCQYCCYYSGAHQGHSVCDVEIRRNEIRKMLMKQQDRLEEREQDIEDQLYKLESDKRLVEEKVNQLKEEVRLQYEKLHQLLDEDLRQTVEVLDKAQAKFCSENAAQALHLGERMQEAKKLLGSLQLLFDKTEDVSFMKNTKSVKILMDRTQTCTSSSLSPTKIGHLNSKLFLNEVAKKEKQLRKMLEGPFSTPVPFLQSVPLYPCGVSSSGAEKRKHSTAFPEASFLETSSGPVGGQYGAAGTASGEGQSGQPLGPCSSTQHLVALPGGAQPVHSSPVFPPSQYPNGSAAQQPMLPQYGGRKILVCSVDNCYCSSVANHGGHQPYPRSGHFPWTVPSQEYSHPLPPTPSVPQSLPSLAVRDWLDASQQPGHQDFYRVYGQPSTKHYVTS

SEQ ID NO: 92735 - protein, 297 aa, Homo sapiens
  Payload ID: 18542
  Gene Name: tripartite motif containing 8
  ENSP ID: ENSP00000473428
  MOD_RES (1)..(1): Any amino acid
XHCVFCRRGPPLPAQKVCLRCEAPCCQSHVQTHLQQPSTARGHLLVEADDVRAWSCPQHNAYRLYHCEAEQVAVCQYCCYYSGAHQGHSVCDVEIRRNEIREKVNQLKEEVRLQYEKLHQLLDEDLRQTVEVLDKAQAKFCSENAAQALHLGERMQEAKKLLGSLQLLFDKTEDVSFMKNTKSVKILMDRTQTCTSSSLSPTKIGHLNSKLFLNEVAKKEKQLRKMLEGPFSTPVPFLQSVPLYPCGVSSSGAEKRKHSTAFPEASFLETSSGPVGGQYGAAGTASGEGQSGQPLGP

SEQ ID NO: 92736 - protein, 710 aa, Homo sapiens
  Payload ID: 18543
  Gene Name: tripartite motif containing 9
  Uniprot ID: Q9C026
  ENSP ID: ENSP00000298355
MEEMEEELKCPVCGSFYREPIILPCSHNLCQACARNILVQTPESESPQSHRAAGSGVSDYDYLDLDKMSLYSEADSGYGSYGGFASAPTTPCQKSPNGVRVFPPAMPPPATHLSPALAPVPRNSCITCPQCHRSLILDDRGLRGFPKNRVLEGVIDRYQQSKAAALKCQLCEKAPKEATVMCEQCDVFYCDPCRLRCHPPRGPLAKHRLVPPAQGRVSRRLSPRKVSTCTDHELENHSMYCVQCKMPVCYQCLEEGKHSSHEVKALGAMWKLHKSQLSQALNGLSDRAKEAKEFLVQLRNMVQQIQENSVEFEACLVAQCDALIDALNRRKAQLLARVNKEHEHKLKVVRDQISHCTVKLRQTTGLMEYCLEVIKENDPSGFLQISDALIRRVHLTEDQWGKGTLTPRMTTDFDLSLDNSPLLQSIHQLDFVQVKASSPVPATPILQLEECCTHNNSATLSWKQPPLSTVPADGYILELDDGNGGQFREVYVGKETMCTVDGLHFNSTYNARVKAFNKTGVSPYSKTLVLQTSEVAWFAFDPGSAHSDIILSNDNLTVTCSSYDDRVVLGKTGFSKGIHYWELTVDRYDNHPDPAFGVARMDVMKDVMLGKDDKAWAMYVDNNRSWFMHNNSHTNRTEGGITKGATIGVLLDLNRKNLTFFINDEQQGPIAFDNVEGLFFPAVSLNRNVQVTLHTGLPVPDFYSSRASIA

SEQ ID NO: 92737 - protein, 802 aa, Homo sapiens
  Payload ID: 18543
  Gene Name: tripartite motif containing 9
  Uniprot ID: Q9C026
  ENSP ID: ENSP00000342970
MEEMEEELKCPVCGSFYREPIILPCSHNLCQACARNILVQTPESESPQSHRAAGSGVSDYDYLDLDKMSLYSEADSGYGSYGGFASAPTTPCQKSPNGVRVFPPAMPPPATHLSPALAPVPRNSCITCPQCHRSLILDDRGLRGFPKNRVLEGVIDRYQQSKAAALKCQLCEKAPKEATVMCEQCDVFYCDPCRLRCHPPRGPLAKHRLVPPAQGRVSRRLSPRKVSTCTDHELENHSMYCVQCKMPVCYQCLEEGKHSSHEVKALGAMWKLHKSQLSQALNGLSDRAKEAKEFLVQLRNMVQQIQENSVEFEACLVAQCDALIDALNRRKAQLLARVNKEHEHKLKVVRDQISHCTVKLRQTTGLMEYCLEVIKENDPSGFLQISDALIRRVHLTEDQWGKGTLTPRMTTDFDLSLDNSPLLQSIHQLDFVQVKVPATPILQLEECCTHNNSATLSWKQPPLSTVPADGYILELDDGNGGQFREVYVGKETMCTVDGLHFNSTYNARVKAFNKTGVSPYSKTLVLQTSEDTDSEEQTLPFPVPSERLPLRRMSPFSSTLNLQPSFPGRSYFDFRSSPHQLSLHSSLQSLNAPGCNFETQSAPYSQLVDIKKLLAVAWFAFDPGSAHSDIILSNDNLTVTCSSYDDRVVLGKTGFSKGIHYWELTVDRYDNHPDPAFGVARMDVMKDVMLGKDDKAWAMYVDNNRSWFMHNNSHTNRTEGGITKGATIGVLLDLNRKNLTFFINDEQQGPIAFDNVEGLFFPAVSLNRNVQVSTLPLRLNSCCWLPVQRLPRAVQSNRREGS

SEQ ID NO: 92738 - protein, 550 aa, Homo sapiens
  Payload ID: 18543
  Gene Name: tripartite motif containing 9
  Uniprot ID: Q9C026
  ENSP ID: ENSP00000353561
MEEMEEELKCPVCGSFYREPIILPCSHNLCQACARNILVQTPESESPQSHRAAGSGVSDYDYLDLDKMSLYSEADSGYGSYGGFASAPTTPCQKSPNGVRVFPPAMPPPATHLSPALAPVPRNSCITCPQCHRSLILDDRGLRGFPKNRVLEGVIDRYQQSKAAALKCQLCEKAPKEATVMCEQCDVFYCDPCRLRCHPPRGPLAKHRLVPPAQGRVSRRLSPRKVSTCTDHELENHSMYCVQCKMPVCYQCLEEGKHSSHEVKALGAMWKLHKSQLSQALNGLSDRAKEAKEFLVQLRNMVQQIQENSVEFEACLVAQCDALIDALNRRKAQLLARVNKEHEHKLKVVRDQISHCTVKLRQTTGLMEYCLEVIKENDPSGFLQISDALIRRVHLTEDQWGKGTLTPRMTTDFDLSLDNSPLLQSIHQLDFVQVKASSPVPATPILQLEECCTHNNSATLSWKQPPLSTVPADGYILELDDGNGGQFREVYVGKETMCTVDGLHFNSTYNARVKAFNKTGVSPYSKTLVLQTSEGKALQQYPSERELRGI

SEQ ID NO: 92739 - protein, 468 aa, Homo sapiens
  Payload ID: 18544
  Gene Name: tripartite motif family-like 1
  Uniprot ID: Q8N9V2
  ENSP ID: ENSP00000327738
MSTADLMENLREELTCFICLDYFSSPVTTECGHSFCLVCLLRSWEEHNTPLSCPECWRTLEGPHFQSNERLGRLASIARQLRSQVLQSEDEQGSYGRMPTTAKALSDDEQGGSAFVAQSHGANRVHLSSEAEEHHREKLQEILNLLRVRRKEAQAVLTHEKERVKLCQEETKTCKQVVVSEYMKMHQFLKEEEQLQLQLLEQEEKENMRKLRNNEIKLTQQIRSLSKMIAQIESSSQSSAFESLEEVRGALERSEPLLLQCPEATTTELSLCRITGMKEMLRKFSTEITLDPATANAYLVLSEDLKSVKYGGSRQQLPDNPERFDQSATVLGTQIFTSGRHYWEVEVGNKTEWEVGICKDSVSRKGNLPKPPGDLFSLIGLKIGDDYSLWVSSPLKGQHVREPVCKVGVFLDYESGHIAFYNGTDESLIYSFPQASFQEALRPIFSPCLPNEGTNTDPLTICSLNSHV

SEQ ID NO: 92740 - protein, 422 aa, Homo sapiens
  Payload ID: 18545
  Gene Name: tripartite motif family-like 2
  ENSP ID: ENSP00000317498
CFQSQEHKHHMVCGIQEAAENYRKLFQEILNTSREKLEAAKSILTDEQERMAMIQEEEQNFKKMIESEYSMRLRLLNEECEQNLQRQQECISDLNLRETLLNQAIKLATELEEMFQEMLQRLGRVGRENMEKLKESEARASEQVRSLLKLIVELEKKCGEGTLALLKCLDLEIRPPELREMNFCCAEATQSMNAKYSLERSKSLLLEHLEPAHITDLSLCHIRGLSSMFRVLQRHLTLDPETAHPCLALSEDLRTMRLRHGQQDGAGNPERLDFSAMVLAAESFTSGRHYWEVDVEKATRWQVGIYHGSADAKGSTARASGEKVLLTGSVMGTEWTLWVFPPLKRLFLEKKLDTVGVFLDCEHGQISFYNVTEMSLIYNFSHCAFQGALRPVFSLCIPNGDTSPDSLTILQHGPSCDATVSP

SEQ ID NO: 92741 - protein, 118 aa, Homo sapiens
  Payload ID: 18545
  Gene Name: tripartite motif family-like 2
  ENSP ID: ENSP00000421575
EEEQNFKKMIESEYSMRLRLLNEECEQNLQRQQECISDLNLRETLLNQAIKLATELEEMFQEMLQRLGRVGRENMEKLKESEARASEQVRSLLKLIVELEKKCGEGTLALLKEQVTAA

SEQ ID NO: 92742 - protein, 437 aa, Homo sapiens
  Payload ID: 18545
  Gene Name: tripartite motif family-like 2
  Uniprot ID: Q8N7C3
  ENSP ID: ENSP00000422581
MSKRLSPQLQHNITEDAYCETHLEPTRLFCDVDQITLCSKCFQSQEHKHHMVCGIQEAAENYRKLFQEILNTSREKLEAAKSILTDEQERMAMIQEEEQNFKKMIESEYSMRLRLLNEECEQNLQRQQECISDLNLRETLLNQAIKLATELEEMFQEMLQRLGRVGRENMEKLKESEARASEQVRSLLKLIVELEKKCGEGTLALLKNAKYSLERSKSLLLEHLEPAHITDLSLCHIRGLSSMFRVLQRHLTLDPETAHPCLALSEDLRTMRLRHGQQDGAGNPERLDFSAMVLAAESFTSGRHYWEVDVEKATRWQVGIYHGSADAKGSTARASGEKVLLTGSVMGTEWTLWVFPPLKRLFLEKKLDTVGVFLDCEHGQISFYNVTEMSLIYNFSHCAFQGALRPVFSLCIPNGDTSPDSLTILQHGPSCDATVSP

SEQ ID NO: 92743 - protein, 118 aa, Homo sapiens; identical to SEQ ID NO: 92741
  Payload ID: 18545
  Gene Name: tripartite motif family-like 2
  ENSP ID: ENSP00000426074

SEQ ID NO: 92744 - protein, 309 aa, Homo sapiens
  Payload ID: 18546
  Gene Name: tripartite motif-containing 51
  Uniprot ID: Q9BSJ1
  ENSP ID: ENSP00000244891
MQSLWEKACENLRNLNMETTRTRCWKDYVSLRIEAIRAEYQKMPAFLHEEEQHHLERLRKEGEDIFQQLNESKARMEHSRELLRGMYEDLKQMCHKADVELLQAFGDILHRYESLLLQVSEPVNPELSAGPITGLLDSLSGFRVDFTLQPERANSHIFLCGDLRSMNVGCDPQDDPDITGKSECFLVWGAQAFTSGKYYWEVHMGDSWNWAFGVCNNYWKEKRQNDKIDGEEGLFLLGCVKEDTHCSLFTTSPLVVQYVPRPTSTVGLFLDCEGRTVSFVDVDQSSLIYTIPNCSFSPPLRPIFCCSHF

SEQ ID NO: 92745 - protein, 452 aa, Homo sapiens
  Payload ID: 18546
  Gene Name: tripartite motif-containing 51
  Uniprot ID: Q9BSJ1
  ENSP ID: ENSP00000395086
MNSGILQVFQRALTCPICMNYFLDPVTIDCGHSFCRPCLYLNWQDTAVLAQCSECKKTTRQRNLNTDICLKNMAFIARKASLRQFLSSEEQICGMHRETKKMFCEVDKSLLCLPCSNSQEHRNHIHCPIEWAAEERREELLKKMQSLWEKACENLRNLNMETTRTRCWKDYVSLRIEAIRAEYQKMPAFLHEEEQHHLERLRKEGEDIFQQLNESKARMEHSRELLRGMYEDLKQMCHKADVELLQAFGDILHRYESLLLQVSEPVNPELSAGPITGLLDSLSGFRVDFTLQPERANSHIFLCGDLRSMNVGCDPQDDPDITGKSECFLVWGAQAFTSGKYYWEVHMGDSWNWAFGVCNNYWKEKRQNDKIDGEEGLFLLGCVKEDTHCSLFTTSPLVVQYVPRPTSTVGLFLDCEGRTVSFVDVDQSSLIYTIPNCSFSPPLRPIFCCSHF

SEQ ID NO: 92746 - protein, 563 aa, Homo sapiens
  Payload ID: 18547
  Gene Name: tripeptidyl peptidase I
  Uniprot ID: O14773
  ENSP ID: ENSP00000299427
MGLQACLLGLFALILSGKCSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHRFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 92747 - protein, 177 aa, Homo sapiens
  Payload ID: 18547
  Gene Name: tripeptidyl peptidase I
  ENSP ID: ENSP00000398136
MGLQACLLGLFALILSGKCSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVAGMRDRSPSCSGSCCSVMSQPCHMCIL

SEQ ID NO: 92748 - protein, 39 aa, Homo sapiens
  Payload ID: 18547
  Gene Name: tripeptidyl peptidase I
  ENSP ID: ENSP00000434647
MGLQACLLGLFALILSGKCSYSPEPDQRRTKIPDPRECG

SEQ ID NO: 92749 - protein, 30 aa, Homo sapiens
  Payload ID: 18547
  Gene Name: tripeptidyl peptidase I
  ENSP ID: ENSP00000435001
MGLQACLLGLFALILSGKCSYSPEPDQRRT

SEQ ID NO: 92750 - protein, 320 aa, Homo sapiens
  Payload ID: 18547
  Gene Name: tripeptidyl peptidase I
  Uniprot ID: O14773
  ENSP ID: ENSP00000437066
MRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 92751 - protein, 556 aa, Homo sapiens
  Payload ID: 18547
  Gene Name: tripeptidyl peptidase I
  ENSP ID: ENSP00000484546
MGLQACLLGLFALILSGKCSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHRFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPTSQLC

SEQ ID NO: 92752 - protein, 1262 aa, Homo sapiens
  Payload ID: 18548
  Gene Name: tripeptidyl peptidase II
  ENSP ID: ENSP00000365220
MATAATEEPFPFHGLLPKKETGAASFLCRYPEYDGRGVLIAVLDTGVDPGAPGMQVTTDGKPKIVDIIDTTGSGDVNTATEVEPKDGEIVGLSGRVLKIPASWTNPSGKYHIGIKNGYDFYPKALKERIQKERKEKIWDPVHRVALAEACRKQEEFDVANNGSSQANKLIKEELQSQVELLNSFEKKYSDPGPVYDCLVWHDGEVWRACIDSNEDGDLSKSTVLRNYKEAQEYGSFGTAEMLNYSVNIYDDGNLLSIVTSGGAHGTHVASIAAGHFPEEPERNGVAPGAQILSIKIGDTRLSTMETGTGLIRAMIEVINHKCDLVNYSYGEATHWPNSGRICEVINEAVWKHNIIYVSSAGNNGPCLSTVGCPGGTTSSVIGVGAYVSPDMMVAEYSLREKLPANQYTWSSRGPSADGALGVSISAPGGAIASVPNWTLRGTQLMNGTSMSSPNACGGIALILSGLKANNIDYTVHSVRRALENTAVKADNIEVFAQGHGIIQVDKAYDYLVQNTSFANKLGFTVTVGNNRGIYLRDPVQVAAPSDHGVGIEPVFPENTENSEKISLQLHLALTSNSSWVQCPSHLELMNQCRHINIRVDPRGLREGLHYTEVCGYDIASPNAGPLFRVPITAVIAAKVNESSHYDLAFTDVHFKPGQIRRHFIEVPEGATWAEVTVCSCSSEVSAKFVLHAVQLVKQRAYRSHEFYKFCSLPEKGTLTEAFPVLGGKAIEFCIARWWASLSDVNIDYTISFHGIVCTAPQLNIHASEGINRFDVQSSLKYEDLAPCITLKNWVQTLRPVSAKTKPLGSRDVLPNNRQLYEMVLTYNFHQPKSGEVTPSCPLLCELLYESEFDSQLWIIFDQNKRQMGSGDAYPHQYSLKLEKGDYTIRLQIRHEQISDLERLKDLPFIVSHRLSNTLSLDIHENHSFALLGKKKSSNLTLPPKYNQPFFVTSLPDDKIPKGAGPGCYLAGSLTLSKTELGKKAGQSAAKRQGKFKKDVIPVHYYLIPPPTKTKNGSKDKEKDSEKEKDLKEEFTEALRDLKIQWMTKLDSSDIYNELKETYPNYLPLYVARLHQLDAEKERMKRLNEIVDAANAVISHIDQTALAVYIAMKTDPRPDAATIKNDMDKQKSTLVDALCRKGCALADHLLHTQAQDGAISTDAEGKEEEGESPLDSLAETFWETTKWTDLFDNKVLTFAYKHALVNKMYGRGLKFATKLVEEKPTKENWKNCIQLMKLLGWTHCASFTENWLPIMYPPDYCVF

SEQ ID NO: 92753 - protein, 1249 aa, Homo sapiens
  Payload ID: 18548
  Gene Name: tripeptidyl peptidase II
  Uniprot ID: P29144
  ENSP ID: ENSP00000365233
MATAATEEPFPFHGLLPKKETGAASFLCRYPEYDGRGVLIAVLDTGVDPGAPGMQVTTDGKPKIVDIIDTTGSGDVNTATEVEPKDGEIVGLSGRVLKIPASWTNPSGKYHIGIKNGYDFYPKALKERIQKERKEKIWDPVHRVALAEACRKQEEFDVANNGSSQANKLIKEELQSQVELLNSFEKKYSDPGPVYDCLVWHDGEVWRACIDSNEDGDLSKSTVLRNYKEAQEYGSFGTAEMLNYSVNIYDDGNLLSIVTSGGAHGTHVASIAAGHFPEEPERNGVAPGAQILSIKIGDTRLSTMETGTGLIRAMIEVINHKCDLVNYSYGEATHWPNSGRICEVINEAVWKHNIIYVSSAGNNGPCLSTVGCPGGTTSSVIGVGAYVSPDMMVAEYSLREKLPANQYTWSSRGPSADGALGVSISAPGGAIASVPNWTLRGTQLMNGTSMSSPNACGGIALILSGLKANNIDYTVHSVRRALENTAVKADNIEVFAQGHGIIQVDKAYDYLVQNTSFANKLGFTVTVGNNRGIYLRDPVQVAAPSDHGVGIEPVFPENTENSEKISLQLHLALTSNSSWVQCPSHLELMNQCRHINIRVDPRGLREGLHYTEVCGYDIASPNAGPLFRVPITAVIAAKVNESSHYDLAFTDVHFKPGQIRRHFIEVPEGATWAEVTVCSCSSEVSAKFVLHAVQLVKQRAYRSHEFYKFCSLPEKGTLTEAFPVLGGKAIEFCIARWWASLSDVNIDYTISFHGIVCTAPQLNIHASEGINRFDVQSSLKYEDLAPCITLKNWVQTLRPVSAKTKPLGSRDVLPNNRQLYEMVLTYNFHQPKSGEVTPSCPLLCELLYESEFDSQLWIIFDQNKRQMGSGDAYPHQYSLKLEKGDYTIRLQIRHEQISDLERLKDLPFIVSHRLSNTLSLDIHENHSFALLGKKKSSNLTLPPKYNQPFFVTSLPDDKIPKGAGPGCYLAGSLTLSKTELGKKADVIPVHYYLIPPPTKTKNGSKDKEKDSEKEKDLKEEFTEALRDLKIQWMTKLDSSDIYNELKETYPNYLPLYVARLHQLDAEKERMKRLNEIVDAANAVISHIDQTALAVYIAMKTDPRPDAATIKNDMDKQKSTLVDALCRKGCALADHLLHTQAQDGAISTDAEGKEEEGESPLDSLAETFWETTKWTDLFDNKVLTFAYKHALVNKMYGRGLKFATKLVEEKPTKENWKNCIQLMKLLGWTHCASFTENWLPIMYPPDYCVF

SEQ ID NO: 92754 - protein, 86 aa, Homo sapiens
  Payload ID: 18549
  Gene Name: triple QxxK/R motif containing
  Uniprot ID: Q629K1
  ENSP ID: ENSP00000368138
MGRKDAATIKLPVDQYRKQIGKQDYKKTKPILRATKLKAEAKKTAIGIKEVGLVLAAILALLLAFYAFFYLRLTTDVDPDLDQDED

SEQ ID NO: 92755 - protein, 54 aa, Homo sapiens
  Payload ID: 18549
  Gene Name: triple QxxK/R motif containing
  ENSP ID: ENSP00000427850
MGRKDAATIKLPVDQYRKQIGKQDYKKTKPILRATKLKAEAKKTAIGIKTHHGC

SEQ ID NO: 92756 - protein, 54 aa, Homo sapiens; identical to SEQ ID NO: 92755
  Payload ID: 18549
  Gene Name: triple QxxK/R motif containing
  ENSP ID: ENSP00000428757

SEQ ID NO: 92757 - protein, 54 aa, Homo sapiens; identical to SEQ ID NO: 92755
  Payload ID: 18549
  Gene Name: triple QxxK/R motif containing
  ENSP ID: ENSP00000428759

SEQ ID NO: 92758 - protein, 86 aa, Homo sapiens; identical to SEQ ID NO: 92754
  Payload ID: 18549
  Gene Name: triple QxxK/R motif containing
  Uniprot ID: Q629K1
  ENSP ID: ENSP00000428822

SEQ ID NO: 92759 - protein, 7 aa, Homo sapiens
  Payload ID: 18549
  Gene Name: triple QxxK/R motif containing
  ENSP ID: ENSP00000429302
MGRKDAA

SEQ ID NO: 92760 - protein, 86 aa, Homo sapiens; identical to SEQ ID NO: 92754
  Payload ID: 18549
  Gene Name: triple QxxK/R motif containing
  Uniprot ID: Q629K1
  ENSP ID: ENSP00000429381

SEQ ID NO: 92761 - protein, 86 aa, Homo sapiens; identical to SEQ ID NO: 92754
  Payload ID: 18549
  Gene Name: triple QxxK/R motif containing
  Uniprot ID: Q629K1
  ENSP ID: ENSP00000429517

SEQ ID NO: 92762 - protein, 86 aa, Homo sapiens; identical to SEQ ID NO: 92754
  Payload ID: 18549
  Gene Name: triple QxxK/R motif containing
  Uniprot ID: Q629K1
  ENSP ID: ENSP00000429742

SEQ ID NO: 92763 - protein, 86 aa, Homo sapiens; identical to SEQ ID NO: 92754
  Payload ID: 18549
  Gene Name: triple QxxK/R motif containing
  Uniprot ID: Q629K1
  ENSP ID: ENSP00000429822

SEQ ID NO: 92764 - protein, 80 aa, Homo sapiens
  Payload ID: 18549
  Gene Name: triple QxxK/R motif containing
  ENSP ID: ENSP00000430123
MGRKDAATIKLPVDQYRKQIGKQDYKKTKPILRATKLKAEAKKTAIGIKSTFFFFPGSWPCTCSYIGTTTGFLCFLLSQT

SEQ ID NO: 92765 - protein, 75 aa, Homo sapiens
  Payload ID: 18549
  Gene Name: triple QxxK/R motif containing
  ENSP ID: ENSP00000430683
MGRKDAATIKLPVDQYRKQIGKQDYKKTKPILRATKLKAEAKKTAIGIKEVGLVLAAILALLLAFYAFFYLRLTT

SEQ ID NO: 92766 - protein, 86 aa, Homo sapiens; identical to SEQ ID NO: 92754
  Payload ID: 18549
  Gene Name: triple QxxK/R motif containing
  Uniprot ID: Q629K1
  ENSP ID: ENSP00000430837

SEQ ID NO: 92767 - protein, 54 aa, Homo sapiens; identical to SEQ ID NO: 92755
  Payload ID: 18549
  Gene Name: triple QxxK/R motif containing
  ENSP ID: ENSP00000430915

SEQ ID NO: 92768 - protein, 86 aa, Homo sapiens; identical to SEQ ID NO: 92754
  Payload ID: 18549
  Gene Name: triple QxxK/R motif containing
  Uniprot ID: Q629K1
  ENSP ID: ENSP00000430992

SEQ ID NO: 92769 - protein, 86 aa, Homo sapiens; identical to SEQ ID NO: 92754
  Payload ID: 18549
  Gene Name: triple QxxK/R motif containing
  Uniprot ID: Q629K1
  ENSP ID: ENSP00000442030

SEQ ID NO: 92770 - protein, 400 aa, Homo sapiens
  Payload ID: 18550
  Gene Name: TRK-fused gene
  Uniprot ID: Q92734
  ENSP ID: ENSP00000240851
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVSGPPSAPAEDRSGTPDSIASSSSAAHPPGVQPQQPPYTGAQTQAGQIEGQMYQQYQQQAGYGAQQPQAPPQQPQQYGIQYSASYSQQTGPQQPQQFQGYGQQPTSQAPAPAFSGQPQQLPAQPPQQYQASNYPAQTYTAQTSQPTNYTVAPASQPGMAPSQPGAYQPRPGFTSLPGSTMTPPPSGPNPYARNRPPFGQGYTQPGPGYR

SEQ ID NO: 92771 - protein, 396 aa, Homo sapiens
  Payload ID: 18550
  Gene Name: TRK-fused gene
  Uniprot ID: Q92734
  ENSP ID: ENSP00000397182
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVSGPPSAPAEDRSGTPDSIASSSSAAHPPGVQPQQPPYTGAQTQAGQMYQQYQQQAGYGAQQPQAPPQQPQQYGIQYSASYSQQTGPQQPQQFQGYGQQPTSQAPAPAFSGQPQQLPAQPPQQYQASNYPAQTYTAQTSQPTNYTVAPASQPGMAPSQPGAYQPRPGFTSLPGSTMTPPPSGPNPYARNRPPFGQGYTQPGPGYR

SEQ ID NO: 92772 - protein, 396 aa, Homo sapiens; identical to SEQ ID NO: 92771
  Payload ID: 18550
  Gene Name: TRK-fused gene
  Uniprot ID: Q92734
  ENSP ID: ENSP00000417952

SEQ ID NO: 92773 - protein, 157 aa, Homo sapiens
  Payload ID: 18550
  Gene Name: TRK-fused gene
  ENSP ID: ENSP00000419504
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQS

SEQ ID NO: 92774 - protein, 128 aa, Homo sapiens
  Payload ID: 18550
  Gene Name: TRK-fused gene
  ENSP ID: ENSP00000419559
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGE

SEQ ID NO: 92775 - protein, 400 aa, Homo sapiens; identical to SEQ ID NO: 92770
  Payload ID: 18550
  Gene Name: TRK-fused gene
  Uniprot ID: Q92734
  ENSP ID: ENSP00000419960

SEQ ID NO: 92776 - protein, 181 aa, Homo sapiens
  Payload ID: 18550
  Gene Name: TRK-fused gene
  ENSP ID: ENSP00000420797
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNV

SEQ ID NO: 92777 - protein, 366 aa, Homo sapiens
  Payload ID: 18550
  Gene Name: TRK-fused gene
  ENSP ID: ENSP00000477562
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVSGPPSAPAEDRSGTPDSIASSSSAAHPPGVQPQQPPYTGAQTQAGQMYQQYSNRPAMVHSSRRLHLSSLNSMVFSIQQAIVSRLDLNNLSSSRDMASNQLPRHQLLPFLVSLNNCLLSRHSSTRRAIILHKLTLPKLLSLLIILWLLPLNLEWLQANLGPINQDQVLLHFLEVP

SEQ ID NO: 92778 - protein, 284 aa, Homo sapiens
  Payload ID: 18550
  Gene Name: TRK-fused gene
  Uniprot ID: Q92734
  ENSP ID: ENSP00000479269
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVSGPPSAPAEDRSGTPDSIASSSSAAHPPGVQPQQPPYTGAQTQAGQIEGQMYQQYQQQAGYGAQQPQAPPQQPQQYGIQYSGFQSMERFHCK

SEQ ID NO: 92779 - protein, 284 aa, Homo sapiens; identical to SEQ ID NO: 92778
  Payload ID: 18550
  Gene Name: TRK-fused gene
  Uniprot ID: Q92734
  ENSP ID: ENSP00000479981

SEQ ID NO: 92780 - protein, 421 aa, Homo sapiens
  Payload ID: 18551
  Gene Name: tRNA 5-methylaminomethyl-2-thiouridylate methyltransferase
  Uniprot ID: O75648
  ENSP ID: ENSP00000290846
MQALRHVVCALSGGVDSAVAALLLRRRGYQVTGVFMKNWDSLDEHGVCTADKDCEDAYRVCQILDIPFHQVSYVKEYWNDVFSDFLNEYEKGRTPNPDIVCNKHIKFSCFFHYAVDNLGADAIATGHYARTSLEDEEVFEQKHVKKPEGLFRNRFEVRNAVKLLQAADSFKDQTFFLSQVSQDALRRTIFPLGGLTKEFVKKIAAENRLHHVLQKKESMGMCFIGKRNFEHFLLQYLQPRPGHFISIEDNKVLGTHKGWFLYTLGQRANIGGLREPWYVVEKDSVKGDVFVAPRTDHPALYRDLLRTSRVHWIAEEPPAALVRDKMMECHFRFRHQMALVPCVLTLNQDGTVWVTAVQAVRALATGQFAVFYKGDECLGSGKILRLGPSAYTLQKGQRRAGMATESPSDSPEDGPGLSPLL

SEQ ID NO: 92781 - protein, 376 aa, Homo sapiens
  Payload ID: 18551
  Gene Name: tRNA 5-methylaminomethyl-2-thiouridylate methyltransferase
  Uniprot ID: O75648
  ENSP ID: ENSP00000370407
MQALRHVVCALSGGVDSAVAALLLRRRGYQVTGVFMKNWDSLDEHGVCTADKDCEDAYRVCQILDIPFHQVSYVKEYWNDVFSDFLNEYEKGRTPNPDIVCNKHIKFSCFFHYAVDNLGADAIATGHYARTSLEDEEVFEQKHVKKPEGLFRNRFEVRNAVKLLQAADSFKDQTFFLSQVSQDALRRTIFPLGGLTKEFVKKIAAENRLHHVLQKKESMGMCFIGKRNFEHFLLQYLQPRPGHFISIEDNKVLGTHKGWFLYTLGQRANIGGLREPWYVVEKDSVKGDVFVAPRTDHPALYRDLLRTSRVHWIAEEPPAALVRDKMMECHFRFRHQMALVCCVLQGGRVPGQREDPAAGAVCLHAPEGPAQSWDGH

SEQ ID NO: 92782 - protein, 99 aa, Homo sapiens
  Payload ID: 18551
  Gene Name: tRNA 5-methylaminomethyl-2-thiouridylate methyltransferase
  ENSP ID: ENSP00000370409
MQALRHVVCALSGGVDSAVAALLLRRRGYQVTGVFMKNWDSLDEHGVCTADKDCEDAYRVCQILDIPFHQVSYVKEYWNDVFRGRCHCHRSLCKNFPGR

SEQ ID NO: 92783 - protein, 99 aa, Homo sapiens; identical to SEQ ID NO: 92782
  Payload ID: 18551
  Gene Name: tRNA 5-methylaminomethyl-2-thiouridylate methyltransferase
  ENSP ID: ENSP00000393014

SEQ ID NO: 92784 - protein, 99 aa, Homo sapiens; identical to SEQ ID NO: 92782
  Payload ID: 18551
  Gene Name: tRNA 5-methylaminomethyl-2-thiouridylate methyltransferase
  ENSP ID: ENSP00000398488

SEQ ID NO: 92785 - protein, 166 aa, Homo sapiens
  Payload ID: 18551
  Gene Name: tRNA 5-methylaminomethyl-2-thiouridylate methyltransferase
  Uniprot ID: O75648
  ENSP ID: ENSP00000407700
MQALRHVVCALSGGVDSAVAALLLRRRGYQVTGVFMKNWDSLDEHGVCTADKDCEDAYRVCQILDIPFHQVSYVKEYWNDVFSDFLNEYEKGRTPNPDIVCNKHIKFSCFFHYAVDNLGADAIATGHYARTSLEDEEVFEQKHVKKPEGLFRNRFEVRNARFPRMP

SEQ ID NO: 92786 - protein, 99 aa, Homo sapiens; identical to SEQ ID NO: 92782
  Payload ID: 18551
  Gene Name: tRNA 5-methylaminomethyl-2-thiouridylate methyltransferase
  ENSP ID: ENSP00000413880

SEQ ID NO: 92787 - protein, 227 aa, Homo sapiens
  Payload ID: 18552
  Gene Name: tRNA aspartic acid methyltransferase 1
  ENSP ID: ENSP00000324263
  MOD_RES (1)..(1): Any amino acid
XSCIPAQVVAAIDVNTVANEVYKYNFPHTQLLAKTIEGITLEEFDRLSFDMILMSPPCQPFTRDLLIQTIENCGFQYQEFLLSPTSLGIPNSRLRYFLIAKLQSEPLPFQAPGQVLMEFPKIESVHPQKYAMDVENKIQEKNVEPNISFDGSIQCSGKDAILFKLETAEEIHRKNQQDSDLSVKMLKDFLEDDTDVNQYLLPPKSLLRYALLLDIVQPTCRRSVCFT

SEQ ID NO: 92788 - protein, 69 aa, Homo sapiens
  Payload ID: 18552
  Gene Name: tRNA aspartic acid methyltransferase 1
  ENSP ID: ENSP00000346652
MEPLRVLELYSGVGGMHHALRESCIPAQVVAAIDVNTVANEVYKYNFPHTQLLAKTIEKRSNTAQFSAT

SEQ ID NO: 92789 - protein, 391 aa, Homo sapiens
  Payload ID: 18552
  Gene Name: tRNA aspartic acid methyltransferase 1
  Uniprot ID: O14717
  ENSP ID: ENSP00000367030
MEPLRVLELYSGVGGMHHALRESCIPAQVVAAIDVNTVANEVYKYNFPHTQLLAKTIEGITLEEFDRLSFDMILMSPPCQPFTRIGRQGDMTDSRTNSFLHILDILPRLQKLPKYILLENVKGFEVSSTRDLLIQTIENCGFQYQEFLLSPTSLGIPNSRLRYFLIAKLQSEPLPFQAPGQVLMEFPKIESVHPQKYAMDVENKIQEKNVEPNISFDGSIQCSGKDAILFKLETAEEIHRKNQQDSDLSVKMLKDFLEDDTDVNQYLLPPKSLLRYALLLDIVQPTCRRSVCFTKGYGSYIEGTGSVLQTAEDVQVENIYKSLTNLSQEEQITKLLILKLRYFTPKEIANLLGFPPEFGFPEKITVKQRYRLLGNSLNVHVVAKLIKILYE

SEQ ID NO: 92790 - protein, 53 aa, Homo sapiens
  Payload ID: 18552
  Gene Name: tRNA aspartic acid methyltransferase 1
  ENSP ID: ENSP00000389497
ALRESCIPAQVVAAIDVNTVANEVYKYNFPHTQLLAKTIEITKITKVYSFGKC

SEQ ID NO: 92791 - protein, 86 aa, Homo sapiens
  Payload ID: 18552
  Gene Name: tRNA aspartic acid methyltransferase 1
  ENSP ID: ENSP00000390611
  MOD_RES (1)..(1): Any amino acid
XSCIPAQVVAAIDVNTVANEVYKYNFPHTQLLAKTIERPLDTNNRKLWLSVPRVSIISNLSWHSKFKATIFSYCKASVRAITLSSP

SEQ ID NO: 92792 - protein, 63 aa, Homo sapiens
  Payload ID: 18552
  Gene Name: tRNA aspartic acid methyltransferase 1
  Uniprot ID: O14717
  ENSP ID: ENSP00000417594
MEPLRVLELYSGVGGMHHALRESCIPAQVVAAIDVNTVANEVYKYNFPHTQLLAKTIEDWPAG

SEQ ID NO: 92793 - protein, 254 aa, Homo sapiens
  Payload ID: 18552
  Gene Name: tRNA aspartic acid methyltransferase 1
  ENSP ID: ENSP00000419625
MEPLRVLELYSGVGGMHHALRESCIPAQVVAAIDVNTVANEVYKYNFPHTQLLAKTIEVLMEFPKIESVHPQKYAMDVENKIQEKNVEPNISFDGSIQCSGKDAILFKLETAEEIHRKNQQDSDLSVKMLKDFLEDDTDVNQYLLPPKSLLRYALLLDIVQPTCRRSVCFTKGYGSYIEGTGSVLQTAEDVQVENIYKSLTNLSQEEQITKLLILKLRYFTPKEIANLLGFPPEFGMWDTCRIQLSCIKTLKNL

SEQ ID NO: 92794 - protein, 136 aa, Homo sapiens
  Payload ID: 18552
  Gene Name: tRNA aspartic acid methyltransferase 1
  ENSP ID: ENSP00000431476
ALRESCIPAQVVAAIDVNTVANEVYKYNFPHTQLLAKTIEGITLEEFDRLSFDMILMSPPCQPFTRLQKLPKYILLENVKGFEVSSTRDLLIQTIENCGFQYQEFLLSPTSLGIPNSRLRYFLIAKLQSEPLPFQA

SEQ ID NO: 92795 - protein, 467 aa, Homo sapiens
  Payload ID: 18553
  Gene Name: tRNA isopentenyltransferase 1
  Uniprot ID: Q9H3H1
  ENSP ID: ENSP00000321810
MASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKPQEMGTEKVIDRKVELEKEDGLVLHKRLSQVDPEMAAKLHPHDKRKVARSLQVFEETGISHSEFLHRQHTEEGGGPLGGPLKFSNPCILWLHADQAVLDERLDKRVDDMLAAGLLEELRDFHRRYNQKNVSENSQDYQHGIFQSIGFKEFHEYLITEGKCTLETSNQLLKKGIEALKQVTKRYARKQNRWVKNRFLSRPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 92796 - protein, 441 aa, Homo sapiens
  Payload ID: 18553
  Gene Name: tRNA isopentenyltransferase 1
  Uniprot ID: Q9H3H1
  ENSP ID: ENSP00000361905
MASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKPQEMGTEKVIDRKVELEKEDGLVLHKRLSQVDPEMAAKLHPHDKRKVARSLQVFEETGISHSEFLHRQHTEEGGGPLGGPLKFSNPCILWLHADQAVLDERLDKRVDDMLAAGLLEELRDFHRRYNQKNVSENSQDYQHGIFQSIGFKEFHEYLITEGKCTLETSNQLLKKGPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 92797 - protein, 385 aa, Homo sapiens
  Payload ID: 18553
  Gene Name: tRNA isopentenyltransferase 1
  Uniprot ID: Q9H3H1
  ENSP ID: ENSP00000388333
MASVAAARAVPVGSGLRGLQRTLPLVVILGATGTGKSTLALQLGQRLGGEIVSADSMQPQEMGTEKVIDRKVELEKEDGLVLHKRLSQVDPEMAAKLHPHDKRKVARSLQVFEETGISHSEFLHRQHTEEGGGPLGGPLKFSNPCILWLHADQADERLDKRVDDMLAAGLLEELRDFHRRYNQKNVSENSQDYQHGIFQSIGFKEFHEYLITEGKCTLETSNQLLKKGIEALKQVTKRYARKQNRWVKNRFLSRPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 92798 - protein, 163 aa, Homo sapiens
  Payload ID: 18553
  Gene Name: tRNA isopentenyltransferase 1
  Uniprot ID: Q9H3H1
  ENSP ID: ENSP00000437700
MFRKIGIEALKQVTKRYARKQNRWVKNRFLSRPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 92799 - protein, 85 aa, Homo sapiens
  Payload ID: 18553
  Gene Name: tRNA isopentenyltransferase 1
  ENSP ID: ENSP00000437896
MPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 92800 - protein, 140 aa, Homo sapiens
  Payload ID: 18553
  Gene Name: tRNA isopentenyltransferase 1
  ENSP ID: ENSP00000473708
  MOD_RES (1)..(1): Any amino acid
XAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKELASF

SEQ ID NO: 92801 - protein, 143 aa, Homo sapiens
  Payload ID: 18553
  Gene Name: tRNA isopentenyltransferase 1
  ENSP ID: ENSP00000473745
MASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKELASF

SEQ ID NO: 92802 - protein, 349 aa, Homo sapiens
  Payload ID: 18553
  Gene Name: tRNA isopentenyltransferase 1
  ENSP ID: ENSP00000473773
MASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKPQEMGTEKVIDRKVELEKEDGLVLHKRLSQVDPEMAAKLHPHDKRKVARSLQVFEETGISHSEFLHRQHTEEGGGPLGGPLKFSNPCILWLHADQAVLDERLDKRVDDMLAAGLLEELRDFHRRYNQKNVSENSQDYQHGIFQSIGFKEFHEYLITEGKCTLETSNQLLKKGIEALKQVTKRYARKQNRWVKNRFLSRPQAYSHSNKDAIQ

SEQ ID NO: 92803 - protein, 81 aa, Homo sapiens
  Payload ID: 18553
  Gene Name: tRNA isopentenyltransferase 1
  ENSP ID: ENSP00000474151
  MOD_RES (1)..(1): Any amino acid
XARAVPVGSGLRGLQRTLPLVVILGATGTGKSTLALQLGQRLGGEIVSADSMQFWIPQKLESDQDPVGLLIPLGLCLSMKA

SEQ ID NO: 92804 - protein, 63 aa, Homo sapiens
  Payload ID: 18553
  Gene Name: tRNA isopentenyltransferase 1
  ENSP ID: ENSP00000474264
MASVAAARAVPVGSGLRGLQRTLPLVVILGATGTGKSTLALQLGQRLGGEIVSADSMQELASF

SEQ ID NO: 92805 - protein, 170 aa, Homo sapiens
  Payload ID: 18553
  Gene Name: tRNA isopentenyltransferase 1
  ENSP ID: ENSP00000474768
IITNKVSAQEQRICRHHMISFVDPLVTNYTVVDFRNRATALIEDIFARDKIPIVVGGTNYYIESLLWKVLVNTKPQEMGTEKVIDRKVELEKEDGLVLHKRLSQVDPEMAAKLHPHDKRKVARSLQVFEETGISHSEFLHRQHTEEGGGPLGGPLKFSNPCILWLHADQF

SEQ ID NO: 92806 - protein, 630 aa, Homo sapiens
  Payload ID: 18554
  Gene Name: tRNA methyltransferase 1
  Uniprot ID: Q9NXH9
  ENSP ID: ENSP00000221504
MQGSSLWLSLTFRSARVLSRARFFEWQSPGLPNTAAMENGTGPYGEERPREVQETTVTEGAAKIAFPSANEVFYNPVQEFNRDLTCAVITEFARIQLGAKGIQIKVPGEKDTQKVVVDLSEQEEEKVELKESENLASGDQPRTAAVGEICEEGLHVLEGLAASGLRSIRFALEVPGLRSVVANDASTRAVDLIRRNVQLNDVAHLVQPSQADARMLMYQHQRVSERFDVIDLDPYGSPATFLDAAVQAVSEGGLLCVTCTDMAVLAGNSGETCYSKYGAMALKSRACHEMALRIVLHSLDLRANCYQRFVVPLLSISADFYVRVFVRVFTGQAKVKASARAKFSAACGPPVTPECEHCGQRHQLGGPMWAEPIHDLDFVGRVLEAVSANPGRFHTSERIRGVLSVITEELPDVPLYYTLDQLSSTIHCNTPSLLQLRSALLHADFRVSLSHACKNAVKTDAPASALWDIMRCWEKECPVKRERLSETSPAFRILSVEPRLQANFTIREDANPSSRQRGLKRFQANPEANWGPRPRARPGGKAADEAMEERRRLLQNKRKEPPEDVAQRAARLKTFPCKRFKEGTCQRGDQCCYSHSPPTPRVSADAAPDCPETSNQTPPGPGAAAGPGID

SEQ ID NO: 92807 - protein, 659 aa, Homo sapiens
  Payload ID: 18554
  Gene Name: tRNA methyltransferase 1
  Uniprot ID: Q9NXH9
  ENSP ID: ENSP00000350352
MQGSSLWLSLTFRSARVLSRARFFEWQSPGLPNTAAMENGTGPYGEERPREVQETTVTEGAAKIAFPSANEVFYNPVQEFNRDLTCAVITEFARIQLGAKGIQIKVPGEKDTQKVVVDLSEQEEEKVELKESENLASGDQPRTAAVGEICEEGLHVLEGLAASGLRSIRFALEVPGLRSVVANDASTRAVDLIRRNVQLNDVAHLVQPSQADARMLMYQHQRVSERFDVIDLDPYGSPATFLDAAVQAVSEGGLLCVTCTDMAVLAGNSGETCYSKYGAMALKSRACHEMALRIVLHSLDLRANCYQRFVVPLLSISADFYVRVFVRVFTGQAKVKASASKQALVFQCVGCGAFHLQRLGKASGVPSGRAKFSAACGPPVTPECEHCGQRHQLGGPMWAEPIHDLDFVGRVLEAVSANPGRFHTSERIRGVLSVITEELPDVPLYYTLDQLSSTIHCNTPSLLQLRSALLHADFRVSLSHACKNAVKTDAPASALWDIMRCWEKECPVKRERLSETSPAFRILSVEPRLQANFTIREDANPSSRQRGLKRFQANPEANWGPRPRARPGGKAADEAMEERRRLLQNKRKEPPEDVAQRAARLKTFPCKRFKEGTCQRGDQCCYSHSPPTPRVSADAAPDCPETSNQTPPGPGAAAGPGID

SEQ ID NO: 92808 - protein, 659 aa, Homo sapiens; identical to SEQ ID NO: 92807
  Payload ID: 18554
  Gene Name: tRNA methyltransferase 1
  Uniprot ID: Q9NXH9
  ENSP ID: ENSP00000416149

SEQ ID NO: 92809 - protein, 191 aa, Homo sapiens
  Payload ID: 18554
  Gene Name: tRNA methyltransferase 1
  ENSP ID: ENSP00000465370
MLMYQHQRVSERFDVIDLDPYGSPATFLDAAVQAVSEGGLLCVTCTDMAVLAGNSGETCYSKYGAMALKSRACHEMALRIVLHSLDLRANCYQRFVVPLLSISADFYVRVFVRVFTGQAKVKASASKQALVFQCVGCGAFHLQRLGKASGVPSGRAKFSAACGPPVTPECEHCGQRHQLGGPMWAEPIHDL

SEQ ID NO: 92810 - protein, 101 aa, Homo sapiens
  Payload ID: 18554
  Gene Name: tRNA methyltransferase 1
  ENSP ID: ENSP00000466716
RIQLGAKGIQIKVPGEKDTQKVVVDLSEQEEEKVELKESENLASGDQPRTAAVGEICERCLGSDLWLQTMPPPGLWISYAGMSSSMTWPTWYSRAKQMPGC

SEQ ID NO: 92811 - protein, 105 aa, Homo sapiens
  Payload ID: 18554
  Gene Name: tRNA methyltransferase 1
  ENSP ID: ENSP00000466966
MQGSSLWLSLTFRSARVLSRARFFEWQSPGLPNTAAMENGTGPYGEERPREVQETTVTEGAAKIAFPSANEVFYNPVQEFNRDLTKACMCWKAWQLQAYVPFDLP

SEQ ID NO: 92812 - protein, 659 aa, Homo sapiens; identical to SEQ ID NO: 92807
  Payload ID: 18554
  Gene Name: tRNA methyltransferase 1
  Uniprot ID: Q9NXH9
  ENSP ID: ENSP00000466967

SEQ ID NO: 92813 - protein, 297 aa, Homo sapiens
  Payload ID: 18554
  Gene Name: tRNA methyltransferase 1
  ENSP ID: ENSP00000467938
MQGSSLWLSLTFRSARVLSRARFFEWQSPGLPNTAAMENGTGPYGEERPREVQETTVTEGAAKIAFPSANEVFYNPVQEFNRDLTCAVITEFARIQLGAKGIQIKVPGEKDTQKVVVDLSEQEEEKVELKESENLASGDQPRTAAVGEICEEGLHVLEGLAASGLRSIRFALEVPGLRSVVANDASTRAVDLIRRNVQLNDVAHLVQPSQADARMLMYQHQRVSERFDVIDLDPYGSPATFLDAAVQAALRIVLHSLDLRANCYQRFVVPLLSISADFYVRVFVRVFTGQAKVKASA

SEQ ID NO: 92814 - protein, 145 aa, Homo sapiens
  Payload ID: 18554
  Gene Name: tRNA methyltransferase 1
  ENSP ID: ENSP00000467984
MQGSSLWLSLTFRSARVLSRARFFEWQSPGLPNTAAMENGTGPYGEERPREVQETTVTEGAAKIAFPSANEVFYNPVQEFNRDLTCAVITEFARIQLGAKGIQSEWRSRLLVGGGHTSLSPCLGSSAAQIQRGFSHIAGPGFCSF

SEQ ID NO: 92815 - protein, 85 aa, Homo sapiens
  Payload ID: 18554
  Gene Name: tRNA methyltransferase 1
  ENSP ID: ENSP00000468031
MQGSSLWLSLTFRSARVLSRARFFEWQSPGLPNTAAMENGTGPYGEERPREVQETTVTEGAAKIAFPSANEVFYNPVQEFNRDLT

SEQ ID NO: 92816 - protein, 113 aa, Homo sapiens
  Payload ID: 18554
  Gene Name: tRNA methyltransferase 1
  ENSP ID: ENSP00000468377
MQGSSLWLSLTFRSARVLSRARFFEWQSPGLPNTAAMENGTGPYGEERPREVQETTVTEGAAKIAFPSANEMCCDHRVCSHSAWGQRNPDQGSRREGHAKSGRGLVRARGGKG

SEQ ID NO: 92817 - protein, 339 aa, Homo sapiens
  Payload ID: 18555
  Gene Name: tRNA methyltransferase 10A
  Uniprot ID: Q8TBZ6
  ENSP ID: ENSP00000273962
MSSEMLPAFIETSNVDKKQGINEDQEESQKPRLGEGCEPISKRQMKKLIKQKQWEEQRELRKQKRKEKRKRKKLERQCQMEPNSDGHDRKRVRRDVVHSTLRLIIDCSFDHLMVLKDIKKLHKQIQRCYAENRRALHPVQFYLTSHGGQLKKNMDENDKGWVNWKDIHIKPEHYSELIKKEDLIYLTSDSPNILKELDESKAYVIGGLVDHNHHKGLTYKQASDYGINHAQLPLGNFVKMNSRKVLAVNHVFEIILEYLETRDWQEAFFTILPQRKGAVPTDKACESASHDNQSVRMEEGGSDSDSSEEEYSRNELDSPHEEKQDKENHTESTVNSLPH

SEQ ID NO: 92818 - protein, 339 aa, Homo sapiens; identical to SEQ ID NO: 92817
  Payload ID: 18555
  Gene Name: tRNA methyltransferase 10A
  Uniprot ID: Q8TBZ6
  ENSP ID: ENSP00000378342

SEQ ID NO: 92819 - protein, 339 aa, Homo sapiens; identical to SEQ ID NO: 92817
  Payload ID: 18555
  Gene Name: tRNA methyltransferase 10A
  Uniprot ID: Q8TBZ6
  ENSP ID: ENSP00000378343

SEQ ID NO: 92820 - protein, 205 aa, Homo sapiens
  Payload ID: 18555
  Gene Name: tRNA methyltransferase 10A
  ENSP ID: ENSP00000397551
MSSEMLPAFIETSNVDKKQGINEDQEESQKPRLGEGCEPISKRQMKKLIKQKQWEEQRELRKQKRKEKRKRKKLERQCQMEPNSDGHDRKRVRRDVVHSTLRLIIDCSFDHLMVLKDIKKLHKQIQRCYAENRRALHPVQFYLTSHGGQLKKNMDENDKGWVNWKDIHIKPEHYSELIKKEDLIYLTSDSPNILKELDESKAYVI

SEQ ID NO: 92821 - protein, 199 aa, Homo sapiens
  Payload ID: 18555
  Gene Name: tRNA methyltransferase 10A
  ENSP ID: ENSP00000423628
MSSEMLPAFIETSNVDKKQGINEDQEESQKPRLGEGCEPISKRQMKKLIKQKQWEEQRELRKQKRKEKRKRKKLERQCQMEPNSDGHDRKRVRRDVVHSTLRLIIDCSFDHLMVLKDIKKLHKQIQRCYAENRRALHPVQFYLTSHGGQLKKNMDENDKGWVNWKDIHIKPEHYSELIKKEDLIYLTSDSPNILKELDE

SEQ ID NO: 92822 - protein, 316 aa, Homo sapiens
  Payload ID: 18556
  Gene Name: tRNA methyltransferase 10B
  Uniprot ID: Q6PF06
  ENSP ID: ENSP00000297994
MDWKLEGSTQKVESPVLQGQEGILEETGEDGLPEGFQLLQIDAEGECQEGEILATGSTAWCSKNVQRKQRHWEKIVAAKKSKRKQEKERRKANRAENPGICPQHSKRFLRALTKDKLLEAKHSGPRLCIDLSMTHYMSKKELSRLAGQIRRLYGSNKKADRPFWICLTGFTTDSPLYEECVRMNDGFSSYLLDITEEDCFSLFPLETLVYLTPDSEHALEDVDLNKVYILGGLVDESIQKKVTFQKAREYSVKTARLPIQEYMVRNQNGKNYHSEILAINQVFDILSTYLETHNWPEALKKGVSSGKGYILRNSVE

SEQ ID NO: 92823 - protein, 229 aa, Homo sapiens
  Payload ID: 18556
  Gene Name: tRNA methyltransferase 10B
  Uniprot ID: Q6PF06
  ENSP ID: ENSP00000366982
MDWKLEGSTQKVESPVLQGQEGILEETGEDGLPEGFQLLQIDAEGECQEGEILATGSTAWCSELSRLAGQIRRLYGSNKKADRPFWICLTGFTTDSPLYEECVRMNDGFSSYLLDITEEDCFSLFPLETLVYLTPDSEHALEDVDLNKVYILGGLVDESIQKKVTFQKAREYSVKTARLPIQEYMVRNQNGKNYHSEILAINQETHNWPEALKKGVSSGKGYILRNSVE

SEQ ID NO: 92824 - protein, 221 aa, Homo sapiens
  Payload ID: 18556
  Gene Name: tRNA methyltransferase 10B
  Uniprot ID: Q6PF06
  ENSP ID: ENSP00000366983
MVLGICPQHSKRFLRALTKDKLLEAKHSGPRLCIDLSMTHYMSKKELSRLAGQIRRLYGSNKKADRPFWICLTGFTTDSPLYEECVRMNDGFSSYLLDITEEDCFSLFPLETLVYLTPDSEHALEDVDLNKVYILGGLVDESIQKKVTFQKAREYSVKTARLPIQEYMVRNQNGKNYHSEILAINQVFDILSTYLETHNWPEALKKGVSSGKGYILRNSVE

SEQ ID NO: 92825 - protein, 174 aa, Homo sapiens
  Payload ID: 18556
  Gene Name: tRNA methyltransferase 10B
  Uniprot ID: Q6PF06
  ENSP ID: ENSP00000437395
MDWKLEGSTQKVESPVLQGQEGILEETGEDGLPEGFQLLQIDAEGECQEGEILATGSTAWCSKNVQRKQRHWEKIVAAKKSKRKQEKERRKANRAENPGICPQHSKRFLRALTKDKLLEAKHSGPRLCIDLSMTHYMSKKVEHPLSLEFLLAMREAQKGTAFRRIWSTPASGIP

SEQ ID NO: 92826 - protein, 141 aa, Homo sapiens
  Payload ID: 18556
  Gene Name: tRNA methyltransferase 10B
  ENSP ID: ENSP00000444612
MDWKLEGSTQKVESPVLQGQEGILEETGEDGLPEGFQLLQIDAEGECQEGEILATGSTAWCSKNVQRKQRHWEKIVAAKKSKRKQEKERRKANRAENPGICPQHSKRFLRALTKDKLLEAKHSGPRLCIDLSMTHYMSKKT

SEQ ID NO: 92827 - protein, 256 aa, Homo sapiens
  Payload ID: 18556
  Gene Name: tRNA methyltransferase 10B
  Uniprot ID: Q6PF06
  ENSP ID: ENSP00000444997
MDWKLEGSTQKVESPVLQGQEGILEETGEDGLPEGFQLLQIDAEGECQEGEILATGSTAWCSKNVQRKQRHWEKIVAAKKSKRKQEKERRKANRAENPGICPQHSKRFLRALTKDKLLEAKHSGPRLCIDLSMTHYMSKKLDITEEDCFSLFPLETLVYLTPDSEHALEDVDLNKVYILGGLVDESIQKKVTFQKAREYSVKTARLPIQEYMVRNQNGKNYHSEILAINQETHNWPEALKKGVSSGKGYILRNSVE

SEQ ID NO: 92828 - protein, 72 aa, Homo sapiens
  Payload ID: 18556
  Gene Name: tRNA methyltransferase 10B
  ENSP ID: ENSP00000445362
MDWKLEGSTQKVESPVLQGQEGILEETGEDGLPEGFQLLQIDAEGECQEGEILATGSTAWCSAFAPSTANVS

SEQ ID NO: 92829 - protein, 72 aa, Homo sapiens
  Payload ID: 18556
  Gene Name: tRNA methyltransferase 10B
  ENSP ID: ENSP00000446050
MDWKLEGSTQKVESPVLQGQEGILEETGEDGLPEGFQLLQIDAEGECQEGEILATGSTAWCSFSNNFVFWII

SEQ ID NO: 92830 - protein, 403 aa, Homo sapiens
  Payload ID: 18557
  Gene Name: tRNA methyltransferase 10C, mitochondrial RNase P subunit
  Uniprot ID: Q7L0Y3
  ENSP ID: ENSP00000312356
MAAFLKMSVSVNFFRPFTRFLVPFTLHRKRNNLTILQRYMSSKIPAVTYPKNESTPPSEELELDKWKTTMKSSVQEECVSTISSSKDEDPLAATREFIEMWRLLGREVPEHITEEELKTLMECVSNTAKKKYLKYLYTKEKVKKARQIKKEMKAAAREEAKNIKLLETTEEDKQKNFLFLRLWDRNMDIAMGWKGAQAMQFGQPLVFDMAYENYMKRKELQNTVSQLLESEGWNRRNVDPFHIYFCNLKIDGALHRELVKRYQEKWDKLLLTSTEKSHVDLFPKDSIIYLTADSPNVMTTFRHDKVYVIGSFVDKSMQPGTSLAKAKRLNLATECLPLDKYLQWEIGNKNLTLDQMIRILLCLKNNGNWQEALQFVPKRKHTGFLEISQHSQEFINRLKKAKT

SEQ ID NO: 92831 - protein, 312 aa, Homo sapiens
  Payload ID: 18557
  Gene Name: tRNA methyltransferase 10C, mitochondrial RNase P subunit
  ENSP ID: ENSP00000419389
MAAFLKMSVSVNFFRPFTRFLVPFTLHRKRNNLTILQRYMSSKIPAVTYPKNESTPPSEELELDKWKTTMKSSVQEECVSTISSSKDEDPLAATREFIEMWRLLGREVPEHITEEELKTLMECVSNTAKKKYLKYLYTKEKVKKARQIKKEMKAAAREEAKNIKLLETTEEDKQKNFLFLRLWDRNMDIAMGWKGAQAMQFGQPLVFDMAYENYMKRKELQNTVSQLLESEGWNRRNVDPFHIYFCNLKIDGALHRELVKRYQEKWDKLLLTSTEKSHVDLFPKDSIIYLTADSPNVMTTFRHDKVYVIGSF

SEQ ID NO: 92832 - protein, 463 aa, Homo sapiens
  Payload ID: 18558
  Gene Name: tRNA methyltransferase 11 homolog
  Uniprot ID: Q7Z4G4
  ENSP ID: ENSP00000333934
MALSCTLNRYLLLMAQEHLEFRLPEIKSLLLLFGGQFASSQETYGKSPFWILSIPSEDIARNLMKRTVCAKSIFELWGHGQSPEELYSSLKNYPVEKMVPFLHSDSTYKIKIHTFNKTLTQEEKIKRIDALEFLPFEGKVNLKKPQHVFSVLEDYGLDPNCIPENPHNIYFGRWIADGQRELIESYSVKKRHFIGNTSMDAGLSFIMANHGKVKENDIVFDPFVGTGGLLIACAHFGAYVYGTDIDYNTVHGLGKATRKNQKWRGPDENIRANLRQYGLEKYYLDVLVSDASKPSWRKGTYFDAIITDPPYGIRESTRRTGSQKEIPKGIEKWEKCPESHVPVSLSYHLSDMFLDLLNFAAETLVLGGRLVYWLPVYTPEYTEEMVPWHPCLELVSNCEQKLSSHTSRRLITMEKVKKFENRDQYSHLLSDHFLPYQGHNSFREKYFSGVTKRIAKEEKSTQE

SEQ ID NO: 92833 - protein, 458 aa, Homo sapiens
  Payload ID: 18558
  Gene Name: tRNA methyltransferase 11 homolog
  Uniprot ID: Q7Z4G4
  ENSP ID: ENSP00000357316
MALSCTLNRYLLLMAQEHLEFRLPEIKSLLLLFGGQFASSQETYGKSPFWILSIPSEDIARNLMKRTVCAKSIFELWGHGQSPEELYSSLKNYPVEKMVPFLHSDSTYKIKIHTFNKTLTQEEKIKRIDALEFLPFEGKVNLKKPQHVFSVLEDYGLDPNCIPENPHNIYFGRWIADGQRELIESYSVKKRHFIGNTSMDAGLSFIMANHGKVKENDIVFDPFVGTGGLLIACAHFGAYVYGTDIDYNTVHGLGKATRKNQKWRGPDENIRANLRQYGLEKYYLDVLVSDASKPSWRKGTYFDAIITDPPYGIRESTRRTGSQKEIPKGIEKWEKCPESHVPVSLSYHLSDMFLDLLNFAAETLVLGGRLVYWLPVYTPEYTEEMVPWHPCLELVSNCEQKLSSHTSRRLITMEKNRDQYSHLLSDHFLPYQGHNSFREKYFSGVTKRIAKEEKSTQE

SEQ ID NO: 92834 - protein, 93 aa, Homo sapiens
  Payload ID: 18558
  Gene Name: tRNA methyltransferase 11 homolog
  ENSP ID: ENSP00000406230
MKRTVCAKSIFELWGHGQSPEELYSSLKNYPVEKMVPFLHSDSTYKIKIHTFNKTLTQEEKIKRIDALEFLPFEGKVNLKKPQHVFSVLEDYG

SEQ ID NO: 92835 - protein, 131 aa, Homo sapiens
  Payload ID: 18558
  Gene Name: tRNA methyltransferase 11 homolog
  ENSP ID: ENSP00000410498
  MOD_RES (1)..(1): Any amino acid
XLSFIMANHGKVKENDIVFDPFVGTGGLLIACAHFGAYVYGTDIDYNTVHGLGKATRKNQKWRGPDENIRANLRQYGLEKYYLDVLVSDASKPSWRKGTYFDAIITDPPYGIRESTRRTGSQKEIPKGIEK

SEQ ID NO: 92836 - protein, 134 aa, Homo sapiens
  Payload ID: 18558
  Gene Name: tRNA methyltransferase 11 homolog
  ENSP ID: ENSP00000415724
MKRTVCAKSIFELWGHGQSPEELYSSLKNYPVEKMVPFLHSDSTYKIKIHTFNKTLTQEEKIKRIDALEFLPFEGKVNLKKPQHVFSVLEDYGLDPNCIPENPHNIYFGRWIADGQRELIESYSVKKRHFIGNT

SEQ ID NO: 92837 - protein, 257 aa, Homo sapiens
  Payload ID: 18558
  Gene Name: tRNA methyltransferase 11 homolog
  Uniprot ID: Q7Z4G4
  ENSP ID: ENSP00000433724
MALSCTLNRYLLLMAQEHLEFRLPEIKSLLLLFGGQFASSQETYGKSPFWILSIPSEDIARNLMKRTVCAKSIFELWGHGQSPEELYSSLKNYPVEKMVPFLHSDSTYKIKIHTFNKTLTQEEKIKRIDALEFLPFEGKVNLKKPQHVFSVLEDYGLDPNCIPENPHNIYFGRWIADGQRELIESYSVKKRHFIGNTSMDAGLSFIMANHGKVKENDIVFDPFVGTGGLLIACAHFGAYVYGTDIDYNTVHGLACST

SEQ ID NO: 92838 - protein, 86 aa, Homo sapiens
  Payload ID: 18558
  Gene Name: tRNA methyltransferase 11 homolog
  ENSP ID: ENSP00000465275
MALSCTLNRYLLLMAQEHLEFRLPFASSQETYGKSPFWILSIPSEDIARNLMKRTVCAKSIFELWGHGQSPEELYSSLKNYPVEKM

SEQ ID NO: 92839 - protein, 4 aa, Homo sapiens
  Payload ID: 18558
  Gene Name: tRNA methyltransferase 11 homolog
  ENSP ID: ENSP00000466001
  MOD_RES (1)..(1): Any amino acid
XVYL

SEQ ID NO: 92840 - protein, 230 aa, Homo sapiens
  Payload ID: 18558
  Gene Name: tRNA methyltransferase 11 homolog
  ENSP ID: ENSP00000467035
MALSCTLNRYLLLMAQEHLEFRLPEIKSLLLLFGGQFASSQETYGKSPFWILSIPSEDIARNLMKRTVCAKSIFELWGHGQSPEELYSSLKNYPVEKMVPFLHSDSTYKIKIHTFNKTLTQEEKIKRIDALEFLPFEGKVNLKKPQHVFSVLEDYGLDPNCIPENPHNIYFGRWIADGQRELIESYSVKKRHFIGNTSMDAGLSFIMANHGKVKENDIVFDPFVGTAVYL

SEQ ID NO: 92841 - protein, 82 aa, Homo sapiens
  Payload ID: 18558
  Gene Name: tRNA methyltransferase 11 homolog
  ENSP ID: ENSP00000467603
MALSCTLNRYLLLMAQEHLEFRLPEIKSLLLLFGGQFASSQETYGKSPFWILSIPSEDIARNLMKRTVCAKFHFYIRTLHIK

SEQ ID NO: 92842 - protein, 120 aa, Homo sapiens
  Payload ID: 18559
  Gene Name: tRNA methyltransferase 11-2 homolog (S. cerevisiae)
  Uniprot ID: Q9UI30
  ENSP ID: ENSP00000309433
MKLLTHNLLSSHVRGVGSRGFPLRLQATEVRICPVEFNPNFVARMIPKVEWSAFLEAADNVPKGPVEGYEENEEFLRTMHHLLLEVEVIEGTLQCPESGRMFPISRGIPNMLLSEEETES

SEQ ID NO: 92843 - protein, 125 aa, Homo sapiens
  Payload ID: 18559
  Gene Name: tRNA methyltransferase 11-2 homolog (S. cerevisiae)
  Uniprot ID: Q9UI30
  ENSP ID: ENSP00000438349
MKLLTHNLLSSHVRGVGSRGFPLRLQATEVRICPVEFNPNFVARMIPKVEWSAFLEAADNLRLIQVPKGPVEGYEENEEFLRTMHHLLLEVEVIEGTLQCPESGRMFPISRGIPNMLLSEEETES

SEQ ID NO: 92844 - protein, 106 aa, Homo sapiens
  Payload ID: 18559
  Gene Name: tRNA methyltransferase 11-2 homolog (S. cerevisiae)
  ENSP ID: ENSP00000440437
MKLLTHNLLSSHVRGVGSRGFPLRLQATEVRICPVEFNPNFVARMIPKVEWSAFLEAADNLRLIQVPKGPVEGYEENEEFLRTMHHLLLEVRSGPSLASRATCLPH

SEQ ID NO: 92845 - protein, 81 aa, Homo sapiens
  Payload ID: 18559
  Gene Name: tRNA methyltransferase 11-2 homolog (S. cerevisiae)
  ENSP ID: ENSP00000441279
MIPKVEWSAFLEAADNLRLIQVPKGPVEGYEENEEFLRTMHHLLLEVEVIEGTLQCPESGRMFPISRGIPNMLLSEEETES

SEQ ID NO: 92846 - protein, 63 aa, Homo sapiens
  Payload ID: 18559
  Gene Name: tRNA methyltransferase 11-2 homolog (S. cerevisiae)
  ENSP ID: ENSP00000444082
MCGGWGPVASPCASRYPPAAVFPFRAGWWAGVQCLPKLLRPAGHRGPYLPCGIQPQLRGAYDT

SEQ ID NO: 92847 - protein, 448 aa, Homo sapiens
  Payload ID: 18560
  Gene Name: tRNA methyltransferase 12 homolog (S. cerevisiae)
  Uniprot ID: Q53H54
  ENSP ID: ENSP00000329858
MRENVVVSNMERESGKPVAVVAVVTEPWFTQRYREYLQRQKLFDTQHRVEKMPDGSVALPVLGETLPEQHLQELRNRVAPGSPCMLTQLPDPVPSKRAQGCSPAQKLCLEVSRWVEGRGVKWSAELEADLPRSWQRHGNLLLLSEDCFQAKQWKNLGPELWETVALALGVQRLAKRGRVSPDGTRTPAVTLLLGDHGWVEHVDNGIRYKFDVTQCMFSFGNITEKLRVASLSCAGEVLVDLYAGIGYFTLPFLVHAGAAFVHACEWNPHAVVALRNNLEINGVADRCQIHFGDNRKLKLSNIADRVILGLIPSSEEGWPIACQVLRQDAGGILHIHQNVESFPGKNLQALGVSKVEKEHWLYPQQITTNQWKNGATRDSRGKMLSPATKPEWQRWAESAETRIATLLQQVHGKPWKTQILHIQPVKSYAPHVDHIVLDLECCPCPSVG

SEQ ID NO: 92848 - protein, 150 aa, Homo sapiens
  Payload ID: 18560
  Gene Name: tRNA methyltransferase 12 homolog (S. cerevisiae)
  ENSP ID: ENSP00000429771
MRENVVVSNMERESGKPVAVVAVVTEPWFTQRYREYLQRQKLFDTQHRVEKMPDGSVALPVLGETLPEQHLQELRNRVAPGSPCMLTQLPDPVPSKRAQGCSPAQKLCLEQVHGKPWKTQILHIQPVKSYAPHVDHIVLDLECCPCPSVG

SEQ ID NO: 92849 - protein, 130 aa, Homo sapiens
  Payload ID: 18561
  Gene Name: tRNA methyltransferase 13 homolog (S. cerevisiae)
  ENSP ID: ENSP00000359158
MVVAAGKRFCGEHAGAAEEEDARKRILCPLDPKHTVYEDQLAKHLKKCNSREKPKPDFYIQDINAGLRDETEIPEQLVPISSLSEEQLEKLIKKLRKASEALHDALNDPKNGDSATKHLKQQVCLGYSNY

SEQ ID NO: 92850 - protein, 481 aa, Homo sapiens
  Payload ID: 18561
  Gene Name: tRNA methyltransferase 13 homolog (S. cerevisiae)
  Uniprot ID: Q9NUP7
  ENSP ID: ENSP00000359160
MATSATSPHAPGFPAEGRCGYYVEKKKRFCRMVVAAGKRFCGEHAGAAEEEDARKRILCPLDPKHTVYEDQLAKHLKKCNSREKPKPDFYIQDINAGLRDETEIPEQLVPISSLSEEQLEKLIKKLRKASEGLNSTLKDHIMSHPALHDALNDPKNGDSATKHLKQQASILGNIENLKLLGPRRCFVEFGAGKGKLSHWVDIALKDAEKVHFILVEKVTTRFKVDGKHRKKNSVFERLQIDIQHLCLNKIPVLREEKLPVVGIGKHLCGMATDLALRCLVETYAASFEERNEEPLAKRIKNDKTEKEIYTLAKEGNEKNVPEKWNPVAGIVIALCCHHRCDWRHYVGKEYFRALGLGAVEFHYFQRMSSWATCGMRKTSLETSNSTTKRQDNQNDDSEEHDDGGYRITDDGADCLPGLLSVEEKKKIGHLCKLLIDQGRIQYLQQKGFSPALQYYTDPLVSLENVLLTALPNHSSSPETTA

SEQ ID NO: 92851 - protein, 109 aa, Homo sapiens
  Payload ID: 18561
  Gene Name: tRNA methyltransferase 13 homolog (S. cerevisiae)
  ENSP ID: ENSP00000359162
MATSATSPHAPGFPAEGRCGYYVEKKKRFCRMVVAAGKRFCGEHAGAAEEEDARKRILCPLDPKHTVYEDQLAKHLKKCNSREKPKPDFYIQDINAGLRDETEIPEQLA

SEQ ID NO: 92852 - protein, 175 aa, Homo sapiens
  Payload ID: 18561
  Gene Name: tRNA methyltransferase 13 homolog (S. cerevisiae)
  Uniprot ID: Q9NUP7
  ENSP ID: ENSP00000432616
MATSATSPHAPGFPAEGRCGYYVEKKKRFCRMVVAAGKRFCGEHAGAAEEEDARKRILCPLDPKHTVYEDQLAKHLKKCNSREKPKPDFYIQDINAGLRDETEIPEQLVPISSLSEEQLEKLIKKLRKASEGLNSTLKDHIMSHPALHDALNDPKNGDSATKHLKQQVCLGYSNY

SEQ ID NO: 92853 - protein, 733 aa, Homo sapiens
  Payload ID: 18562
  Gene Name: tRNA methyltransferase 1-like
  Uniprot ID: Q7Z2T5
  ENSP ID: ENSP00000356476
MENMAEEELLPLEKEEVEVAQVQVPTPARDSAGVPAPAPDSALDSAPTPASAPAPAPALAQAPALSPSLASAPEEAKSKRHISIQRQLADLENLAFVTDGNFDSASSLNSDNLDAGNRQACPLCPKEKFRACNSHKLRRHLQNLHWKVSVEFEGYRMCICHLPCRPVKPNIIGEQITSKMGAHYHCIICSATITRRTDMLGHVRRHMNKGETKSSYIAASTAKPPKEILKEADTDVQVCPNYSIPQKTDSYFNPKMKLNRQLIFCTLAALAEERKPLECLDAFGATGIMGLQWAKHLGNAVKVTINDLNENSVTLIQENCHLNKLKVVVDSKEKEKSDDILEEGEKNLGNIKVTKMDANVLMHLRSFDFIHLDPFGTSVNYLDSAFRNIRNLGIVSVTSTDISSLYAKAQHVARRHYGCNIVRTEYYKELAARIVVAAVARAAARCNKGIEVLFAVALEHFVLVVVRVLRGPTSADETAKKIQYLIHCQWCEERIFQKDGNMVEENPYRQLPCNCHGSMPGKTAIELGPLWSSSLFNTGFLKRMLFESLHHGLDDIQTLIKTLIFESECTPQSQFSIHASSNVNKQEENGVFIKTTDDTTTDNYIAQGKRKSNEMITNLGKKQKTDVSTEHPPFYYNIHRHSIKGMNMPKLKKFLCYLSQAGFRVSRTHFDPMGVRTDAPLMQFKSILLKYSTPTYTGGQSESHVQSASEDTVTERVEMSVNDKAEASGCRRW

SEQ ID NO: 92854 - protein, 212 aa, Homo sapiens
  Payload ID: 18562
  Gene Name: tRNA methyltransferase 1-like
  ENSP ID: ENSP00000414339
TSVNYLDSAFRNIRNLGIVSVTSTDISSLYAKAQHVARRHYGCNIVRTEYYKELAARIVVAAVARAAARCNKGIEVLFAVALEHFVLVVVRVLRGPTSADETAKKIQYLIHCQWCEERIFQKDGNMVEENPYRQLPCNCHGSMPGKTAIELGPLWSSSLFNTGFLKRMLFESLHHGLDDIQTLIKTLIFESECTPQSQFSIHASSNVNKQGD

SEQ ID NO: 92855 - protein, 625 aa, Homo sapiens
  Payload ID: 18563
  Gene Name: tRNA methyltransferase 2 homolog A
  Uniprot ID: Q8IZ69
  ENSP ID: ENSP00000252136
MSENLDNEGPKPMESCGQESSSALSCPTVSVPPAAPAALEEVEKEGAGAATGPGPQPGLYSYIRDDLFTSEIFKLELQNVPRHASFSDVRRFLGRFGLQPHKTKLFGQPPCAFVTFRSAAERDKALRVLHGALWKGRPLSVRLARPKADPMARRRRQEGESEPPVTRVADVVTPLWTVPYAEQLERKQLECEQVLQKLAKEIGSTNRALLPWLLEQRHKHNKACCPLEGVRPSPQQTEYRNKCEFLVGVGVDGEDNTVGCRLGKYKGGTCAVAAPFDTVHIPEATKQVVKAFQEFIRSTPYSAYDPETYTGHWKQLTVRTSRRHQAMAIAYFHPQKLSPEELAELKTSLAQHFTAGPGRASGVTCLYFVEEGQRKTPSQEGLPLEHVAGDRCIHEDLLGLTFRISPHAFFQVNTPAAEVLYTVIQDWAQLDAGSMVLDVCCGTGTIGLALARKVKRVIGVELCPEAVEDARVNAQDNELSNVEFHCGRAEDLVPTLVSRLASQHLVAILDPPRAGLHSKVILAIRRAKNLRRLLYVSCNPRAAMGNFVDLCRAPSNRVKGIPFRPVKAVAVDLFPQTPHCEMLILFERVEHPNGTGVLGPHSPPAQPTPGPPDNTLQETGTFPSS

SEQ ID NO: 92856 - protein, 562 aa, Homo sapiens
  Payload ID: 18563
  Gene Name: tRNA methyltransferase 2 homolog A
  Uniprot ID: Q8IZ69
  ENSP ID: ENSP00000384968
MSENLDNEGPKPMESCGQESSSALSCPTVSVPPAAPAALEEVEKEGAGAATGPGPQPGLYSYIRDDLFTSEIFKLELQNVPRHASFSDVRRFLGRFGLQPHKTKLFGQPPCAFVTFRSAAERDKALRVLHGALWKGRPLSVRLARPKADPMARRRRQEGESEPPVTRVADVVTPLWTVPYAEQLERKQLECEQVLQKLAKEIGSTNRALLPWLLEQRHKHNKACCPLEGVRPSPQQTEYRNKCEFLVGVGVDGEDNTVGCRLGKYKGGTCAVAAPFDTVHIPEATKQVVKAFQEFIRSTPYSAYDPETYTGHWKQLTVRTSRRHQAMAIAYFHPQKLSPEELAELKTSLAQHFTAGPGRASGVTCLYFVEEGQRKTPSQEGLPLEHVAGDRCIHEDLLGLTFRISPHAFFQVNTPAAEVLYTVIQDWAQLDAGSMVLDVCCGTGTIGLALARKVKRVIGVELCPEAVEDARVNAQDNELSNVEFHCGRAEDLVPTLVSRLASQHLVAILDPPRAGLHSKVILAIRRAKNLRRLLYVSCNPRAAMGNFVDAPLFPPQPLQSPI

SEQ ID NO: 92857 - protein, 625 aa, Homo sapiens; identical to SEQ ID NO: 92855
  Payload ID: 18563
  Gene Name: tRNA methyltransferase 2 homolog A
  Uniprot ID: Q8IZ69
  ENSP ID: ENSP00000385807

SEQ ID NO: 92858 - protein, 142 aa, Homo sapiens
  Payload ID: 18563
  Gene Name: tRNA methyltransferase 2 homolog A
  ENSP ID: ENSP00000392261
  MOD_RES (1)..(1): Any amino acid
XEHTRSRGALHSHPGLGPIGCGEHGAGRVLWHRHHWPGPGPEGKEGHWGRAMPRGCGGRPGERPGQCLCRAPSNRVKGIPFRPVKAVAVDLFPQTPHCEMLILFERVEHPNGTGVLGPHSPPAQPTPGPPDNTLQETGTFPS

SEQ ID NO: 92859 - protein, 119 aa, Homo sapiens
  Payload ID: 18563
  Gene Name: tRNA methyltransferase 2 homolog A
  ENSP ID: ENSP00000393911
MESCGQESSSALSCPTVSVPPAAPAALEEVEKEGAGAATGPGPQPGLYSYIRDDLFTSEIFKLELQNVPRHASFSDVRRFLGRFGLQPHKTKLFGQPPCAFVTFRSAAERDKALRVLHG

SEQ ID NO: 92860 - protein, 643 aa, Homo sapiens
  Payload ID: 18563
  Gene Name: tRNA methyltransferase 2 homolog A
  ENSP ID: ENSP00000395738
MSENLDNEGPKPMESCGQESSSALSCPTVSVPPAAPAALEEVEKEGAGAATGPGPQPGLYSYIRDDLFTSEIFKLELQNVPRHASFSDVRRFLGRFGLQPHKTKLFGQPPCAFVTFRSAAERDKALRVLHGALWKGRPLSVRLARPKADPMARRRRQEGESEPPVTRVADVVTPLWTVPYAEQLERKQLECEQVLQKLAKEIGSTNRALLPWLLEQRHKHNKACCPLEGVRPSPQQTEYRNKCEFLVGVGVDGEDNTVGCRLGKYKGGTCAVAAPFDTVHIPEATKQVVKAFQEFIRSTPYSAYDPETYTGHWKQLTVRTSRRHQAMAIAYFHPQKLSPEELAELKTSLAQHFTAGPGRASGVTCLYFVEEGQRKTPSQEGLPLEHVAGDRCIHEDLLGLTFRISPHAFFQVNTPAAEVLYTVIQDWAQLDAGSMVLDVCCGTGTIGLALARGPMYSPPWVGRHHAFLFQKVKRVIGVELCPEAVEDARVNAQDNELSNVEFHCGRAEDLVPTLVSRLASQHLVAILDPPRAGLHSKVILAIRRAKNLRRLLYVSCNPRAAMGNFVDLCRAPSNRVKGIPFRPVKAVAVDLFPQTPHCEMLILFERVEHPNGTGVLGPHSPPAQPTPGPPDNTLQETGTFPSS

SEQ ID NO: 92861 - protein, 158 aa, Homo sapiens
  Payload ID: 18563
  Gene Name: tRNA methyltransferase 2 homolog A
  ENSP ID: ENSP00000397744
KVKRVIGVELCPEAVEDARVNAQDNELSNVEFHCGRAEDLVPTLVSRLASQHLVAILDPPRAGLHSKVILAIRRAKNLRRLLLCRAPSNRVKGIPFRPVKAVAVDLFPQTPHCEMLILFERVEHPNGTGVLGPHSPPAQPTPGPPDNTLQETGTFPSS

SEQ ID NO: 92862 - protein, 504 aa, Homo sapiens
  Payload ID: 18564
  Gene Name: tRNA methyltransferase 2 homolog B
  Uniprot ID: Q96GJ1
  ENSP ID: ENSP00000362026
MAGLKRRVPLHSLRYFISMVGLFSKPGLLPWYARNPPGWSQLFLGTVCKGDFTRVIATKCQKGQKSQKKPSHLGPLDGSWQERLADVVTPLWRLSYEEQLKVKFAAQKKILQRLESYIQMLNGVSVTTAVPKSERLSCLLHPIIPSPVINGYRNKSTFSVNRGPDGNPKTVGFYLGTWRDGNVVCVQSNHLKNIPEKHSQVAQYYEVFLRQSPLEPCLVFHEGGYWRELTVRTNSQGHTMAIITFHPQKLSQEELHVQKEIVKEFFIRGPGAACGLTSLYFQESTMTRCSHQQSPYQLLFGEPYIFEELLSLKIRISPDAFFQINTAGAEMLYRTVGELTGVNSDTILLDICCGTGVIGLSLAQHTSRVLGIELLEQAVEDARWTAAFNGITNSEFHTGQAEKILPGLLKSKEDGQSIVAVVNPARAGLHYKVIQAIRNFRAIHTLVFVSCKLHGESTRNVIELCCPPDPAKKLLGEPFVLQQAVPVDLFPHTPHCELVLLFTR

SEQ ID NO: 92863 - protein, 504 aa, Homo sapiens; identical to SEQ ID NO: 92862
  Payload ID: 18564
  Gene Name: tRNA methyltransferase 2 homolog B
  Uniprot ID: Q96GJ1
  ENSP ID: ENSP00000362027

SEQ ID NO: 92864 - protein, 459 aa, Homo sapiens
  Payload ID: 18564
  Gene Name: tRNA methyltransferase 2 homolog B
  Uniprot ID: Q96GJ1
  ENSP ID: ENSP00000362030
MAGLKRRVPLHSLRYFISMVGLFSKPGLLPWYARNPPGWSQLFLGTVCKGDFTRVIATKCQKGQKSQKKPSHLGPLDGSWQERLADVVTPLWRLSYEEQLKPVINGYRNKSTFSVNRGPDGNPKTVGFYLGTWRDGNVVCVQSNHLKNIPEKHSQVAQYYEVFLRQSPLEPCLVFHEGGYWRELTVRTNSQGHTMAIITFHPQKLSQEELHVQKEIVKEFFIRGPGAACGLTSLYFQESTMTRCSHQQSPYQLLFGEPYIFEELLSLKIRISPDAFFQINTAGAEMLYRTVGELTGVNSDTILLDICCGTGVIGLSLAQHTSRVLGIELLEQAVEDARWTAAFNGITNSEFHTGQAEKILPGLLKSKEDGQSIVAVVNPARAGLHYKVIQAIRNFRAIHTLVFVSCKLHGESTRNVIELCCPPDPAKKLLGEPFVLQQAVPVDLFPHTPHCELVLLFTR

SEQ ID NO: 92865 - protein, 504 aa, Homo sapiens; identical to SEQ ID NO: 92862
  Payload ID: 18564
  Gene Name: tRNA methyltransferase 2 homolog B
  Uniprot ID: Q96GJ1
  ENSP ID: ENSP00000438134

SEQ ID NO: 92866 - protein, 757 aa, Homo sapiens
  Payload ID: 18565
  Gene Name: tRNA methyltransferase 44 homolog (S. cerevisiae)
  Uniprot ID: Q8IYL2
  ENSP ID: ENSP00000374387
MAEVGRTGISYPGALLPQGFWAAVEVWLERPQVANKRLCGARLEARWSAALPCAEARGPGTSAGSEQKERGPGPGQGSPGGGPGPRSLSGPEQGTACCELEEAQGQCQQEEAQREAASVPLRDSGHPGHAEGREGDFPAADLDSLWEDFSQSLARGNSELLAFLTSSGAGSQPEAQRELDVVLRTVIPKTSPHCPLTTPRREIVVQDVLNGTITFLPLEEDDEGNLKVKMSNVYQIQLSHSKEEWFISVLIFCPERWHSDGIVYPKPTWLGEELLAKLAKWSVENKKSDFKSTLSLISIMKYSKAYQELKEKYKEMVKVWPEVTDPEKFVYEDVAIAAYLLILWEEERAERRLTARQSFVDLGCGNGLLVHILSSEGHPGRGIDVRRRKIWDMYGPQTQLEEDAITPNDKTLFPDVDWLIGNHSDELTPWIPVIAARSSYNCRFFVLPCCFFDFIGRYSRRQSKKTQYREYLDFIKEVGFTCGFHVDEDCLRIPSTKRVCLVGKSRTYPSSREASVDEKRTQYIKSRRGCPVSPPGWELSPSPRWVAAGSAGHCDGQQALDARVGCVTRAWAAEHGAGPQAEGPWLPGFHPREKAERVRNCAALPRDFIDQVVLQVANLLLGGKQLNTRSSRNGSLKTWNGGESLSLAEVANELDTETLRRLKRECGGLQTLLRNSHQVFQVVNGRVHIRDWREETLWKTKQPEAKQRLLSEACKTRLCWFFMHHPDGCALSTDCCPFAHGPAELRPPRTTPRKKIS

SEQ ID NO: 92867 - protein, 411 aa, Homo sapiens
  Payload ID: 18565
  Gene Name: tRNA methyltransferase 44 homolog (S. cerevisiae)
  Uniprot ID: Q8IYL2
  ENSP ID: ENSP00000424643
MCIKFSSVIAKKNERWHSDGIVYPKPTWLGEELLAKLAKWSVENKKSDFKSTLSLISIMKYSKAYQELKEKYKEMVKVWPEVTDPEKFVYEDVAIAAYLLILWEEERAERRLTARQSFVDLGCGNGLLVHILSSEGHPGRGIDVRRRKIWDMYGPQTQLEEDAITPNDKTLFPDVDWLIGNHSDELTPWIPVIAARSSYNCRFFVLPCCFFDFIGRYSRRQSKKTQYREYLDFIKEVGFTCGFHVDEDCLRIPSTKRVCLVGKSRTYPSSREASVDEKRTQYIKSRRGCPVSPPGWELSPSPRWVAAGSAGHCDGQQALDARVGCVTRAWAAEHGAGPQAEGPWLPGFHPREKAERVRNCAALPRDFIDQVVLQVANLLLGGKQLNTRSSRNGSLKTWNGGGKLSTILGRG

SEQ ID NO: 92868 - protein, 220 aa, Homo sapiens
  Payload ID: 18565
  Gene Name: tRNA methyltransferase 44 homolog (S. cerevisiae)
  ENSP ID: ENSP00000434207
  MOD_RES (1)..(1): Any amino acid
XSAALPCAEARGPGTSAGSEQKERGPGPGQGSPGGGPGPRSLSGPEQGTACCELEEAQGQCQQEEAQREAASVPLRDSGHPGHAEGREGDFPAADLDSLWEDFSQSLARGNSELLAFLTSSGAGSQPEAQRELDVVLRTVIPKTSPHCPLTTPRREIVVQERWHSDGIVYPKPTWLGEELLAKLAKWSVENKKSDFKSTLSLISIMKYSKAYQELKEKYK

SEQ ID NO: 92869 - protein, 509 aa, Homo sapiens
  Payload ID: 18566
  Gene Name: tRNA methyltransferase 5
  Uniprot ID: Q32P41
  ENSP ID: ENSP00000261249
MVLWILWRPFGFSGRFLKLESHSITESKSLIPVAWTSLTQMLLEAPGIFLLGQRKRFSTMPETETHERETELFSPPSDVRGMTKLDRTAFKKTVNIPVLKVRKEIVSKLMRSLKRAALQRPGIRRVIEDPEDKESRLIMLDPYKIFTHDSFEKAELSVLEQLNVSPQISKYNLELTYEHFKSEEILRAVLPEGQDVTSGFSRIGHIAHLNLRDHQLPFKHLIGQVMIDKNPGITSAVNKINNIDNMYRNFQMEVLSGEQNMMTKVRENNYTYEFDFSKVYWNPRLSTEHSRITELLKPGDVLFDVFAGVGPFAIPVAKKNCTVFANDLNPESHKWLLYNCKLNKVDQKVKVFNLDGKDFLQGPVKEELMQLLGLSKERKPSVHVVMNLPAKAIEFLSAFKWLLDGQPCSSEFLPIVHCYSFSKDANPAEDVRQRAGAVLGISLEACSSVHLVRNVAPNKEMLCITFQIPASVLYKNQTRNPENHEDPPLKRQRTAEAFSDEKTQIVSNT

SEQ ID NO: 92870 - protein, 152 aa, Homo sapiens
  Payload ID: 18566
  Gene Name: tRNA methyltransferase 5
  ENSP ID: ENSP00000451666
MVQGRYQPAQGCSLPCAAWAQKHREVTHPPRILWRPFGFSGRFLKLESHSITESKSLIPVAWTSLTQMLLEAPGIFLLGQRKRFSTMPETETHERETELFSPPSDVRGMTKLDRTAFKKTVNIPVLKVRKEIVSKLMRSLKRAALQRPGIRR

SEQ ID NO: 92871 - protein, 169 aa, Homo sapiens
  Payload ID: 18566
  Gene Name: tRNA methyltransferase 5
  ENSP ID: ENSP00000452567
MTRALFAANSDDVIEDPPIHPRPTSDRYRSGRILWRPFGFSGRFLKLESHSITESKSLIPVAWTSLTQMLLEAPGIFLLGQRKRFSTMPETETHERETELFSPPSDVRGMTKLDRTAFKKTVNIPVLKVRKEIVSKLMRSLKRAALQRPGIRRVIEDPEDKESRLIMLD

SEQ ID NO: 92872 - protein, 497 aa, Homo sapiens
  Payload ID: 18567
  Gene Name: tRNA methyltransferase 6
  Uniprot ID: Q9UJA5
  ENSP ID: ENSP00000203001
MEGSGEQPGPQPQHPGDHRIRDGDFVVLKREDVFKAVQVQRRKKVTFEKQWFYLDNVIGHSYGTAFEVTSGGSLQPKKKREEPTAETKEAGTDNRNIVDDGKSQKLTQDDIKALKDKGIKGEEIVQQLIENSTTFRDKTEFAQDKYIKKKKKKYEAIITVVKPSTRILSIMYYAREPGKINHMRYDTLAQMLTLGNIRAGNKMIVMETCAGLVLGAMMERMGGFGSIIQLYPGGGPVRAATACFGFPKSFLSGLYEFPLNKVDSLLHGTFSAKMLSSEPKDSALVEESNGTLEEKQASEQENEDSMAEAPESNHPEDQETMETISQDPEHKGPKERGSKKDYIQEKQRRQEEQRKRHLEAAALLSERNADGLIVASRFHPTPLLLSLLDFVAPSRPFVVYCQYKEPLLECYTKLRERGGVINLRLSETWLRNYQVLPDRSHPKLLMSGGGGYLLSGFTVAMDNLKADTSLKSNASTLESHETEEPAAKKRKCPESDS

SEQ ID NO: 92873 - protein, 327 aa, Homo sapiens
  Payload ID: 18567
  Gene Name: tRNA methyltransferase 6
  Uniprot ID: Q9UJA5
  ENSP ID: ENSP00000392070
MYYAREPGKINHMRYDTLAQMLTLGNIRAGNKMIVMETCAGLVLGAMMERMGGFGSIIQLYPGGGPVRAATACFGFPKSFLSGLYEFPLNKVDSLLHGTFSAKMLSSEPKDSALVEESNGTLEEKQASEQENEDSMAEAPESNHPEDQETMETISQDPEHKGPKERGSKKDYIQEKQRRQEEQRKRHLEAAALLSERNADGLIVASRFHPTPLLLSLLDFVAPSRPFVVYCQYKEPLLECYTKLRERGGVINLRLSETWLRNYQVLPDRSHPKLLMSGGGGYLLSGFTVAMDNLKADTSLKSNASTLESHETEEPAAKKRKCPESDS

SEQ ID NO: 92874 - protein, 191 aa, Homo sapiens
  Payload ID: 18568
  Gene Name: tRNA methyltransferase 61A
  ENSP ID: ENSP00000299202
  MOD_RES (1)..(1): Any amino acid
XHVWSPGSRSVAGTGSGSVSHAIIRTIAPTGHLHTVEFHQQRAEKAREEFQEHRVGRWVTVRTQDVCRSGFGVSHVADAVFLDIPSPWEAVGHAWDALKVEGGRFCSFSPCIEQVQRTCQALAARGFSELSTLEVLPQVYNVRTVSLPPPDLGTGTDGPAGSDTSPFRSGTPMKEAVGHTGYLTFATKTPG

SEQ ID NO: 92875 - protein, 289 aa, Homo sapiens
  Payload ID: 18568
  Gene Name: tRNA methyltransferase 61A
  Uniprot ID: Q96FX7
  ENSP ID: ENSP00000374399
MSFVAYEELIKEGDTAILSLGHGAMVAVRVQRGAQTQTRHGVLRHSVDLIGRPFGSKVTCGRGGWVYVLHPTPELWTLNLPHRTQILYSTDIALITMMLELRPGSVVCESGTGSGSVSHAIIRTIAPTGHLHTVEFHQQRAEKAREEFQEHRVGRWVTVRTQDVCRSGFGVSHVADAVFLDIPSPWEAVGHAWDALKVEGGRFCSFSPCIEQVQRTCQALAARGFSELSTLEVLPQVYNVRTVSLPPPDLGTGTDGPAGSDTSPFRSGTPMKEAVGHTGYLTFATKTPG

SEQ ID NO: 92876 - protein, 477 aa, Homo sapiens [sequence omitted]

SEQ ID NO: 92877 - protein, 366 aa, Homo sapiens
  Payload ID: 18569
  Gene Name: tRNA methyltransferase 61B
  ENSP ID: ENSP00000389617
MLMAWCRGPVLLCLRQGLGTNSFLHGLGQEPFEGARSLCCRSSPRDLRDGEREHEAAQRKAPGAESCPSLPLSISDIGTGCLSSLENLRLPTLREESSPRELEDSSGDQGRCGPTHQGSEDPSMLSQAQSATEVEERHVSPSCSTSRERPFQAGELILAETGEGETKFKKLFRLNNFGLLNSNWGAVPFGKIVGKFPGQILRSSFGKQYMLRRPALEDYVVLMKRGTAITFPKDINMILSMMDINPGDTVLEAGSGSGGMSLFLSKAVGSQGRVISFEVRKDHHDLAKKNYKHWRDSWKLSHVEEWPDNVDFIHKDISGATEDIKSLTFDAVALDMLNPHVTLPVFYPHLKHGGVCAVYVVKRIAF

SEQ ID NO: 92878 - protein, 102 aa, Homo sapiens
  Payload ID: 18569
  Gene Name: tRNA methyltransferase 61B
  ENSP ID: ENSP00000405467
  MOD_RES (1)..(1): Any amino acid
XELLDGIRTCELALSCEKISEVIVRDWLVCLAKQKNGILAQKVESKINTDVQLDSQEKIGVKEESHSDFPYGSFPYVARPVHWQPGHTAFLVKLRKVKPQLN

SEQ ID NO: 92879 - protein, 159 aa, Homo sapiens
  Payload ID: 18570
  Gene Name: tRNA methyltransferase O
  ENSP ID: ENSP00000364258
RGLEESGPRPTATPCGCVKPALETGNLLTEPVGYLESCFSAKNGTPRQPSICSYSRACLRIRKRIFNNPEHSLMGLEQFSHVWILFVFHKNGHLSCKAKVQPPRLNGAKTGVFSTRSPHRPNAIGLTLAKLEKVEALGKWTDIMAAVLMSTVLCGRSLG

SEQ ID NO: 92880 - protein, 295 aa, Homo sapiens [sequence omitted]

SEQ ID NO: 92881 - protein, 441 aa, Homo sapiens
  Payload ID: 18570
  Gene Name: tRNA methyltransferase O
  Uniprot ID: Q9BU70
  ENSP ID: ENSP00000364260
MRGLEESGPRPTATPCGCVKPALETGNLLTEPVGYLESCFSAKNGTPRQPSICSYSRACLRIRKRIFNNPEHSLMGLEQFSHVWILFVFHKNGHLSCKAKVQPPRLNGAKTGVFSTRSPHRPNAIGLTLAKLEKVEGGAIYLSGIDMIHGTPVLDIKPYIAEYDSPQNVMEPLADFNLQNNQHTPNTVSQSDSKTDSCDQRQLSGCDEPQPHHSTKRKPKCPEDRTSEENYLTHSDTARIQQAFPMHREIAVDFGLESRRDQSSSVAEEQIGPYCPEKSFSEKGTDKKLERVEGAAVLQGSRAETQPMAPHCPAGRADGAPRSVVPAWVTEAPVATLEVRFTPHAEMDLGQLSSQDVGQASFKYFQSAEEAKRAIEAVLSADPRSVYRRKLCQDRLFYFTVDIAHVTCWFGDGFAEVLRIKPASEPVHMTGPVGSLVSLGS

SEQ ID NO: 92882 - protein, 172 aa, Homo sapiens
  Payload ID: 18570
  Gene Name: tRNA methyltransferase O
  ENSP ID: ENSP00000408473
GLEESGPRPTATPCGCVKPALETGNLLTEPVGYLESCFSAKNGTPRQPSICSYSRACLRIRKRIFNNPEHSLMGLEQFSHVWILFVFHKNGHLSCKAKVQPPRLNGAKTGVFSTRSPHRPNAIGLTLAKLEKVEGNPFHFYFYLFPHPKKPYKINSIHHWLFIQTSTNDVNS

SEQ ID NO: 92883 - protein, 185 aa, Homo sapiens [sequence omitted]

SEQ ID NO: 92884 - protein, 434 aa, Homo sapiens
  Payload ID: 18571
  Gene Name: tRNA nucleotidyl transferase, CCA-adding, 1
  Uniprot ID: Q96Q11
  ENSP ID: ENSP00000251607
MLRCLYHWHRPVLNRRWSRLCLPKQYLFTMKLQSPEFQSLFTEGLKSLTELFVKENHELRIAGGAVRDLLNGVKPQDIDFATTATPTQMKEMFQSAGIRMINNRGEKHGTITARLHEENFEITTLRIDVTTDGRHAEVEFTTDWQKDAERRDLTINSMFLGFDGTLFDYFNGYEDLKNKKVRFVGHAKQRIQEDYLRILRYFRFYGRIVDKPGDHDPETLEAIAENAKGLAGISGERIWVELKKILVGNHVNHLIHLIYDLDVAPYIGLPANASLEEFDKVSKNVDGFSPKPVTLLASLFKVQDDVTKLDLRLKIAKEEKNLGLFIVKNRKDLIKATDSSDPLKPYQDFIIDSREPDATTRVCELLKYQGEHCLLKEMQQWSIPPFPVSGHDIRKVGISSGKEIGALLQQLREQWKKSGYQMEKDELLSYIKKT

SEQ ID NO: 92885 - protein, 414 aa, Homo sapiens
  Payload ID: 18571
  Gene Name: tRNA nucleotidyl transferase, CCA-adding, 1
  Uniprot ID: Q96Q11
  ENSP ID: ENSP00000280591
MLRCLYHWHRPVLNRRWSRLCLPKQYLFTMKLQSPEFQSLFTEGLKSLTELFVKENHELRIAGGAVRDLLNGVKPQDIDFATTATPTQMKEMFQSAGIRMINNRGEKHGTITARLHEENFEITTLRIDVTTDGRHAEVEFTTDWQKDAERRDLTINSMFLGFDGTLFDYFNGYEDLKNKKVRFVGHAKQRIQEDYLRILRYFRFYGRIVDKPGDHDPETLEAIAENAKGLAGISGERIWVELKKILVGLPANASLEEFDKVSKNVDGFSPKPVTLLASLFKVQDDVTKLDLRLKIAKEEKNLGLFIVKNRKDLIKATDSSDPLKPYQDFIIDSREPDATTRVCELLKYQGEHCLLKEMQQWSIPPFPVSGHDIRKVGISSGKEIGALLQQLREQWKKSGYQMEKDELLSYIKKT

SEQ ID NO: 92886 - protein, 57 aa, Homo sapiens
  Payload ID: 18571
  Gene Name: tRNA nucleotidyl transferase, CCA-adding, 1
  Uniprot ID: Q96Q11
  ENSP ID: ENSP00000342985
MLRCLYHWHRPVLNRRWSRLCLPKQYLFTMKLQSPEFQSLFTEGLKSLTGINAFHEN

SEQ ID NO: 92887 - protein, 65 aa, Homo sapiens
  Payload ID: 18571
  Gene Name: tRNA nucleotidyl transferase, CCA-adding, 1
  ENSP ID: ENSP00000380881
MLRCLYHWHRPVLNRRWSRLCLPKQYLFTMKLQSPEFQSLFTEGLKSLTDKVLLCHPGWSAVARS

SEQ ID NO: 92888 - protein, 57 aa, Homo sapiens; identical to SEQ ID NO: 92886
  Payload ID: 18571
  Gene Name: tRNA nucleotidyl transferase, CCA-adding, 1
  Uniprot ID: Q96Q11
  ENSP ID: ENSP00000385745

SEQ ID NO: 92889 - protein, 62 aa, Homo sapiens
  Payload ID: 18571
  Gene Name: tRNA nucleotidyl transferase, CCA-adding, 1
  ENSP ID: ENSP00000388615
MLRCLYHWHRPVLNRRWSRLCLPKQYLFTMKLQSPEFQSLFTEGLKSLTELFVKENHELRIA

SEQ ID NO: 92890 - protein, 57 aa, Homo sapiens; identical to SEQ ID NO: 92886
  Payload ID: 18571
  Gene Name: tRNA nucleotidyl transferase, CCA-adding, 1
  Uniprot ID: Q96Q11
  ENSP ID: ENSP00000400394

SEQ ID NO: 92891 - protein, 434 aa, Homo sapiens; identical to SEQ ID NO: 92884
  Payload ID: 18571
  Gene Name: tRNA nucleotidyl transferase, CCA-adding, 1
  Uniprot ID: Q96Q11
  ENSP ID: ENSP00000415100

SEQ ID NO: 92892 - protein, 253 aa, Homo sapiens
  Payload ID: 18572
  Gene Name: tRNA phosphotransferase 1
  Uniprot ID: Q86TN4
  ENSP ID: ENSP00000314073
MNFSGGGRQEAAGSRGRRAPRPREQDRDVQLSKALSYALRHGALKLGLPMGADGFVPLGTLLQLPQFRGFSAEDVQRVVDTNRKQRFALQLGDPSTGLLIRANQGHSLQVPKLELMPLETPQALPPMLVHGTFWKHWPSILLKGLSCQGRTHIHLAPGLPGDPGIISGMRSHCEIAVFIDGPLALADGIPFFRSANGVILTPGNTDGFLLPKYFKEALQLRPTRKPLSLAGDEETECQSSPKHSSRERRRIQQ

SEQ ID NO: 92893 - protein, 255 aa, Homo sapiens
  Payload ID: 18572
  Gene Name: tRNA phosphotransferase 1
  Uniprot ID: Q86TN4
  ENSP ID: ENSP00000378050
MNFSGGGRQEAAGSRGRRAPRPREQDRDVQLSKALSYALRHGALKLGLPMGADGFVPLGTLLQLPQFRGFSAEDVQRVVDTNRKQRFALQLGDPSTGLLIRANQGHSLQVGVPKLELMPLETPQALPPMLVHGTFWKHWPSILLKGLSCQGRTHIHLAPGLPGDPGIISGMRSHCEIAVFIDGPLALADGIPFFRSANGVILTPGNTDGFLLPKYFKEALQLRPTRKPLSLAGDEETECQSSPKHSSRERRRIQQ

SEQ ID NO: 92894 - protein, 204 aa, Homo sapiens
  Payload ID: 18572
  Gene Name: tRNA phosphotransferase 1
  Uniprot ID: Q86TN4
  ENSP ID: ENSP00000378051
MGADGFVPLGTLLQLPQFRGFSAEDVQRVVDTNRKQRFALQLGDPSTGLLIRANQGHSLQVPKLELMPLETPQALPPMLVHGTFWKHWPSILLKGLSCQGRTHIHLAPGLPGDPGIISGMRSHCEIAVFIDGPLALADGIPFFRSANGVILTPGNTDGFLLPKYFKEALQLRPTRKPLSLAGDEETECQSSPKHSSRERRRIQQ

SEQ ID NO: 92895 - protein, 167 aa, Homo sapiens
  Payload ID: 18572
  Gene Name: tRNA phosphotransferase 1
  ENSP ID: ENSP00000437741
MGADGFVPLGTLLQLPQFRGFSAEDVQRVVDTNRKQRFALQLGDPSTGLLIRANQGHSLQVPKLELMPLETPQALPPMLVHGTFWKHWPSILLKGLSCQGRTHIHLAPGLPGDPGIISGMRSHCEIAVFIDGPLALAGKPLSLAGDEETECQSSPKHSSRERRRIQQ

SEQ ID NO: 92896 - protein, 216 aa, Homo sapiens
  Payload ID: 18572
  Gene Name: tRNA phosphotransferase 1
  Uniprot ID: Q86TN4
  ENSP ID: ENSP00000438683
MNFSGGGRQEAAGSRGRRAPRPREQDRDVQLSKALSYALRHGALKLGLPMGADGFVPLGTLLQLPQFRGFSAEDVQRVVDTNRKQRFALQLGDPSTGLLIRANQGHSLQVPKLELMPLETPQALPPMLVHGTFWKHWPSILLKGLSCQGRTHIHLAPGLPGDPGIISGMRSHCEIAVFIDGPLALAGKPLSLAGDEETECQSSPKHSSRERRRIQQ

SEQ ID NO: 92897 - protein, 111 aa, Homo sapiens
  Payload ID: 18572
  Gene Name: tRNA phosphotransferase 1
  ENSP ID: ENSP00000439586
MLVHGTFWKHWPSILLKGLSCQGRTHIHLAPGLPGDPGIISGMRSHCEIAVFIDGPLALAGNTDGFLLPKYFKEALQLRPTRKPLSLAGDEETECQSSPKHSSRERRRIQQ

SEQ ID NO: 92898 - protein, 191 aa, Homo sapiens
  Payload ID: 18572
  Gene Name: tRNA phosphotransferase 1
  ENSP ID: ENSP00000442066
MNFSGGGRQEAAGSRGRRAPRPREQDRDVQLSKALSYALRHGALKLGLPMGADGFVPLGTLLQLPQFRGFSAEDVQRVVDTNRKQRFALQLGDPSTGLLIRANQGHSLQVGVPKLELMPLETPQALPPMLVHGTFWKHWPSILLKGLSCQGRTHIHLAPGLPGDPGIISGMRSHCEIAVFIDGPLALADGI

SEQ ID NO: 92899 - protein, 115 aa, Homo sapiens
  Payload ID: 18572
  Gene Name: tRNA phosphotransferase 1
  ENSP ID: ENSP00000445292
  MOD_RES (1)..(1): Any amino acid
XPSILLKGLSCQGRTHIHLAPGLPGDPGIISGMRSHCEIAVFIDGPLALADGIPFFRSANGVILTPGNTDGFLLPKYFKEALQLRPTRENHHPSPYSLFLKAVPFCPHLSPSFQP

SEQ ID NO: 92900 - protein, 287 aa, Homo sapiens
  Payload ID: 18573
  Gene Name: tRNA selenocysteine 1 associated protein 1
  Uniprot ID: Q9NX07
  ENSP ID: ENSP00000362936
MAASLWMGDLEPYMDENFISRAFATMGETVMSVKIIRNRLTGIPAGYCFVEFADLATAEKCLHKINGKPLPGATPAKRFKLNYATYGKQPDNSPEYSLFVGDLTPDVDDGMLYEFFVKVYPSCRGGKVVLDQTGVSKGYGFVKFTDELEQKRALTECQGAVGLGSKPVRLSVAIPKASRVKPVEYSQMYSYSYNQYYQQYQNYYAQWGYDQNTGSYSYSYPQYGYTQSTMQTYEEVGDDALEDPMPQLDVTEANKEFMEQSEELYDALMDCHWQPLDTVSSEIPAMM

SEQ ID NO: 92901 - protein, 298 aa, Homo sapiens
  Payload ID: 18574
  Gene Name: tRNA-histidine guanylyltransferase 1-like
  Uniprot ID: Q9NWX6
  ENSP ID: ENSP00000231198
MWGACKVKVHDSLATISITLRRYLRLGATMAKSKFEYVRDFEADDTCLAHCWVVVRLDGRNFHRFAEKHNFAKPNDSRALQLMTKCAQTVMEELEDIVIAYGQSDEYSFVFKRKTNWFKRRASKFMTHVASQFASSYVFYWRDYFEDQPLLYPPGFDGRVVVYPSNQTLKDYLSWRQADCHINNLYNTVFWALIQQSGLTPVQAQGRLQGTLAADKNEILFSEFNINYNNELPMYRKGTVLIWQKVDEVMTKEIKLPTEMEGKKMAVTRTRTKPVPLHCDIIGDAFWKEHPEILDEDS

SEQ ID NO: 92902 - protein, 124 aa, Homo sapiens
  Payload ID: 18574
  Gene Name: tRNA-histidine guanylyltransferase 1-like
  ENSP ID: ENSP00000428387
MWGACKVKVHDSLATISITLRRYLRLGATMAKSKFEYVRDFEADDTCLAHCWVVVRLDGRNFHRFAEKHNFAKPNDSRALQLMTKCAQTVMEELEDIVIAYGQSDEYSFVFKRKTNWFKRRARL

SEQ ID NO: 92903 - protein, 34 aa, Homo sapiens
  Payload ID: 18574
  Gene Name: tRNA-histidine guanylyltransferase 1-like
  ENSP ID: ENSP00000431090
  MOD_RES (1)..(1): Any amino acid
XEILFSEFNINYNNELPMYRKGTVLIWQKYQGVP

SEQ ID NO: 92904 - protein, 732 aa, Homo sapiens
  Payload ID: 18575
  Gene Name: tRNA-yW synthesizing protein 1 homolog (S. cerevisiae)
  Uniprot ID: Q9NV66
  ENSP ID: ENSP00000352645
MDPSADTWDLFSPLISLWINRFYIYLGFAVSISLWICVQIVIKTQGKNLQEKSVPKAAQDLMTNGYVSLQEKDIFVSGVKIFYGSQTGTAKGFATVLAEAVTSLDLPVAIINLKEYDPDDHLIEEVTSKNVCVFLVATYTDGLPTESAEWFCKWLEEASIDFRFGKTYLKGMRYAVFGLGNSAYASHFNKVGKNVDKWLWMLGAHRVMSRGEGDCDVVKSKHGSIEADFRAWKTKFISQLQALQKGERKKSCGGHCKKGKCESHQHGSEEREEGSHEQDELHHRDTEEEEPFESSSEEEFGGEDHQSLNSIVDVEDLGKIMDHVKKEKREKEQQEEKSGLFRNMGRNEDGERRAMITPALREALTKQGYQLIGSHSGVKLCRWTKSMLRGRGGCYKHTFYGIESHRCMETTPSLACANKCVFCWRHHTNPVGTEWRWKMDQPEMILKEAIENHQNMIKQFKGVPGVKAERFEEGMTVKHCALSLVGEPIMYPEINRFLKLLHQCKISSFLVTNAQFPAEIRNLEPVTQLYVSVDASTKDSLKKIDRPLFKDFWQRFLDSLKALAVKQQRTVYRLTLVKAWNVDELQAYAQLVSLGNPDFIEVKGVTYCGESSASSLTMAHVPWHEEVVQFVHELVDLIPEYEIACEHEHSNCLLIAHRKFKIGGEWWTWIDYNRFQELIQEYEDSGGSKTFSAKDYMARTPHWALFGASERGFDPKDTRHQRKNKSKAISGC

SEQ ID NO: 92905 - protein, 384 aa, Homo sapiens
  Payload ID: 18575
  Gene Name: tRNA-yW synthesizing protein 1 homolog (S. cerevisiae)
  Uniprot ID: Q9NV66
  ENSP ID: ENSP00000354795
MDPSADTWDLFSPLISLWINRFYIYLGFAVSISLWICVQIVIKTQGKNLQEKSVPKAAQDLMTNGYVSLQEKDIFVSGVKIFYGSQTGTAKGFATVLAEAVTSLDLPVAIINLKEYDPDDHLIEEVTSKNVCVFLVATYTDGLPTESAEWFCKWLEEASIDFRFGKTYLKGMRYAVFGLGNSAYASHFNKVGKNVDKWLWMLGAHRVMSRGEGDCDVVKSKHGSIEADFRAWKTKFISQLQALQKGERKKSCGGHCKKGKCESHQHGSEEREEGSHEQDELHHRDTEEEEPFESSSEEEFGGEDHQSLNSIVDVEDLGKIMDHVKKEKREKEQQEEKSGLFRNMGRNEDGERRAMITPALREALTKQVHAPRERRLLQTHILWN

SEQ ID NO: 92906 - protein, 134 aa, Homo sapiens
  Payload ID: 18575
  Gene Name: tRNA-yW synthesizing protein 1 homolog (S. cerevisiae)
  ENSP ID: ENSP00000398897
MDPSADTWDLFSPLISLWINRFYIYLGFAVSISLWICVQIVIKTQGKNLQEKSVPKAAQDLMTNGYVSLQEKDIFVSGVKIFYGSQTGTAKGFATVLAEAVTSLDLPVAIINLKEYDPDDHLIEEVGKNVDKWL

SEQ ID NO: 92907 - protein, 668 aa, Homo sapiens
  Payload ID: 18575
  Gene Name: tRNA-yW synthesizing protein 1 homolog (S. cerevisiae)
  ENSP ID: ENSP00000478959
MDPSADTWDLFSPLISLWINRFYIYLGFAVSISLWICVQIVIKTQGFATVLAEAVTSLDLPVAIINLKEYDPDDHLIEEVTSKNVCVFLVATYTDGLPTESAEWFCKWLEEASIDFRFGKTYLKGMRYAVFGLGNSAYASHFNKVGKNVDKWLWMLGAHRVMSRGEGDCDVVKSKHGSIEADFRAWKTKFISQLQALQKGERKKSCGGHCKKGKCESHQHGSEEREEGSHEQDELHHRDTEEEEPFESSSEEEFGGEDHQSLNSIVDVEDLGKIMDHVKKEKREKEQQEEKSGLFRNMGRNEDGERRAMITPALREALTKQVHAPRERRLLQTHILWNESHRCMETTPSLACANKCVFCWRHHTNPVGTEWRWKMDQPEMILKEAIENHQNMIKQFKGVPGVKAERFEEGMTVKHCALSLVGEPIMYPEINRFLKLLHQCKISSFLVTNAQFPAEIRNLEPVTQLYVSVDASTKDSLKKIDRPLFKDFWQRFLDSLKALAVKQQRTVYRLTLVKAWNVDELQAYAQLVSLGNPDFIEVKGVTYCGESSASSLTMAHVPWHEEVVQFVHELVDLIPEYEIACEHEHSNCLLIAHRKFKIGGEWWTWIDYNRFQELIQEYEDSGGSKTFSAKDYMARTPHWALFGASERGFDPKDTRHQRKNKSKAISGC

SEQ ID NO: 92908 - protein, 471 aa, Homo sapiens
  Payload ID: 18576
  Gene Name: tRNA-yW synthesizing protein 1 homolog B (S. cerevisiae)
  ENSP ID: ENSP00000480534
MDPSADTWDLSSPLISLWINRFYIYLGFAVSISLWICVQIVIEMQGFATVLAEAVTSLDLPVAIINLKEYDPDDHLIEEEEEPFESSSEEEFGGEDHQSLNSIVDVEDLGKIMDHVKKEKREKEQQEEKSGLFRNMGRNEDGERRAMITPALREALTKQVDAPRERSLLQTHILWNESHRCMETTPSLACANKCVFCWWHHNNPVGTEWLWKMDQPEMILKEAIENHQNMIKQFKGVPGVKAERFEEGMTVKHCALSLVGEPIMYPEINRFLKLLHQCKISSFLVTNAQFPAEIRNLEPVTQLYVSVDASTKDSLKKIDRPLFKDFWQQFLDSLKALAVKQQRTVYRLMLVKAWNVDELQAYAQLVSLGNPDFIEVKGVTYCRESSASSLTMAHVPWHEEVVQFVRELVDLIPEYEIACEHEHSNCLLIAHRKTVLGGTPGHGVTEIQWEEWIKKRLISQARWLISVIPAH

SEQ ID NO: 92909 - protein, 668 aa, Homo sapiens
  Payload ID: 18576
  Gene Name: tRNA-yW synthesizing protein 1 homolog B (S. cerevisiae)
  ENSP ID: ENSP00000482502
MDPSADTWDLSSPLISLWINRFYIYLGFAVSISLWICVQIVIEMQGFATVLAEAVTSLDLPVAIINLKEYDPDDHLIEEVTSKNVCVFLVATYTDGLPTESAEWFCKWLEEASIDFRFGKTYLKGMRDAVFGLGNSAYASHFNKVGKNVDKWLWMLGVHRVMSRGEGDCDVVKSKHGSIEANFRAWKTKFISQLQALQKGERKKSCGGHCKKGKCESHQHGSEEREEGSQEQDELHHRDTKEEEPFESSSEEEFGGEDHQSLNSIVDVEDLGKIMDHVKKEKREKEQQEEKSGLFRNMGRNEDGERRAMITPALREALTKQVDAPRERSLLQTHILWNESHRCMETTPSLACANKCVFCWWHHNNPVGTEWLWKMDQPEMILKEAIENHQNMIKQFKGVPGVKAERFEEGMTVKHCALSLVGEPIMYPEINRFLKLLHQCKISSFLVTNAQFPAEIRNLEPVTQLYVSVDASTKDSLKKIDRPLFKDFWQQFLDSLKALAVKQQRTVYRLMLVKAWNVDELQAYAQLVSLGNPDFIEVKGVTYCRESSASSLTMAHVPWHEEVVQFVRELVDLIPEYEIACEHEHSNCLLIAHRKFKIGGEWWTWIDYNRFQELIQEYEDSGGSKTFSAKDYMARTPHWALFGANERSFDPKDTRHQRKNKSKAISGC

SEQ ID NO: 92910 - protein, 325 aa, Homo sapiens
  Payload ID: 18576
  Gene Name: tRNA-yW synthesizing protein 1 homolog B (S. cerevisiae)
  ENSP ID: ENSP00000484480
MDPSADTWDLSSPLISLWINRFYIYLGFAVSISLWICVQIVIEMQGFATVLAEAVTSLDLPVAIINLKEYDPDDHLIEEVGKNVDKWLWMLGVHRVMSRGEGDCDVVKSKHGSIEANFRAWKTKFISQLQALQKGERKKSCGGHCKKGKCESHQHGSEEREEGSQEQDELHHRDTKEEEPFESSSEEEFGGEDHQSLNSIVDVEDLGKIMDHVKKEKREKEQQEEKSGLFRNMGRNEDGERRAMITPALREALTKQVDAPRERSLLQTHILWNESHRCMETTPSLACANKCVFCWWHHNNPVGTEWLWKMDQPEMILKEAIENHQ

SEQ ID NO: 92911 - protein, 259 aa, Homo sapiens
  Payload ID: 18577
  Gene Name: tRNA-yW synthesizing protein 3 homolog (S. cerevisiae)
  Uniprot ID: Q6IPR3
  ENSP ID: ENSP00000359904
MDRSAEFRKWKAQCLSKADLSRKGSVDEDVVELVQFLNMRDQFFTTSSCAGRILLLDRGINGFEVQKQNCCWLLVTHKLCVKDDVIVALKKANGDATLKFEPFVLHVQCRQLQDAQILHSMAIDSGFRNSGITVGKRGKTMLAVRSTHGLEVPLSHKGKLMVTEEYIDFLLNVANQKMEENKKRIERFYNCLQHALERETMTNLHPKIKEKNNSSYIHKKKRNPEKTRAQCITKESDEELENDDDDDLGINVTIFPEDY

SEQ ID NO: 92912 - protein, 226 aa, Homo sapiens
  Payload ID: 18577
  Gene Name: tRNA-yW synthesizing protein 3 homolog (S. cerevisiae)
  Uniprot ID: Q6IPR3
  ENSP ID: ENSP00000407025
MDRSAEFRKWKAQCLSKADLSRKGSVDEDVVELVQFLNMRDQFFTTSSCAGRILLLDRGINGFEVQKQNCCWLLVTHKLCVKDDVHSMAIDSGFRNSGITVGKRGKTMLAVRSTHGLEVPLSHKGKLMVTEEYIDFLLNVANQKMEENKKRIERFYNCLQHALERETMTNLHPKIKEKNNSSYIHKKKRNPEKTRAQCITKESDEELENDDDDDLGINVTIFPEDY

SEQ ID NO: 92913 - protein, 56 aa, Homo sapiens
  Payload ID: 18577
  Gene Name: tRNA-yW synthesizing protein 3 homolog (S. cerevisiae)
  ENSP ID: ENSP00000476365
MAIDSGFRNSGITVGKRGKTMLAVRSTHGLEVPLSHKGKLMVTEEYIDFLLNVANQ

SEQ ID NO: 92914 - protein, 139 aa, Homo sapiens
  Payload ID: 18577
  Gene Name: tRNA-yW synthesizing protein 3 homolog (S. cerevisiae)
  ENSP ID: ENSP00000477469
MAIDSGFRNSGITVGKRGKTMLAVRSTHGLEVPLSHKGKLMVTEEYIDFLLNVANQKMEENKKRIERFYNCLQHALERETMTNLHPKIKEKNNSSYIHKKKRNPEKTRAQCITKESDEELENDDDDDLGINVTIFPEDY

SEQ ID NO: 92915 - protein, 315 aa, Homo sapiens
  Payload ID: 18578
  Gene Name: tRNA-yW synthesizing protein 5
  Uniprot ID: A2RUC4
  ENSP ID: ENSP00000346627
MAGQHLPVPRLEGVSREQFMQHLYPQRKPLVLEGIDLGPCTSKWTVDYLSQVGGKKEVKIHVAAVAQMDFISKNFVYRTLPFDQLVQRAAEEKHKEFFVSEDEKYYLRSLGEDPRKDVADIRKQFPLLKGDIKFPEFFKEEQFFSSVFRISSPGLQLWTHYDVMDNLLIQVTGKKRVVLFSPRDAQYLYLKGTKSEVLNIDNPDLAKYPLFSKARRYECSLEAGDVLFIPALWFHNVISEEFGVGVNIFWKHLPSECYDKTDTYGNKDPTAASRAAQILDRALKTLAELPEEYRDFYARRMVLHIQDKAYSKNSE

SEQ ID NO: 92916 - protein, 121 aa, Homo sapiens
  Payload ID: 18578
  Gene Name: tRNA-yW synthesizing protein 5
  ENSP ID: ENSP00000398447
MAGQHLPVPRLEGVSREQFMQHLYPQRKPLVLEGIDLGPCTSKWTVDYLSQVGGKKEVKIHVAAVAQMDFIKLYLLTSWSRGQLKRNIKNSLFQRMRNTTYGHLEKTLERMLQISESSFLC

SEQ ID NO: 92917 - protein, 121 aa, Homo sapiens; identical to SEQ ID NO: 92916
  Payload ID: 18578
  Gene Name: tRNA-yW synthesizing protein 5
  ENSP ID: ENSP00000420024

SEQ ID NO: 92918 - protein, 1431 aa, Homo sapiens
  Payload ID: 18579
  Gene Name: trophinin
  Uniprot ID: Q12816
  ENSP ID: ENSP00000173898
MDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEHIEALNVTDAATRQIEASVVAIRPKKSKGKKAASRGPNSVSEISEAPLATQIVTNQALAATLRVKRGSRARKAATKARATESQTPNADQGAQAKIASAQTNVSALETQVAAAVQALADDYLAQLSLEPTTRTRGKRNRKSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEARAQMGIGEEAVAGPWNWDDMDIDCLTREELGDDAQAWSRFSFEIEARAQENADASTNVNFSRGASTRAGFSDGASISFNGAPSSSGGFSGGPGITFGVAPSTSASFSNTASISFGGTLSTSSSFSSAASISFGCAHSTSTSFSSEASISFGGMPCTSASFSGGVSSSFSGPLSTSATFSGGASSGFGGTLSTTAGFSGVLSTSTSFGSAPTTSTVFSSALSTSTGFGGILSTSVCFGGSPSSSGSFGGTLSTSICFGGSPCTSTGFGGTLSTSVSFGGSSSTSANFGGTLSTSICFDGSPSTGAGFGGALNTSASFGSVLNTSTGFGGAMSTSADFGGTLSTSVCFGGSPGTSVSFGSALNTNAGYGGAVSTNTDFGGTLSTSVCFGGSPSTSAGFGGALNTNASFGCAVSTSASFSGAVSTSACFSGAPITNPGFGGAFSTSAGFGGALSTAADFGGTPSNSIGFGAAPSTSVSFGGAHGTSLCFGGAPSTSLCFGSASNTNLCFGGPPSTSACFSGATSPSFCDGPSTSTGFSFGNGLSTNAGFGGGLNTSAGFGGGLGTSAGFSGGLSTSSGFDGGLGTSAGFGGGPGTSTGFGGGLGTSAGFSGGLGTSAGFGGGLVTSDGFGGGLGTNASFGSTLGTSAGFSGGLSTSDGFGSRPNASFDRGLSTIIGFGSGSNTSTGFTGEPSTSTGFSSGPSSIVGFSGGPSTGVGFCSGPSTSGFSGGPSTGAGFGGGPNTGAGFGGGPSTSAGFGSGAASLGACGFSYG

SEQ ID NO: 92919 - protein, 706 aa, Homo sapiens
  Payload ID: 18579
  Gene Name: trophinin
  Uniprot ID: Q12816
  ENSP ID: ENSP00000318278
MDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEHIEALNVTDAATRQIEASVVAIRPKKSKGKKAASRGPNSVSEISEAPLATQIVTNQALAATLRVKRGSRARKAATKARATESQTPNADQGAQAKIASAQTNVSALETQVAAAVQALADDYLAQLSLEPTTRTRGKRNRKSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEIYSPCLQIPLINCSSPSHGAKVHPWNLCPHSSQGSYGQSAEGVM

SEQ ID NO: 92920 - protein, 706 aa, Homo sapiens; identical to SEQ ID NO: 92919
  Payload ID: 18579
  Gene Name: trophinin
  Uniprot ID: Q12816
  ENSP ID: ENSP00000364162

SEQ ID NO: 92921 - protein, 1034 aa, Homo sapiens
  Payload ID: 18579
  Gene Name: trophinin
  Uniprot ID: Q12816
  ENSP ID: ENSP00000364181
MDRRNDYGYRVPLFQSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEARAQMGIGEEAVAGPWNWDDMDIDCLTREELGDDAQAWSRFSFEIEARAQENADASTNVNFSRGASTRAGFSDGASISFNGAPSSSGGFSGGPGITFGVAPSTSASFSNTASISFGGTLSTSSSFSSAASISFGCAHSTSTSFSSEASISFGGMPCTSASFSGGVSSSFSGPLSTSATFSGGASSGFGGTLSTTAGFSGVLSTSTSFGSAPTTSTVFSSALSTSTGFGGILSTSVCFGGSPSSSGSFGGTLSTSICFGGSPCTSTGFGGTLSTSVSFGGSSSTSANFGGTLSTSICFDGSPSTGAGFGGALNTSASFGSVLNTSTGFGGAMSTSADFGGTLSTSVCFGGSPGTSVSFGSALNTNAGYGGAVSTNTDFGGTLSTSVCFGGSPSTSAGFGGALNTNASFGCAVSTSASFSGAVSTSACFSGAPITNPGFGGAFSTSAGFGGALSTAADFGGTPSNSIGFGAAPSTSVSFGGAHGTSLCFGGAPSTSLCFGSASNTNLCFGGPPSTSACFSGATSPSFCDGPSTSTGFSFGNGLSTNAGFGGGLNTSAGFGGGLGTSAGFSGGLSTSSGFDGGLGTSAGFGGGPGTSTGFGGGLGTSAGFSGGLGTSAGFGGGLVTSDGFGGGLGTNASFGSTLGTSAGFSGGLSTSDGFGSRPNASFDRGLSTIIGFGSGSNTSTGFTGEPSTSTGFSSGPSSIVGFSGGPSTGVGFCSGPSTSGFSGGPSTGAGFGGGPNTGAGFGGGPSTSAGFGSGAASLGACGFSYG

SEQ ID NO: 92922 - protein, 309 aa, Homo sapiens
  Payload ID: 18579
  Gene Name: trophinin
  Uniprot ID: Q12816
  ENSP ID: ENSP00000382641
MDRRNDYGYRVPLFQSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEIYSPCLQIPLINCSSPSHGAKVHPWNLCPHSSQGSYGQSAEGVM

SEQ ID NO: 92923 - protein, 71 aa, Homo sapiens
  Payload ID: 18579
  Gene Name: trophinin
  ENSP ID: ENSP00000387676
MHTLLAATKDSLAMDPPVVNRPKKSKTKKAPIKTITKAAPAAPPVPAANEIATNKPKITWQALNLPVITQI

SEQ ID NO: 92924 - protein, 230 aa, Homo sapiens
  Payload ID: 18579
  Gene Name: trophinin
  ENSP ID: ENSP00000388947
MHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEH

SEQ ID NO: 92925 - protein, 123 aa, Homo sapiens
  Payload ID: 18579
  Gene Name: trophinin
  ENSP ID: ENSP00000392841
MHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLK

SEQ ID NO: 92926 - protein, 168 aa, Homo sapiens
  Payload ID: 18579
  Gene Name: trophinin
  ENSP ID: ENSP00000404645
MDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKS

SEQ ID NO: 92927 - protein, 168 aa, Homo sapiens; identical to SEQ ID NO: 92926
  Payload ID: 18579
  Gene Name: trophinin
  ENSP ID: ENSP00000404767

SEQ ID NO: 92928 - protein, 681 aa, Homo sapiens
  Payload ID: 18579
  Gene Name: trophinin
  ENSP ID: ENSP00000404794
MDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQGQITNETASIHTTAASIRTKKASKARKTIAKVINTDTEHIEALNVTDAATRQIEASVVAIRPKKSKGKKAASRGPNSVSEISEAPLATQIVTNQALAATLRVKRGSRARKAATKARATESQTPNADQGAQAKIASAQTNVSALETQVAAAVQALADDYLAQLSLEPTTRTRGKRNRKSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEWFQHQHWLYWRTQHQHGLQ

SEQ ID NO: 92929 - protein, 3 aa, Homo sapiens
  Payload ID: 18579
  Gene Name: trophinin
  ENSP ID: ENSP00000405043
MHT

SEQ ID NO: 92930 - protein, 962 aa, Homo sapiens
  Payload ID: 18579
  Gene Name: trophinin
  Uniprot ID: Q12816
  ENSP ID: ENSP00000405126
MLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQAAAVAVAEAEARAEARAQMGIGEEAVAGPWNWDDMDIDCLTREELGDDAQAWSRFSFEIEARAQENADASTNVNFSRGASTRAGFSDGASISFNGAPSSSGGFSGGPGITFGVAPSTSASFSNTASISFGGTLSTSSSFSSAASISFGCAHSTSTSFSSEASISFGGMPCTSASFSGGVSSSFSGPLSTSATFSGGASSGFGGTLSTTAGFSGVLSTSTSFGSAPTTSTVFSSALSTSTGFGGILSTSVCFGGSPSSSGSFGGTLSTSICFGGSPCTSTGFGGTLSTSVSFGGSSSTSANFGGTLSTSICFDGSPSTGAGFGGALNTSASFGSVLNTSTGFGGAMSTSADFGGTLSTSVCFGGSPGTSVSFGSALNTNAGYGGAVSTNTDFGGTLSTSVCFGGSPSTSAGFGGALNTNASFGCAVSTSASFSGAVSTSACFSGAPITNPGFGGAFSTSAGFGGALSTAADFGGTPSNSIGFGAAPSTSVSFGGAHGTSLCFGGAPSTSLCFGSASNTNLCFGGPPSTSACFSGATSPSFCDGPSTSTGFSFGNGLSTNAGFGGGLNTSAGFGGGLGTSAGFSGGLSTSSGFDGGLGTSAGFGGGPGTSTGFGGGLGTSAGFSGGLGTSAGFGGGLVTSDGFGGGLGTNASFGSTLGTSAGFSGGLSTSDGFGSRPNASFDRGLSTIIGFGSGSNTSTGFTGEPSTSTGFSSGPSSIVGFSGGPSTGVGFCSGPSTSGFSGGPSTGAGFGGGPNTGAGFGGGPSTSAGFGSGAASLGACGFSYG

SEQ ID NO: 92931 - protein, 121 aa, Homo sapiens
  Payload ID: 18579
  Gene Name: trophinin
  ENSP ID: ENSP00000405311
MHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQ

SEQ ID NO: 92932 - protein, 176 aa, Homo sapiens
  Payload ID: 18579
  Gene Name: trophinin
  ENSP ID: ENSP00000406574
MDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLP

SEQ ID NO: 92933 - protein, 102 aa, Homo sapiens
  Payload ID: 18579
  Gene Name: trophinin
  ENSP ID: ENSP00000407996
MDRRNDYGYRVPLFQSKHLNGDERSGSNYRRIPWGRRPAPPRDVAILQERANKLVKYLLVKDQTKIPIKRSDMLRDVIQEYDEYFPEIIERASYTLEKMFRV

SEQ ID NO: 92934 - protein, 192 aa, Homo sapiens
  Payload ID: 18579
  Gene Name: trophinin
  ENSP ID: ENSP00000411717
MHTLLAATKDSLAMDPPVVNRPKKSKTKKAPIKTITKAAPAAPPVPAANEIATNKPKITWQALNLPVITQISQALPTTEVTNTQASSVTAQPKKANKMKRVTAKAAQGSQSPTGHEGGTIQLKSPLQVLKLPVISQNIHAPIANESASSQALITSIKPKKASKAKKAANKAIASATEVSLAATATHTATTQG

SEQ ID NO: 92935 - protein, 64 aa, Homo sapiens
  Payload ID: 18579
  Gene Name: trophinin
  ENSP ID: ENSP00000412588
MHTLLAATKDSLAMDPPVVNRPKKSKTKKAPIKTITKAAPAAPPVPAANEIATNKPKITWQALN

SEQ ID NO: 92936 - protein, 357 aa, Homo sapiens
  Payload ID: 18579
  Gene Name: trophinin
  ENSP ID: ENSP00000483142
MDRRNDYGYRVPLFQSKHLNGDERSGSNYRRIPWGRRPAPPRDVAILQERANKLVKYLLVKDQTKIPIKRSDMLRDVIQEYDEYFPEIIERASYTLEKMFRVNLKEIDKQSSLYILISTQESSAGILGTTKDTPKLGLLMVILSVIFMNGNKASEAVIWEVLRKLGLRPGVRHSLFGEVRKLITDEFVKQKYLEYKRVPNSRPPEYEFFWGLRSYHETSKMKVLKFACRVQKKDPKDWAVQYREAVEMEVQLQLWLWLRLKPGLSGSNTSTGFTGEPSTSTGFSSGPSSIVGFSGGPSTGVGFCSGPSTSGFSGGPSTGAGFGGGPNTGAGFGGGPSTSAGFGSGAASLGACGFSYG

SEQ ID NO: 92937 - protein, 778 aa, Homo sapiens
  Payload ID: 18580
  Gene Name: trophinin associated protein
  Uniprot ID: Q12815
  ENSP ID: ENSP00000257909
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALCFIPVGSAAPQGSP

SEQ ID NO: 92938 - protein, 144 aa, Homo sapiens
  Payload ID: 18580
  Gene Name: trophinin associated protein
  Uniprot ID: Q12815
  ENSP ID: ENSP00000369684
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTVLVPAPGKLFALRRSPFPPAKCHLARCHGLYL

SEQ ID NO: 92939 - protein, 53 aa, Homo sapiens
  Payload ID: 18580
  Gene Name: trophinin associated protein
  ENSP ID: ENSP00000446564
MTTRQATKDPLLRGVSPTPSKIPVRSQKRTPFPTVTSCAVDQENQDPRRLQGP

SEQ ID NO: 92940 - protein, 290 aa, Homo sapiens
  Payload ID: 18580
  Gene Name: trophinin associated protein
  ENSP ID: ENSP00000446646
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTRPSFQELRRETAGSSRTSVSQASGLLLETPVQPGEREVVTHSDEGGVASLGLAQRVPLRENREMSHT

SEQ ID NO: 92941 - protein, 114 aa, Homo sapiens
  Payload ID: 18580
  Gene Name: trophinin associated protein
  ENSP ID: ENSP00000447244
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEA

SEQ ID NO: 92942 - protein, 457 aa, Homo sapiens
  Payload ID: 18580
  Gene Name: trophinin associated protein
  ENSP ID: ENSP00000447421
MSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALCFIPVGSAAPQGSP

SEQ ID NO: 92943 - protein, 868 aa, Homo sapiens
  Payload ID: 18580
  Gene Name: trophinin associated protein
  ENSP ID: ENSP00000447509
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGKELAGKECEHKRSSPHCELHTCPAPTPGNLMLPHLPPWPSLALPQEEGRGCTSSPVLLIGLAVGGGGGEDSTWWKYRTPDLPLNFPCPSGLSNLAPRTLALRERLKSCLTAIHCFHEARLDDECAFYTSRAPPSGPTRVCTNPVATLLEWQDALCFIPVGSAAPQGSP

SEQ ID NO: 92944 - protein, 53 aa, Homo sapiens; identical to SEQ ID NO: 92939
  Payload ID: 18580
  Gene Name: trophinin associated protein
  ENSP ID: ENSP00000447876

SEQ ID NO: 92945 - protein, 126 aa, Homo sapiens
  Payload ID: 18580
  Gene Name: trophinin associated protein
  Uniprot ID: Q12815
  ENSP ID: ENSP00000448313
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTGAMACTCNHSYSGG

SEQ ID NO: 92946 - protein, 52 aa, Homo sapiens
  Payload ID: 18580
  Gene Name: trophinin associated protein
  ENSP ID: ENSP00000449032
MTTRQATKDPLLRGVSPTPSKIPVRSQKRTPFPTVTSCAVDQENQDPRVRGA

SEQ ID NO: 92947 - protein, 87 aa, Homo sapiens
  Payload ID: 18580
  Gene Name: trophinin associated protein
  ENSP ID: ENSP00000449245
MTTRQATKDPLLRGVSPTPSKIPVRSQKRTPFPTVTSCAVDQENQDPRRWVQKPPLNIQRPLVDSAGPRPKARHQAETSQRLRLQGP

SEQ ID NO: 92948 - protein, 180 aa, Homo sapiens
  Payload ID: 18580
  Gene Name: trophinin associated protein
  ENSP ID: ENSP00000449588
MTTRQATKDPLLRGVSPTPSKIPVRSQKRTPFPTVTSCAVDQENQDPRGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTR

SEQ ID NO: 92949 - protein, 68 aa, Homo sapiens
  Payload ID: 18580
  Gene Name: trophinin associated protein
  ENSP ID: ENSP00000449866
MTTRQATKDPLLRGVSPTPSKIPVRSQKRTPFPTVTSCAVDQENQDPRQNVISPGAMACTCNHSYSGG

SEQ ID NO: 92950 - protein, 126 aa, Homo sapiens
  Payload ID: 18580
  Gene Name: trophinin associated protein
  ENSP ID: ENSP00000449984
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTGTCWSHGNTASMAE

SEQ ID NO: 92951 - protein, 158 aa, Homo sapiens
  Payload ID: 18580
  Gene Name: trophinin associated protein
  ENSP ID: ENSP00000450306
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGCSGLCIFGPQNPHPPTGPCQGFLLL

SEQ ID NO: 92952 - protein, 420 aa, Homo sapiens
  Payload ID: 18581
  Gene Name: trophoblast glycoprotein
  Uniprot ID: Q13641
  ENSP ID: ENSP00000358765
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQLAVLPAGAFARRPPLAELAALNLSGSRLDEVRAGAFEHLPSLRQLDLSHNPLADLSPFAFSGSNASVSAPSPLVELILNHIVPPEDERQNRSFEGMVVAALLAGRALQGLRRLELASNHFLYLPRDVLAQLPSLRHLDLSNNSLVSLTYVSFRNLTHLESLHLEDNALKVLHNGTLAELQGLPHIRVFLDNNPWVCDCHMADMVTWLKETEVVQGKDRLTCAYPEKMRNRVLLELNSADLDCDPILPPSLQTSYVFLGIVLALIGAIFLLVLYLNRKGIKKWMHNIRDACRDHMEGYHYRYEINADPRLTNLSSNSDV

SEQ ID NO: 92953 - protein, 420 aa, Homo sapiens; identical to SEQ ID NO: 92952
  Payload ID: 18581
  Gene Name: trophoblast glycoprotein
  Uniprot ID: Q13641
  ENSP ID: ENSP00000440049

SEQ ID NO: 92954 - protein, 420 aa, Homo sapiens; identical to SEQ ID NO: 92952
  Payload ID: 18581
  Gene Name: trophoblast glycoprotein
  Uniprot ID: Q13641
  ENSP ID: ENSP00000441219

SEQ ID NO: 92955 - protein, 420 aa, Homo sapiens; identical to SEQ ID NO: 92952
  Payload ID: 18581
  Gene Name: Trophoblast glycoprotein
  ENSP ID: ENSP00000489140

SEQ ID NO: 92956 - protein, 420 aa, Homo sapiens; identical to SEQ ID NO: 92952
  Payload ID: 18581
  Gene Name: Trophoblast glycoprotein
  ENSP ID: ENSP00000489143

SEQ ID NO: 92957 - protein, 420 aa, Homo sapiens; identical to SEQ ID NO: 92952
  Payload ID: 18581
  Gene Name: Trophoblast glycoprotein
  ENSP ID: ENSP00000489447

SEQ ID NO: 92958 - protein, 382 aa, Homo sapiens
  Payload ID: 18582
  Gene Name: trophoblast glycoprotein-like
  Uniprot ID: P0DKB5
  ENSP ID: ENSP00000474988
MAPRAGQPGLQGLLLVAAALSQPAAPCPFQCYCFGGPKLLLRCASGAELRQPPRDVPPDARNLTIVGANLTVLRAAAFAGGDGDGDQAAGVRLPLLSALRLTHNHIEVVEDGAFDGLPSLAALDLSHNPLRALGGGAFRGLPALRSLQLNHALVRGGPALLAALDAALAPLAELRLLGLAGNALSRLPPAALRLARLEQLDVRLNALAGLDPDELRALERDGGLPGPRLLLADNPLRCGCAARPLLAWLRNATERVPDSRRLRCAAPRALLDRPLLDLDGARLRCADSGADARGEEAEAAGPELEASYVFFGLVLALIGLIFLMVLYLNRRGIQRWMRNLREACRDQMEGYHYRYEQDADPRRAPAPAAPAGSRATSPGSGL

SEQ ID NO: 92959 - protein, 359 aa, Homo sapiens
  Payload ID: 18583
  Gene Name: tropomodulin 1
  Uniprot ID: P28289
  ENSP ID: ENSP00000259365
MSYRRELEKYRDLDEDEILGALTEEELRTLENELDELDPDNALLPAGLRQKDQTTKAPTGPFKREELLDHLEKQAKEFKDREDLVPYTGEKRGKVWVPKQKPLDPVLESVTLEPELEEALANASDAELCDIAAILGMHTLMSNQQYYQALSSSSIMNKEGLNSVIKPTQYKPVPDEEPNSTDVEETLERIKNNDPKLEEVNLNNIRNIPIPTLKAYAEALKENSYVKKFSIVGTRSNDPVAYALAEMLKENKVLKTLNVESNFISGAGILRLVEALPYNTSLVEMKIDNQSQPLGNKVEMEIVSMLEKNATLLKFGYHFTQQGPRLRASNAMMNNNDLVRKRRLADLTGPIIPKCRSGV

SEQ ID NO: 92960 - protein, 232 aa, Homo sapiens
  Payload ID: 18583
  Gene Name: tropomodulin 1
  Uniprot ID: P28289
  ENSP ID: ENSP00000364318
MSQVLSILGMHTLMSNQQYYQALSSSSIMNKEGLNSVIKPTQYKPVPDEEPNSTDVEETLERIKNNDPKLEEVNLNNIRNIPIPTLKAYAEALKENSYVKKFSIVGTRSNDPVAYALAEMLKENKVLKTLNVESNFISGAGILRLVEALPYNTSLVEMKIDNQSQPLGNKVEMEIVSMLEKNATLLKFGYHFTQQGPRLRASNAMMNNNDLVRKRRLADLTGPIIPKCRSGV

SEQ ID NO: 92961 - protein, 359 aa, Homo sapiens; identical to SEQ ID NO: 92959
  Payload ID: 18583
  Gene Name: tropomodulin 1
  Uniprot ID: P28289
  ENSP ID: ENSP00000378637

SEQ ID NO: 92962 - protein, 351 aa, Homo sapiens
  Payload ID: 18584
  Gene Name: tropomodulin 2 (neuronal)
  Uniprot ID: Q9NZR1
  ENSP ID: ENSP00000249700
MALPFQKELEKYKNIDEDELLGKLSEEELKQLENVLDDLDPESAMLPAGFRQKDQTQKAATGPFDREHLLMYLEKEALEQKDREDFVPFTGEKKGRVFIPKEKPIETRKEEKVTLDPELEEALASASDTELYDLAAVLGVHNLLNNPKFDEETANNKGGKGPVRNVVKGEKVKPVFEEPPNPTNVEISLQQMKANDPSLQEVNLNNIKNIPIPTLREFAKALETNTHVKKFSLAATRSNDPVAIAFADMLKVNKTLTSLNIESNFITGTGILALVEALKENDTLTEIKIDNQRQQLGTAVEMEIAQMLEENSRILKFGYQFTKQGPRTRVAAAITKNNDLVRKKRVEADRR

SEQ ID NO: 92963 - protein, 315 aa, Homo sapiens
  Payload ID: 18584
  Gene Name: tropomodulin 2 (neuronal)
  Uniprot ID: Q9NZR1
  ENSP ID: ENSP00000404590
MALPFQKELEKYKNIDEDELLGKLSEEELKQLENVLDDLDPESAMLPAGFRQKDQTQKAATGPFDREHLLMYLEKEALEQKDREDFVPFTGEKKGRVFIPKEKPIETRKEEKVTLDPELEEALASASDTELYDLAAVLGVHNLLNNPKFDEETANNKGGKGPVRNVVKGEKVKPVFEEPPNPTNVEISLQQMKANDPSLQEVNLNNIKAFADMLKVNKTLTSLNIESNFITGTGILALVEALKENDTLTEIKIDNQRQQLGTAVEMEIAQMLEENSRILKFGYQFTKQGPRTRVAAAITKNNDLVRKKRVEADRR

SEQ ID NO: 92964 - protein, 307 aa, Homo sapiens
  Payload ID: 18584
  Gene Name: tropomodulin 2 (neuronal)
  ENSP ID: ENSP00000437743
MLPAGFRQKDQTQKAATGPFDREHLLMYLEKEALEQKDREDFVPFTGEKKGRVFIPKEKPIETRKEEKVTLDPELEEALASASDTELYDLAAVLGVHNLLNNPKFDEETANNKGGKGPVRNVVKGEKVKPVFEEPPNPTNVEISLQQMKANDPSLQEVNLNNIKNIPIPTLREFAKALETNTHVKKFSLAATRSNDPVAIAFADMLKVNKTLTSLNIESNFITGTGILALVEALKENDTLTEIKIDNQRQQLGTAVEMEIAQMLEENSRILKFGYQFTKQGPRTRVAAAITKNNDLVRKKRVEADRR

SEQ ID NO: 92965 - protein, 110 aa, Homo sapiens
  Payload ID: 18584
  Gene Name: tropomodulin 2 (neuronal)
  ENSP ID: ENSP00000453524
  MOD_RES (1)..(1): Any amino acid
XAIAFADMLKVNKTLTSLNIESNFITGTGILALVEALKENDTLTEIKIDNQRQQLGTAVEMEIAQMLEENSRILKFGYQFTKQGPRTRVAAAITKNNDLVRKKRVEADRR

SEQ ID NO: 92966 - protein, 352 aa, Homo sapiens
  Payload ID: 18585
  Gene Name: tropomodulin 3 (ubiquitous)
  Uniprot ID: Q9NYL9
  ENSP ID: ENSP00000308753
MALPFRKDLEKYKDLDEDELLGNLSETELKQLETVLDDLDPENALLPAGFRQKNQTSKSTTGPFDREHLLSYLEKEALEHKDREDYVPYTGEKKGKIFIPKQKPVQTFTEEKVSLDPELEEALTSASDTELCDLAAILGMHNLITNTKFCNIMGSSNGVDQEHFSNVVKGEKILPVFDEPPNPTNVEESLKRTKENDAHLVEVNLNNIKNIPIPTLKDFAKALETNTHVKCFSLAATRSNDPVATAFAEMLKVNKTLKSLNVESNFITGVGILALIDALRDNETLAELKIDNQRQQLGTAVELEMAKMLEENTNILKFGYQFTQQGPRTRAANAITKNNDLVRKRRVEGDHQ

SEQ ID NO: 92967 - protein, 352 aa, Homo sapiens; identical to SEQ ID NO: 92966
  Payload ID: 18585
  Gene Name: tropomodulin 3 (ubiquitous)
  Uniprot ID: Q9NYL9
  ENSP ID: ENSP00000438909

SEQ ID NO: 92968 - protein, 187 aa, Homo sapiens
  Payload ID: 18585
  Gene Name: tropomodulin 3 (ubiquitous)
  ENSP ID: ENSP00000452939
  MOD_RES (1)..(1): Any amino acid
XVVKGEKILPVFDEPPNPTNVEESLKRTKENDAHLVEVNLNNIKNIPIPTLKDFAKALETNTHVKCFSLAATRSNDPVATAFAEMLKVNKTLKSLNVESNFITGVGILALIDALRDNETLAELKIDNQRQQLGTAVELEMAKMLEENTNILKFGYQFTQQGPRTRAANAITKNNDLVRKRRVEGDHQ

SEQ ID NO: 92969 - protein, 213 aa, Homo sapiens
  Payload ID: 18585
  Gene Name: tropomodulin 3 (ubiquitous)
  ENSP ID: ENSP00000454040
MHNLITNTKFCNIMGSSNGVDQEHFSNVVKGEKILPVFDEPPNPTNVEESLKRTKENDAHLVEVNLNNIKNIPIPTLKDFAKALETNTHVKCFSLAATRSNDPVATAFAEMLKVNKTLKSLNVESNFITGVGILALIDALRDNETLAELKIDNQRQQLGTAVELEMAKMLEENTNILKFGYQFTQQGPRTRAANAITKNNDLVRKRRVEGDHQ

SEQ ID NO: 92970 - protein, 33 aa, Homo sapiens
  Payload ID: 18585
  Gene Name: tropomodulin 3 (ubiquitous)
  ENSP ID: ENSP00000454161
MALPFRKDLEKYKDLDEDELLGNLSETELKQLE

SEQ ID NO: 92971 - protein, 345 aa, Homo sapiens
  Payload ID: 18586
  Gene Name: tropomodulin 4 (muscle)
  Uniprot ID: Q9NZQ9
  ENSP ID: ENSP00000295314
MSSYQKELEKYRDIDEDEILRTLSPEELEQLDCELQEMDPENMLLPAGLRQRDQTKKSPTGPLDREALLQYLEQQALEVKERDDLVPFTGEKKGKPYIQPKREIPAEEQITLEPELEEALAHATDAEMCDIAAILDMYTLMSNKQYYDALCSGEICNTEGISSVVQPDKYKPVPDEPPNPTNIEEILKRVRSNDKELEEVNLNNIQDIPIPMLSELCEAMKANTYVRSFSLVATRSGDPIANAVADMLRENRSLQSLNIESNFISSTGLMAVLKAVRENATLTELRVDNQRQWPGDAVEMEMATVLEQCPSIVRFGYHFTQQGPRARAAQAMTRNNELRRQQKKR

SEQ ID NO: 92972 - protein, 142 aa, Homo sapiens
  Payload ID: 18586
  Gene Name: tropomodulin 4 (muscle)
  ENSP ID: ENSP00000406333
MSSYQKELEKYRDIDEDEILRTLSPEELEQLDCELQEMDPENMLLPAGLRQRDQTKKSPTGPLDREALLQYLEQQALEVKERDDLVPFTGEKKGKPYIQPKREIPAEEQITLEPELEEALAHATDAEMCDIAAILDMYTLMS

SEQ ID NO: 92973 - protein, 123 aa, Homo sapiens
  Payload ID: 18586
  Gene Name: tropomodulin 4 (muscle)
  ENSP ID: ENSP00000468006
  MOD_RES (1)..(1): Any amino acid
XDALCSGEICNTEGISSVVQPDKYKPVPDEPPNPTNIEEILKRVRSNDKELEEVNLNNIQAVADMLRENRSLQSLNIESNFISSTGLMAVLKAVRENATLTELRVDNQVASKRRDNTAFPFTN

SEQ ID NO: 92974 - protein, 43 aa, Homo sapiens
  Payload ID: 18586
  Gene Name: tropomodulin 4 (muscle)
  ENSP ID: ENSP00000468489
MSSYQKELEKYRDIDEDEILRTLSPEELEQLDCELQEMDPELD

SEQ ID NO: 92975 - protein, 284 aa, Homo sapiens
  Payload ID: 18587
  Gene Name: tropomyosin 1 (alpha)
  Uniprot ID: P09493
  ENSP ID: ENSP00000267996
MDAIKKKMQMLKLDKENALDRAEQAEADKKAAEDRSKQLEEDIAAKEKLLRVSEDERDRVLEELHKAEDSLLAAEEAAAKAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEEKVAHAKEENLSMHQMLDQTLLELNNM

SEQ ID NO: 92976 - protein, 284 aa, Homo sapiens
  Payload ID: 18587
  Gene Name: tropomyosin 1 (alpha)
  Uniprot ID: P09493
  ENSP ID: ENSP00000288398
MDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQVRQLEEQLRIMDQTLKALMAAEDKYSQKEDRYEEEIKVLSDKLKEAETRAEFAERSVTKLEKSIDDLEDELYAQKLKYKAISEELDHALNDMTSM

SEQ ID NO: 92977 - protein, 245 aa, Homo sapiens
  Payload ID: 18587
  Gene Name: tropomyosin 1 (alpha)
  ENSP ID: ENSP00000322577
MAGSSSLEAVRRKIRSLQEQADAAEERAGTLQRELDHERKLRETAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQVRQLEEQLRIMDQTLKALMAAEDKYSQKEDRYEEEIKVLSDKLKEAETRAEFAERSVTKLEKSIDDLEDQLYQQLEQNRRLTNELKLALNED

SEQ ID NO: 92978 - protein, 245 aa, Homo sapiens
  Payload ID: 18587
  Gene Name: tropomyosin 1 (alpha)
  Uniprot ID: P09493
  ENSP ID: ENSP00000334624
MAGSSSLEAVRRKIRSLQEQADAAEERAGTLQRELDHERKLRETAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEDQLYQQLEQNRRLTNELKLALNED

SEQ ID NO: 92979 - protein, 326 aa, Homo sapiens
  Payload ID: 18587
  Gene Name: tropomyosin 1 (alpha)
  ENSP ID: ENSP00000350667
MDAIKKKMQMLKLDKENALDRAEQAEADKKAAEDRSKQLEEDIAAKEKLLRVSEDERDRVLEELHKAEDSLLAAEEAAAKLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEEKVAHAKEENLSMHQMLDQTLLELNNM

SEQ ID NO: 92980 - protein, 284 aa, Homo sapiens
  Payload ID: 18587
  Gene Name: tropomyosin 1 (alpha)
  Uniprot ID: P09493
  ENSP ID: ENSP00000351022
MDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQVRQLEEQLRIMDQTLKALMAAEDKYSQKEDRYEEEIKVLSDKLKEAETRAEFAERSVTKLEKSIDDLEEKVAHAKEENLSMHQMLDQTLLELNNM

SEQ ID NO: 92981 - protein, 248 aa, Homo sapiens
  Payload ID: 18587
  Gene Name: tropomyosin 1 (alpha)
  ENSP ID: ENSP00000384315
MAGSSSLEAVRRKIRSLQEQADAAEERAGTLQRELDHERKLRETAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQVRQLEEQLRIMDQTLKALMAAEDKYSQKEDRYEEEIKVLSDKLKEAETRAEFAERSVTKLEKSIDDLEEKVAHAKEENLSMHQMLDQTLLELNNM

SEQ ID NO: 92982 - protein, 284 aa, Homo sapiens
  Payload ID: 18587
  Gene Name: tropomyosin 1 (alpha)
  Uniprot ID: P09493
  ENSP ID: ENSP00000385107
MDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEDELYAQKLKYKAISEELDHALNDMTSI

SEQ ID NO: 92983 - protein, 92 aa, Homo sapiens
  Payload ID: 18587
  Gene Name: tropomyosin 1 (alpha)
  ENSP ID: ENSP00000452624
MKVIESRAQKDEEKMEIQEIQLKEAKHIAEDADRKYEEVARKLVIIESDLERAEERAELSEGQVRQLEEQLRIMDQTLKALMAAEDKQMCRA

SEQ ID NO: 92984 - protein, 248 aa, Homo sapiens
  Payload ID: 18587
  Gene Name: tropomyosin 1 (alpha)
  ENSP ID: ENSP00000452658
MAGSSSLEAVRRKIRSLQEQADAAEERAGTLQRELDHERKLRETAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEDELYAQKLKYKAISEELDHALNDMTSI

SEQ ID NO: 92985 - protein, 33 aa, Homo sapiens
  Payload ID: 18587
  Gene Name: tropomyosin 1 (alpha)
  ENSP ID: ENSP00000452830
  MOD_RES (1)..(1): Any amino acid
XIDDLEDELYAQKLKYKAISEELDHALNDMTSM

SEQ ID NO: 92986 - protein, 284 aa, Homo sapiens
  Payload ID: 18587
  Gene Name: tropomyosin 1 (alpha)
  Uniprot ID: P09493
  ENSP ID: ENSP00000452879
MDAIKKKMQMLKLDKENALDRAEQAEADKKAAEDRSKQLEEDIAAKEKLLRVSEDERDRVLEELHKAEDSLLAAEEAAAKAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQVRQLEEQLRIMDQTLKALMAAEDKYSQKEDRYEEEIKVLSDKLKEAETRAEFAERSVTKLEKSIDDLEEKVAHAKEENLSMHQMLDQTLLELNNM

SEQ ID NO: 92987 - protein, 157 aa, Homo sapiens
  Payload ID: 18587
  Gene Name: tropomyosin 1 (alpha)
  ENSP ID: ENSP00000452887
MDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERWPVSWSSLRATWNVQRSGLSSQKAKSDSWKNN

SEQ ID NO: 92988 - protein, 142 aa, Homo sapiens
  Payload ID: 18587
  Gene Name: tropomyosin 1 (alpha)
  ENSP ID: ENSP00000452977
KATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQVRQLEEQLRIMDQTLKALMAAEDKQMCRA

SEQ ID NO: 92989 - protein, 70 aa, Homo sapiens
  Payload ID: 18587
  Gene Name: tropomyosin 1 (alpha)
  ENSP ID: ENSP00000452999
MDAIKKKMQMLKLDKENALDRAEQAEADKKAAEDRSKQLEDELVSLQKKLKGTEDELDKYSELCICLFSS

SEQ ID NO: 92990 - protein, 108 aa, Homo sapiens
  Payload ID: 18587
  Gene Name: tropomyosin 1 (alpha)
  ENSP ID: ENSP00000453050
MKVIESRAQKDEEKMEIQEIQLKEAKHIAEDADRKYEEVARKLVIIESDLERAEERAELSEGQVRQLEEQLRIMDQTLKALMAAEDKYSQKEDRYEEEIKVLSDKLKE

SEQ ID NO: 92991 - protein, 265 aa, Homo sapiens
  Payload ID: 18587
  Gene Name: tropomyosin 1 (alpha)
  ENSP ID: ENSP00000453062
  MOD_RES (1)..(1): Any amino acid
XRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEDELYAQKLKYKAISEELDHALNDMTSM

SEQ ID NO: 92992 - protein, 68 aa, Homo sapiens
  Payload ID: 18587
  Gene Name: tropomyosin 1 (alpha)
  ENSP ID: ENSP00000453092
LNRRIQLVEEELDRAQERLATALQKLEEAEKAADESERGMKVIESRAQKDEEKMEIQEIQLKEQMCRA

SEQ ID NO: 92993 - protein, 8 aa, Homo sapiens
  Payload ID: 18587
  Gene Name: tropomyosin 1 (alpha)
  ENSP ID: ENSP00000453136
MKVIESRA

SEQ ID NO: 92994 - protein, 40 aa, Homo sapiens
  Payload ID: 18587
  Gene Name: tropomyosin 1 (alpha)
  ENSP ID: ENSP00000453324
MDAIKKKMQMLKLDKENALDRAEQAEADKKAAEDRSKQWT

SEQ ID NO: 92995 - protein, 275 aa, Homo sapiens
  Payload ID: 18587
  Gene Name: tropomyosin 1 (alpha)
  ENSP ID: ENSP00000453724
MAGSSSLEAVRRKIRSLQEQADAAEERAGTLQRELDHERKLRETAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQVRQLEEQLRIMDQTLKALMAAEDKYSQKEDRYEEEIKVLSDKLKEAETRAEFAERSVTKLEKSIDDLEGKILSSVFSLILMVEYQPGKTIFQFKGIHIDTLLCTCTFFLCVLWGFSLWLLNS

SEQ ID NO: 92996 - protein, 49 aa, Homo sapiens
  Payload ID: 18587
  Gene Name: tropomyosin 1 (alpha)
  ENSP ID: ENSP00000453817
MAGSSSLEAVRRKIRSLQEQADAAEERAGTLQRELDHERKLRETRHESH

SEQ ID NO: 92997 - protein, 284 aa, Homo sapiens
  Payload ID: 18587
  Gene Name: tropomyosin 1 (alpha)
  Uniprot ID: P09493
  ENSP ID: ENSP00000453941
MDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEEKVAHAKEENLSMHQMLDQTLLELNNM

SEQ ID NO: 92998 - protein, 223 aa, Homo sapiens
  Payload ID: 18587
  Gene Name: tropomyosin 1 (alpha)
  ENSP ID: ENSP00000453955
  MOD_RES (1)..(1): Any amino acid
XELHKAEDSLLAAEEAAAKAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEDELYAQKLKYKAISEELDHALNDMTSM

SEQ ID NO: 92999 - protein, 106 aa, Homo sapiens
  Payload ID: 18587
  Gene Name: tropomyosin 1 (alpha)
  ENSP ID: ENSP00000477929
MDAIKKKMQMLKLDKENALDRAEQAEADKKAAEDRSKQLEDELVSLQKKLKGTEDELDKYSEALKDAQEKLELAEKKATDVSARSHCFPHLLPAWPLRGHHRAGEQ

SEQ ID NO: 93000 - protein, 284 aa, Homo sapiens
  Payload ID: 18588
  Gene Name: tropomyosin 2 (beta)
  Uniprot ID: P07951
  ENSP ID: ENSP00000354219
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESKCGDLEEELKIVTNNLKSLEAQADKYSTKEDKYEEEIKLLEEKLKEAETRAEFAERSVAKLEKTIDDLEDEVYAQKMKYKAISEELDNALNDITSL

SEQ ID NO: 93001 - protein, 284 aa, Homo sapiens
  Payload ID: 18588
  Gene Name: tropomyosin 2 (beta)
  ENSP ID: ENSP00000367541
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESKCGDLEEELKIVTNNLKSLEAQADKYSTKEDKYEEEIKLLEEKLKEAETRAEFAERSVAKLEKTIDDLEETLASAKEENVEIHQTLDQTLLELNNL

SEQ ID NO: 93002 - protein, 284 aa, Homo sapiens
  Payload ID: 18588
  Gene Name: tropomyosin 2 (beta)
  Uniprot ID: P07951
  ENSP ID: ENSP00000367542
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESRARQLEEELRTMDQALKSLMASEEEYSTKEDKYEEEIKLLEEKLKEAETRAEFAERSVAKLEKTIDDLEETLASAKEENVEIHQTLDQTLLELNNL

SEQ ID NO: 93003 - protein, 322 aa, Homo sapiens
  Payload ID: 18588
  Gene Name: tropomyosin 2 (beta)
  ENSP ID: ENSP00000367550
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESKCGDLEEELKIVTNNLKSLEAQADKYSTKEDKYEEEIKLLEEKLKEAETRAEFAERSVAKLEKTIDDLEESTSIATTEHWFTPDTLALTDTPSPCTEPTHKTPWPTLKPLCTGTPWLSLSDSPLHVGTCGPIKP

SEQ ID NO: 93004 - protein, 111 aa, Homo sapiens
  Payload ID: 18588
  Gene Name: tropomyosin 2 (beta)
  ENSP ID: ENSP00000475952
IAEDSDRKYEEVARKLVILEGELERSEERAEVAESKCGDLEEELKIVTNNLKSLEAQADKYSTKEDKYEEEIKLLEEKLKEAETRAEFAERSVAKLEKTIDDLEGKRSLYK

SEQ ID NO: 93005 - protein, 285 aa, Homo sapiens
  Payload ID: 18589
  Gene Name: tropomyosin 3
  ENSP ID: ENSP00000271850
MMEAIKKKMQMLKLDKENALDRAEQAEAEQKQAEERSKQLEDELAAMQKKLKGTEDELDKYSEALKDAQEKLELAEKKAADAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 93006 - protein, 158 aa, Homo sapiens
  Payload ID: 18589
  Gene Name: tropomyosin 3
  Uniprot ID: P06753
  ENSP ID: ENSP00000307712
MKVIENRALKDEEKMELQEIQLKEAKHIAEEADRKYEEVARKLVIIEGDLERTEERAELAESKCSELEEELKNVTNNLKSLEAQAEKYSQKEDKYEEEIKILTDKLKEAETRAEFAERSVAKLEKTIDDLEDKLKCTKEEHLCTQRMLDQTLLDLNEM

SEQ ID NO: 93007 - protein, 248 aa, Homo sapiens
  Payload ID: 18589
  Gene Name: tropomyosin 3
  Uniprot ID: P06753
  ENSP ID: ENSP00000339035
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESKCSELEEELKNVTNNLKSLEAQAEKYSQKEDKYEEEIKILTDKLKEAETRAEFAERSVAKLEKTIDDLEDKLKCTKEEHLCTQRMLDQTLLDLNEM

SEQ ID NO: 93008 - protein, 223 aa, Homo sapiens
  Payload ID: 18589
  Gene Name: tropomyosin 3
  ENSP ID: ENSP00000339378
MAGITTIEAVKRKIQVLQQQADDAEERAERLQREVEGESRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 93009 - protein, 232 aa, Homo sapiens
  Payload ID: 18589
  Gene Name: tropomyosin 3
  ENSP ID: ENSP00000341653
MAGITTIEAVKRKIQVLQQQADDAEERAERLQREVEGERRAREQAEAEVASLNRRIQLVEEELDRAQERLATALQKLEEAEKAADEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 93010 - protein, 285 aa, Homo sapiens
  Payload ID: 18589
  Gene Name: tropomyosin 3
  Uniprot ID: P06753
  ENSP ID: ENSP00000357516
MMEAIKKKMQMLKLDKENALDRAEQAEAEQKQAEERSKQLEDELAAMQKKLKGTEDELDKYSEALKDAQEKLELAEKKAADAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESKCSELEEELKNVTNNLKSLEAQAEKYSQKEDKYEEEIKILTDKLKEAETRAEFAERSVAKLEKTIDDLEDELYAQKLKYKAISEELDHALNDMTSI

SEQ ID NO: 93011 - protein, 247 aa, Homo sapiens
  Payload ID: 18589
  Gene Name: tropomyosin 3
  Uniprot ID: P06753
  ENSP ID: ENSP00000357517
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEERLYSQLERNRLLSNELKLTLHDLCD

SEQ ID NO: 93012 - protein, 247 aa, Homo sapiens
  Payload ID: 18589
  Gene Name: tropomyosin 3
  Uniprot ID: P06753
  ENSP ID: ENSP00000357518
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESKCSELEEELKNVTNNLKSLEAQAEKYSQKEDKYEEEIKILTDKLKEAETRAEFAERSVAKLEKTIDDLEERLYSQLERNRLLSNELKLTLHDLCD

SEQ ID NO: 93013 - protein, 248 aa, Homo sapiens
  Payload ID: 18589
  Gene Name: tropomyosin 3
  Uniprot ID: P06753
  ENSP ID: ENSP00000357520
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDELYAQKLKYKAISEELDHALNDMTSI

SEQ ID NO: 93014 - protein, 248 aa, Homo sapiens
  Payload ID: 18589
  Gene Name: tropomyosin 3
  Uniprot ID: P06753
  ENSP ID: ENSP00000357521
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 93015 - protein, 95 aa, Homo sapiens
  Payload ID: 18589
  Gene Name: tropomyosin 3
  ENSP ID: ENSP00000422207
MAGITTIEAVKRKIQVLQQQADDAEERAERLQREVEGERRAREQAEAEVASLNRRIQLVEEELDRAQERLATALQKLEEAEKAADESERWMSRLD

SEQ ID NO: 93016 - protein, 75 aa, Homo sapiens
  Payload ID: 18589
  Gene Name: tropomyosin 3
  ENSP ID: ENSP00000426306
MMEAIKKKMQMLKLDKENALDRAEQAEAEQKQAEERSKQLEDELAAMQKKLKGTEDELDKYSEALKDAQEKLELA

SEQ ID NO: 93017 - protein, 49 aa, Homo sapiens
  Payload ID: 18589
  Gene Name: tropomyosin 3
  ENSP ID: ENSP00000426521
MAGITTIEAVKRKIQVLQQQADDAEERAERLQREVEGERRAREQRYEGY

SEQ ID NO: 93018 - protein, 227 aa, Homo sapiens
  Payload ID: 18589
  Gene Name: tropomyosin 3
  ENSP ID: ENSP00000480520
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKAETRAEFAERSVAKLEKTIDDLEDKLKCTKEEHLCTQRMLDQTLLDLNEM

SEQ ID NO: 93019 - protein, 248 aa, Homo sapiens
  Payload ID: 18590
  Gene Name: tropomyosin 4
  Uniprot ID: P67936
  ENSP ID: ENSP00000300933
MAGLNSLEAVKRKIQALQQQADEAEDRAQGLQRELDGERERREKAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEEKLAQAKEENVGLHQTLDQTLNELNCI

SEQ ID NO: 93020 - protein, 284 aa, Homo sapiens
  Payload ID: 18590
  Gene Name: tropomyosin 4
  Uniprot ID: P67936
  ENSP ID: ENSP00000345230
MEAIKKKMQMLKLDKENAIDRAEQAEADKKAAEDKCKQVEEELTHLQKKLKGTEDELDKYSEDLKDAQEKLELTEKKASDAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEEKLAQAKEENVGLHQTLDQTLNELNCI

SEQ ID NO: 93021 - protein, 16 aa, Homo sapiens
  Payload ID: 18590
  Gene Name: tropomyosin 4
  ENSP ID: ENSP00000466106
MKVIENRAMKDEEKME

SEQ ID NO: 93022 - protein, 69 aa, Homo sapiens
  Payload ID: 18590
  Gene Name: tropomyosin 4
  ENSP ID: ENSP00000466158
MEAIKKKMQMLKLDKENAIDRAEQAEADKKAAEDKCKQVEEELTHLQKKLKGTEDELDKYSEDLKDAQE

SEQ ID NO: 93023 - protein, 102 aa, Homo sapiens
  Payload ID: 18590
  Gene Name: tropomyosin 4
  ENSP ID: ENSP00000466654
MKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLL

SEQ ID NO: 93024 - protein, 179 aa, Homo sapiens
  Payload ID: 18590
  Gene Name: tropomyosin 4
  ENSP ID: ENSP00000467087
MVEEELTHLQKKLKGTEDELDKYSEDLKDAQEKLELTEKKASDAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSE

SEQ ID NO: 93025 - protein, 138 aa, Homo sapiens
  Payload ID: 18590
  Gene Name: tropomyosin 4
  ENSP ID: ENSP00000467250
MSSMPATKFSFPFHIFLSCHLSARRIEGWNSNEAPPPRPTLAEGDVAALNRRIQLVEEELDRAQERLATALQKLEEAEKAADESERGMKVIENRAMKDEEKMEIQEMQLKEAKHIAEEADRKYEEVARKLVILEGELE

SEQ ID NO: 93026 - protein, 110 aa, Homo sapiens
  Payload ID: 18590
  Gene Name: tropomyosin 4
  ENSP ID: ENSP00000467319
  MOD_RES (1)..(1): Any amino acid
XLERAEERAEVSELKCGDLEEELKNVTNNLKSLEAASEKYSEKEDKYEEEIKLLSDKLKEAETRAEFAERTVAKLEKTIDDLEEKLAQAKEENVGLHQTLDQTLNELNCI

SEQ ID NO: 93027 - protein, 96 aa, Homo sapiens
  Payload ID: 18590
  Gene Name: tropomyosin 4
  ENSP ID: ENSP00000467558
MKVIENRAMKDEEKMEIQEMQLKEAKHIAEEADRKYEEVARKLVILEGELERAEERAEVSELKCGDLEEELKNVTNNLKSLEAASEKYSEKEDKYE

SEQ ID NO: 93028 - protein, 59 aa, Homo sapiens
  Payload ID: 18590
  Gene Name: tropomyosin 4
  ENSP ID: ENSP00000468010
KLLSDKLKEAETRAEFAERTVAKLEKTIDDLEDELYAQKLKYKAISEELDHALNDMTSL

SEQ ID NO: 93029 - protein, 170 aa, Homo sapiens
  Payload ID: 18590
  Gene Name: tropomyosin 4
  ENSP ID: ENSP00000468246
MGSWAGRGVTIGPTPSRASANKVEEELTHLQKKLKGTEDELDKYSEDLKDAQEKLELTEKKASDAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVS

SEQ ID NO: 93030 - protein, 161 aa, Homo sapiens
  Payload ID: 18591
  Gene Name: troponin C type 1 (slow)
  Uniprot ID: P63316
  ENSP ID: ENSP00000232975
MDDIYKAAVEQLTEEQKNEFKAAFDIFVLGAEDGCISTKELGKVMRMLGQNPTPEELQEMIDEVDEDGSGTVDFDEFLVMMVRCMKDDSKGKSEEELSDLFRMFDKNADGYIDLDELKIMLQATGETITEDDIEELMKDGDKNNDGRIDYDEFLEFMKGVE

SEQ ID NO: 93031 - protein, 99 aa, Homo sapiens
  Payload ID: 18591
  Gene Name: troponin C type 1 (slow)
  ENSP ID: ENSP00000420596
MRMLGQNPTPEELQEMIDEVDEDGSGTVDFDEFLVMMVRCMKDDSKGKSEEELSDLFRMFDKNADGYIDLDELKIMLQATGETITEDDIEELMKDGDKN

SEQ ID NO: 93032 - protein, 160 aa, Homo sapiens
  Payload ID: 18592
  Gene Name: troponin C type 2 (fast)
  Uniprot ID: P02585
  ENSP ID: ENSP00000361636
MTDQQAEARSYLSEEMIAEFKAAFDMFDADGGGDISVKELGTVMRMLGQTPTKEELDAIIEEVDEDGSGTIDFEEFLVMMVRQMKEDAKGKSEEELAECFRIFDRNADGYIDPEELAEIFRASGEHVTDEEIESLMKDGDKNNDGRIDFDEFLKMMEGVQ

SEQ ID NO: 93033 - protein, 145 aa, Homo sapiens
  Payload ID: 18592
  Gene Name: troponin C type 2 (fast)
  ENSP ID: ENSP00000361638
MIAEFKAAFDMFDADGGGDISVKELGTVMRMLGQTPTKEELDAIIEEVDEDGSGTIDFEEFLVMMVRQMKEDAKGKSEEELAECFRIFDRNADGYIDPEELAEIFRASGEHVTDEEIESLMKDGDKNNDGRIDFDEFLKMMEGVQ

SEQ ID NO: 93034 - protein, 187 aa, Homo sapiens
  Payload ID: 18593
  Gene Name: troponin I type 1 (skeletal, slow)
  Uniprot ID: P19237
  ENSP ID: ENSP00000337022
MPEVERKPKITASRKLLLKSLMLAKAKECWEQEHEEREAEKVRYLAERIPTLQTRGLSLSALQDLCRELHAKVEVVDEERYDIEAKCLHNTREIKDLKLKVMDLRGKFKRPPLRRVRVSADAMLRALLGSKHKVSMDLRANLKSVKKEDTEKERPVEVGDWRKNVEAMSGMEGRKKMFDAAKSPTSQ

SEQ ID NO: 93035 - protein, 187 aa, Homo sapiens; identical to SEQ ID NO: 93034
  Payload ID: 18593
  Gene Name: troponin I type 1 (skeletal, slow)
  Uniprot ID: P19237
  ENSP ID: ENSP00000354488

SEQ ID NO: 93036 - protein, 187 aa, Homo sapiens; identical to SEQ ID NO: 93034
  Payload ID: 18593
  Gene Name: troponin I type 1 (skeletal, slow)
  Uniprot ID: P19237
  ENSP ID: ENSP00000356281

SEQ ID NO: 93037 - protein, 105 aa, Homo sapiens
  Payload ID: 18593
  Gene Name: troponin I type 1 (skeletal, slow)
  ENSP ID: ENSP00000451307
MPEVERKPKITASRKLLLKSLMLAKAKECWEQEHEEREAEKVRYLAERIPTLQTRGLSLSALQDLCRELHAKVEVVDEERYDIEAMSGMEGRKKMFDAAKSPTSQ

SEQ ID NO: 93038 - protein, 131 aa, Homo sapiens
  Payload ID: 18593
  Gene Name: troponin I type 1 (skeletal, slow)
  ENSP ID: ENSP00000451660
MLAKAKECWEQEHEEREAEKVRYLAERIPTLQTRGLSLSALQDLCRELHAKVEVVDEERYDIEAKCLHNTREIKDLKLKVMDLRGKFKRPPLRRVRVSADAMLRALLGSKHKVSMDLRANLKSVKKEDTEK

SEQ ID NO: 93039 - protein, 137 aa, Homo sapiens
  Payload ID: 18593
  Gene Name: troponin I type 1 (skeletal, slow)
  ENSP ID: ENSP00000451776
MPEVERKPKITASRKLLLKSLMLAKAKECWEQEHEEREAEKVRYLAERIPTLQTRGLSLSALQDLCRELHAKVEVVDEERYDIEAKCLHNTREIKDLKLKVMDLRGKFKRPPLRRVRVSADAMLRALLGSKHKVSMD

SEQ ID NO: 93040 - protein, 187 aa, Homo sapiens [sequence omitted]

SEQ ID NO: 93041 - protein, 182 aa, Homo sapiens
  Payload ID: 18594
  Gene Name: troponin I type 2 (skeletal, fast)
  Uniprot ID: P48788
  ENSP ID: ENSP00000252898
MGDEEKRNRAITARRQHLKSVMLQIAATELEKEESRREAEKQNYLAEHCPPLHIPGSMSEVQELCKQLHAKIDAAEEEKYDMEVRVQKTSKELEDMNQKLFDLRGKFKRPPLRRVRMSADAMLKALLGSKHKVCMDLRANLKQVKKEDTEKERDLRDVGDWRKNIEEKSGMEGRKKMFESES

SEQ ID NO: 93042 - protein, 182 aa, Homo sapiens
  Payload ID: 18594
  Gene Name: troponin I type 2 (skeletal, fast)
  Uniprot ID: P48788
  ENSP ID: ENSP00000371330
MSQCKKRNRAITARRQHLKSVMLQIAATELEKEESRREAEKQNYLAEHCPPLHIPGSMSEVQELCKQLHAKIDAAEEEKYDMEVRVQKTSKELEDMNQKLFDLRGKFKRPPLRRVRMSADAMLKALLGSKHKVCMDLRANLKQVKKEDTEKERDLRDVGDWRKNIEEKSGMEGRKKMFESES

SEQ ID NO: 93043 - protein, 182 aa, Homo sapiens; identical to SEQ ID NO: 93041
  Payload ID: 18594
  Gene Name: troponin I type 2 (skeletal, fast)
  Uniprot ID: P48788
  ENSP ID: ENSP00000371331

SEQ ID NO: 93044 - protein, 182 aa, Homo sapiens; identical to SEQ ID NO: 93041
  Payload ID: 18594
  Gene Name: troponin I type 2 (skeletal, fast)
  Uniprot ID: P48788
  ENSP ID: ENSP00000371336

SEQ ID NO: 93045 - protein, 182 aa, Homo sapiens
  Payload ID: 18594
  Gene Name: troponin I type 2 (skeletal, fast)
  ENSP ID: ENSP00000481242
MGDLQKRNRAITARRQHLKSVMLQIAATELEKEESRREAEKQNYLAEHCPPLHIPGSMSEVQELCKQLHAKIDAAEEEKYDMEVRVQKTSKELEDMNQKLFDLRGKFKRPPLRRVRMSADAMLKALLGSKHKVCMDLRANLKQVKKEDTEKERDLRDVGDWRKNIEEKSGMEGRKKMFESES

SEQ ID NO: 93046 - protein, 210 aa, Homo sapiens
  Payload ID: 18595
  Gene Name: troponin I type 3 (cardiac)
  Uniprot ID: P19429
  ENSP ID: ENSP00000341838
MADGSSDAAREPRPAPAPIRRRSSNYRAYATEPHAKKKSKISASRKLQLKTLLLQIAKQELEREAEERRGEKGRALSTRCQPLELAGLGFAELQDLCRQLHARVDKVDEERYDIEAKVTKNITEIADLTQKIFDLRGKFKRPTLRRVRISADAMMQALLGARAKESLDLRAHLKQVKKEDTEKENREVGDWRKNIDALSGMEGRKKKFES

SEQ ID NO: 93047 - protein, 57 aa, Homo sapiens
  Payload ID: 18595
  Gene Name: troponin I type 3 (cardiac)
  ENSP ID: ENSP00000465258
MILPCSISPWQKKSKISASRKLQLKPRVGCASLPPLCRLCCCRLQSKSWSERRRSGA

SEQ ID NO: 93048 - protein, 185 aa, Homo sapiens
  Payload ID: 18595
  Gene Name: troponin I type 3 (cardiac)
  ENSP ID: ENSP00000466729
MILPCSISPWQKKSKISASRKLQLKTLLLQIAKQELEREAEERRGEKGRALSTRCQPLELAGLGFAELQDLCRQLHARVDKVDEERYDIEAKVTKNITEIADLTQKIFDLRGKFKRPTLRRVRISADAMMQALLGARAKESLDLRAHLKQVKKEDTEKENREVGDWRKNIDALSGMEGRKKKFES

SEQ ID NO: 93049 - protein, 262 aa, Homo sapiens
  Payload ID: 18596
  Gene Name: troponin T type 1 (skeletal, slow)
  Uniprot ID: P13805
  ENSP ID: ENSP00000291901
MSDTEEQEYEEEQPEEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLKQQKYEINVLYNRISHAQKFRKGAGKGRVGGRWK

SEQ ID NO: 93050 - protein, 251 aa, Homo sapiens
  Payload ID: 18596
  Gene Name: troponin T type 1 (skeletal, slow)
  Uniprot ID: P13805
  ENSP ID: ENSP00000349233
MSDTEEQEYEEEQPEEEAAEEEEEEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLKQQKYEINVLYNRISHAQKFRKGAGKGRVGGRWK

SEQ ID NO: 93051 - protein, 192 aa, Homo sapiens
  Payload ID: 18596
  Gene Name: troponin T type 1 (skeletal, slow)
  ENSP ID: ENSP00000439640
MEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLKQQKYEINVLYNRISHAQKFRKGAGKGRVGGRWK

SEQ ID NO: 93052 - protein, 192 aa, Homo sapiens; identical to SEQ ID NO: 93051
  Payload ID: 18596
  Gene Name: troponin T type 1 (skeletal, slow)
  ENSP ID: ENSP00000464843

SEQ ID NO: 93053 - protein, 67 aa, Homo sapiens
  Payload ID: 18596
  Gene Name: troponin T type 1 (skeletal, slow)
  ENSP ID: ENSP00000465544
  MOD_RES (1)..(1): Any amino acid
XEPVAEPEEERPKPSPPQLGPSTFRSLPGLAATSLDGTSRRWEVAQGGRATHGLCVSVHSAAPWCLL

SEQ ID NO: 93054 - protein, 147 aa, Homo sapiens
  Payload ID: 18596
  Gene Name: troponin T type 1 (skeletal, slow)
  ENSP ID: ENSP00000465686
  MOD_RES (1)..(1): Any amino acid
XRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLKQQKYEINVLYNRISHAQKFRKGAGKGRVGGRWK

SEQ ID NO: 93055 - protein, 159 aa, Homo sapiens
  Payload ID: 18596
  Gene Name: troponin T type 1 (skeletal, slow)
  ENSP ID: ENSP00000465991
MRRSSRKRRLRRRRRKKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLKQQKYEINVLYNRISHAQKFRKGAGKGRVGGRWK

SEQ ID NO: 93056 - protein, 278 aa, Homo sapiens
  Payload ID: 18596
  Gene Name: troponin T type 1 (skeletal, slow)
  Uniprot ID: P13805
  ENSP ID: ENSP00000467176
MSDTEEQEYEEEQPEEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLRARSAWLPPSQPSCPAREKAQELSDWIHQLESEKFDLMAKLKQQKYEINVLYNRISHAQKFRKGAGKGRVGGRWK

SEQ ID NO: 93057 - protein, 144 aa, Homo sapiens
  Payload ID: 18596
  Gene Name: troponin T type 1 (skeletal, slow)
  ENSP ID: ENSP00000467299
MSDTEEQEYEEEQPEEEAAEEEEEGEVPDSAEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDA

SEQ ID NO: 93058 - protein, 251 aa, Homo sapiens; identical to SEQ ID NO: 93050
  Payload ID: 18596
  Gene Name: troponin T type 1 (skeletal, slow)
  Uniprot ID: P13805
  ENSP ID: ENSP00000467789

SEQ ID NO: 93059 - protein, 210 aa, Homo sapiens
  Payload ID: 18596
  Gene Name: troponin T type 1 (skeletal, slow)
  ENSP ID: ENSP00000467881
  MOD_RES (1)..(1): Any amino acid
XKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQLREKAQELSDWIHQLESEKFDLMAKLKQQKYEINVLYNRISHAQKFRKGAGKGRVGGRWK

SEQ ID NO: 93060 - protein, 192 aa, Homo sapiens; identical to SEQ ID NO: 93051
  Payload ID: 18596
  Gene Name: troponin T type 1 (skeletal, slow)
  ENSP ID: ENSP00000467980

SEQ ID NO: 93061 - protein, 104 aa, Homo sapiens
  Payload ID: 18596
  Gene Name: troponin T type 1 (skeletal, slow)
  ENSP ID: ENSP00000469564
  MOD_RES (1)..(1): Any amino acid
XEMKVRILSERKKPLDIDYMGEEQLREKAQELSDWIHQLESEKFDLMAKLKQQKYEINVLYNRISHAQKLLRLALSPRLECSGVISAHCNFHLPGSSDSPASAP

SEQ ID NO: 93062 - protein, 203 aa, Homo sapiens
  Payload ID: 18596
  Gene Name: troponin T type 1 (skeletal, slow)
  ENSP ID: ENSP00000470777
MSDTEEQEYEEEQPEEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFGGYLVKAEQKRGKRQTGREMKVRILSERKKPLDIDYMGEEQL

SEQ ID NO: 93063 - protein, 151 aa, Homo sapiens
  Payload ID: 18596
  Gene Name: troponin T type 1 (skeletal, slow)
  ENSP ID: ENSP00000470854
MSDTEEQEYEEEQPEEEAAEEEEEEEERPKPSRPVVPPLIPPKIPEGERVDFDDIHRKRMEKDLLELQTLIDVHFEQRKKEEEELVALKERIERRRSERAEQQRFRTEKERERQAKLAEEKMRKEEEEAKKRAEDDAKKKKVLSNMGAHFG

SEQ ID NO: 93064 - protein, 298 aa, Homo sapiens
  Payload ID: 18597
  Gene Name: troponin T type 2 (cardiac)
  Uniprot ID: P45379
  ENSP ID: ENSP00000236918
MSDIEEVVEEYEEEEQEEAAVEEEEDWREDEDEQEEAAEEDAEAEAETEETRAEEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQKQAQTERKSGKRQTEREKKKKILAERRKVLAIDHLNEDQLREKAKELWQSIYNLEAEKFDLQEKFKQQKYEINVLRNRINDNQKVSKTRGKAKVTGRWK

SEQ ID NO: 93065 - protein, 255 aa, Homo sapiens
  Payload ID: 18597
  Gene Name: troponin T type 2 (cardiac)
  Uniprot ID: P45379
  ENSP ID: ENSP00000353535
MSDIEEVVEEYEEEEQEEAAVEEEEDWREDEDEQEEAAEEDAEAEAETEETRAEDEEEEEAKEAEDGPMEESKPKPRSFMPNLVPPKIPDGERVDFDERRRAERAEQQRIRNEREKERQNRLAEERARREEEENRRKAEDEARKKKALSNMMHFGGYIQKTERKSGKRQTEREKKKKILAERRKVLAIDHLNEDQLREKAKELWQSIYNLEAEKFDLQEKFKQQKYEINVLRNRINDNQKVSKTRGKAKVTGRWK

SEQ ID NO: 93066 - protein, 291 aa, Homo sapiens [sequence omitted]

SEQ ID NO: 93067 - protein, 282 aa, Homo sapiens
  Payload ID: 18597
  Gene Name: troponin T type 2 (cardiac)
  ENSP ID: ENSP00000356286
MSDIEEVVEEYEEEEQEEQEEAAEEDAEAEAETEETRAEEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQKAQTERKSGKRQTEREKKKKILAERRKVLAIDHLNEDQLREKAKELWQSIYNLEAEKFDLQEKFKQQKYEINVLRNRINDNQKVSKTRGKAKVTGRWK

SEQ ID NO: 93068 - protein, 288 aa, Homo sapiens
  Payload ID: 18597
  Gene Name: troponin T type 2 (cardiac)
  Uniprot ID: P45379
  ENSP ID: ENSP00000356287
MSDIEEVVEEYEEEEQEEAAVEEQEEAAEEDAEAEAETEETRAEEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQKQAQTERKSGKRQTEREKKKKILAERRKVLAIDHLNEDQLREKAKELWQSIYNLEAEKFDLQEKFKQQKYEINVLRNRINDNQKVSKTRGKAKVTGRWK

SEQ ID NO: 93069 - protein, 255 aa, Homo sapiens; identical to SEQ ID NO: 93065
  Payload ID: 18597
  Gene Name: troponin T type 2 (cardiac)
  Uniprot ID: P45379
  ENSP ID: ENSP00000356289

SEQ ID NO: 93070 - protein, 285 aa, Homo sapiens
  Payload ID: 18597
  Gene Name: troponin T type 2 (cardiac)
  Uniprot ID: P45379
  ENSP ID: ENSP00000356291
MSDIEEVVEEYEEEEQEEAAVEEQEEAAEEDAEAEAETEETRAEEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQKTERKSGKRQTEREKKKKILAERRKVLAIDHLNEDQLREKAKELWQSIYNLEAEKFDLQEKFKQQKYEINVLRNRINDNQKVSKTRGKAKVTGRWK

SEQ ID NO: 93071 - protein, 226 aa, Homo sapiens
  Payload ID: 18597
  Gene Name: troponin T type 2 (cardiac)
  ENSP ID: ENSP00000387874
MEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQKTERKSGKRQTEREKKKKILAERRKVLAIDHLNEDQLREKAKELWQSIYNLEAEKFDLQEKFKQQKYEINVLRNRINDNQKVSKTRGKAKVTGRWK

SEQ ID NO: 93072 - protein, 114 aa, Homo sapiens
  Payload ID: 18597
  Gene Name: troponin T type 2 (cardiac)
  ENSP ID: ENSP00000395163
MSDIEEVVEEYEEEEQEEEEDWREDEDEQEEAAEEDAEAEAETEETRAEEDEEEEEAKEAEDGPMEESKPKPRSFMPNLVPPKIPDGERVDFDDIHRKRMEKDLNELQALIEAH

SEQ ID NO: 93073 - protein, 180 aa, Homo sapiens
  Payload ID: 18597
  Gene Name: troponin T type 2 (cardiac)
  ENSP ID: ENSP00000402238
MSDIEEVVEEYEEEEQEEAAVEEEEDWREDEDEQEEAAEEDAEAEAETEETRAEEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAED

SEQ ID NO: 93074 - protein, 226 aa, Homo sapiens; identical to SEQ ID NO: 93071
  Payload ID: 18597
  Gene Name: troponin T type 2 (cardiac)
  ENSP ID: ENSP00000404134

SEQ ID NO: 93075 - protein, 97 aa, Homo sapiens
  Payload ID: 18597
  Gene Name: troponin T type 2 (cardiac)
  ENSP ID: ENSP00000408731
MSDIEEVVEEYEEEEQEEAAVEEQEEAAEEDAEAEAETEETRAEDEEEEEAKEAEDGPMEESKPKPRSFMPNLVPPKIPDGERVDFDDIHRKRMEKD

SEQ ID NO: 93076 - protein, 271 aa, Homo sapiens
  Payload ID: 18597
  Gene Name: troponin T type 2 (cardiac)
  ENSP ID: ENSP00000414036
MSDIEEVVEEYEEEEQEEQEEAAEEDAEAEAETEETRAEEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQKAQTERKSGKRQTEREKKKKILAERRKVLAIDHLNEDQLREKAKELWQSIYNLEAEKFDLQEKFKQQKYEINVLRNRINDNQKVSKT

SEQ ID NO: 93077 - protein, 288 aa, Homo sapiens; identical to SEQ ID NO: 93068
  Payload ID: 18597
  Gene Name: troponin T type 2 (cardiac)
  Uniprot ID: P45379
  ENSP ID: ENSP00000422031

SEQ ID NO: 93078 - protein, 258 aa, Homo sapiens
  Payload ID: 18598
  Gene Name: troponin T type 3 (skeletal, fast)
  Uniprot ID: P45378
  ENSP ID: ENSP00000278317
MSDEEVEQVEEQYEEEEEAQEEEEVQEDTAEEDAEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 93079 - protein, 245 aa, Homo sapiens
  Payload ID: 18598
  Gene Name: troponin T type 3 (skeletal, fast)
  Uniprot ID: P45378
  ENSP ID: ENSP00000344870
MSDEEVEQVEEQYEEEEEAQEEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 93080 - protein, 244 aa, Homo sapiens
  Payload ID: 18598
  Gene Name: troponin T type 3 (skeletal, fast)
  ENSP ID: ENSP00000370969
MSDEEVEQVEEEAQEEEEVQEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 93081 - protein, 250 aa, Homo sapiens
  Payload ID: 18598
  Gene Name: troponin T type 3 (skeletal, fast)
  Uniprot ID: P45378
  ENSP ID: ENSP00000370970
MSDEEVEQVEEQYEEEEEAQEEEEVQEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 93082 - protein, 261 aa, Homo sapiens
  Payload ID: 18598
  Gene Name: troponin T type 3 (skeletal, fast)
  Uniprot ID: P45378
  ENSP ID: ENSP00000370975
MSDEEVEQVEEQYEEEEEAQEEAAEVHEEVHEPEEVQEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 93083 - protein, 250 aa, Homo sapiens
  Payload ID: 18598
  Gene Name: troponin T type 3 (skeletal, fast)
  Uniprot ID: P45378
  ENSP ID: ENSP00000370991
MSDEEVEQVEEQYEEEEEAQEEEEVQEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDIMNVRARVQMLAKFSKKAGTPAKGKVGGRWK

SEQ ID NO: 93084 - protein, 256 aa, Homo sapiens
  Payload ID: 18598
  Gene Name: troponin T type 3 (skeletal, fast)
  Uniprot ID: P45378
  ENSP ID: ENSP00000371001
MSDEEVEQVEEQYEEEEEAQEEAAEVHEEVHEPEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 93085 - protein, 269 aa, Homo sapiens
  Payload ID: 18598
  Gene Name: troponin T type 3 (skeletal, fast)
  Uniprot ID: P45378
  ENSP ID: ENSP00000380468
MSDEEVEQVEEQYEEEEEAQEEAAEVHEEVHEPEEVQEDTAEEDAEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 93086 - protein, 239 aa, Homo sapiens
  Payload ID: 18598
  Gene Name: troponin T type 3 (skeletal, fast)
  ENSP ID: ENSP00000380471
MSDEEVEQVEEEAQEEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 93087 - protein, 239 aa, Homo sapiens
  Payload ID: 18598
  Gene Name: troponin T type 3 (skeletal, fast)
  ENSP ID: ENSP00000413203
MSDEEVEQVEEEAQEEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDIMNVRARVQMLAKFSKKAGTPAKGKVGGRWK

SEQ ID NO: 93088 - protein, 208 aa, Homo sapiens
  Payload ID: 18598
  Gene Name: troponin T type 3 (skeletal, fast)
  ENSP ID: ENSP00000415614
MSDEEVEQVEEQYEEEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYD

SEQ ID NO: 93089 - protein, 538 aa, Homo sapiens
  Payload ID: 18599
  Gene Name: TROVE domain family, member 2
  Uniprot ID: P10155
  ENSP ID: ENSP00000356411
MEESVNQMQPLNEKQIANSQDGYVWQVTDMNRLHRFLCFGSEGGTYYIKEQKLGLENAEALIRLIEDGRGCEVIQEIKSFSQEGRTTKQEPMLFALAICSQCSDISTKQAAFKAVSEVCRIPTHLFTFIQFKKDLKESMKCGMWGRALRKAIADWYNEKGGMALALAVTKYKQRNGWSHKDLLRLSHLKPSSEGLAIVTKYITKGWKEVHELYKEKALSVETEKLLKYLEAVEKVKRTRDELEVIHLIEEHRLVREHLLTNHLKSKEVWKALLQEMPLTALLRNLGKMTANSVLEPGNSEVSLVCEKLCNEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRGMLDMCGFDTGALDVIRNFTLDMI

SEQ ID NO: 93090 - protein, 518 aa, Homo sapiens
  Payload ID: 18599
  Gene Name: TROVE domain family, member 2
  Uniprot ID: P10155
  ENSP ID: ENSP00000356413
MEESVNQMQPLNEKQIANSQDGYVWQVTDMNRLHRFLCFGSEGGTYYIKEQKLGLENAEALIRLIEDGRGCEVIQEIKSFSQEGRTTKQEPMLFALAICSQCSDISTKQAAFKAVSEVCRIPTHLFTFIQFKKDLKESMKCGMWGRALRKAIADWYNEKGGMALALAVTKYKQRNGWSHKDLLRLSHLKPSSEGLAIVTKYITKGWKEVHELYKEKALSVETEKLLKYLEAVEKVKRTRDELEVIHLIEEHRLVREHLLTNHLKSKEVWKALLQEMPLTALLRNLGKMTANSVLEPGNSEVSLVCEKLCNEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRDTVK

SEQ ID NO: 93091 - protein, 525 aa, Homo sapiens
  Payload ID: 18599
  Gene Name: TROVE domain family, member 2
  Uniprot ID: P10155
  ENSP ID: ENSP00000356414
MEESVNQMQPLNEKQIANSQDGYVWQVTDMNRLHRFLCFGSEGGTYYIKEQKLGLENAEALIRLIEDGRGCEVIQEIKSFSQEGRTTKQEPMLFALAICSQCSDISTKQAAFKAVSEVCRIPTHLFTFIQFKKDLKESMKCGMWGRALRKAIADWYNEKGGMALALAVTKYKQRNGWSHKDLLRLSHLKPSSEGLAIVTKYITKGWKEVHELYKEKALSVETEKLLKYLEAVEKVKRTRDELEVIHLIEEHRLVREHLLTNHLKSKEVWKALLQEMPLTALLRNLGKMTANSVLEPGNSEVSLVCEKLCNEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRALQNTLLNKSF

SEQ ID NO: 93092 - protein, 534 aa, Homo sapiens
  Payload ID: 18599
  Gene Name: TROVE domain family, member 2
  Uniprot ID: P10155
  ENSP ID: ENSP00000356415
MEESVNQMQPLNEKQIANSQDGYVWQVTDMNRLHRFLCFGSEGGTYYIKEQKLGLENAEALIRLIEDGRGCEVIQEIKSFSQEGRTTKQEPMLFALAICSQCSDISTKQAAFKAVSEVCRIPTHLFTFIQFKKDLKESMKCGMWGRALRKAIADWYNEKGGMALALAVTKYKQRNGWSHKDLLRLSHLKPSSEGLAIVTKYITKGWKEVHELYKEKALSVETEKLLKYLEAVEKVKRTRDELEVIHLIEEHRLVREHLLTNHLKSKEVWKALLQEMPLTALLRNLGKMTANSVLEPGNSEVSLVCEKLCNEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRGMLDMCGFDTGALDPCKIPY

SEQ ID NO: 93093 - protein, 538 aa, Homo sapiens; identical to SEQ ID NO: 93089
  Payload ID: 18599
  Gene Name: TROVE domain family, member 2
  Uniprot ID: P10155
  ENSP ID: ENSP00000356416

SEQ ID NO: 93094 - protein, 538 aa, Homo sapiens; identical to SEQ ID NO: 93089
  Payload ID: 18599
  Gene Name: TROVE domain family, member 2
  Uniprot ID: P10155
  ENSP ID: ENSP00000383752

SEQ ID NO: 93095 - protein, 66 aa, Homo sapiens
  Payload ID: 18599
  Gene Name: TROVE domain family, member 2
  ENSP ID: ENSP00000401176
MEESVNQMQPLNEKQIANSQDGYVWQVTDMNRLHRFLCFGSEGLAIVTKYITKGWKEVHELYKEKA

SEQ ID NO: 93096 - protein, 193 aa, Homo sapiens
  Payload ID: 18599
  Gene Name: TROVE domain family, member 2
  ENSP ID: ENSP00000424612
ALIRLIEDGRGCEVIQEIKSFSQEGRTTKQEPMLFALAICSQCSDISTKQAAFKAVSEVCRIPTHLFTFIQFKKDLKESMKCGMWGRALRKAIADWYNEKGGMALALAVTKYKQRNGWSHKDLLRLSHLKPSSEVKLEKTATQKGGFTFQFCGLKPRLAIVTKYITKGWKEVHELYKEKALSVETEKLLKYLE

SEQ ID NO: 93097 - protein, 41 aa, Homo sapiens
  Payload ID: 18599
  Gene Name: TROVE domain family, member 2
  ENSP ID: ENSP00000425296
MEESVNQMQPLNEKQIANSQDGYVWQVTDMNRLHRFLCFGS

SEQ ID NO: 93098 - protein, 263 aa, Homo sapiens
  Payload ID: 18599
  Gene Name: TROVE domain family, member 2
  ENSP ID: ENSP00000472298
MPLTALLRNLGKMTANSVLEPGNSEVSLVCEKLCNEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRGMLDMCGFDTGALDVIRNFTLDMI

SEQ ID NO: 93099 - protein, 919 aa, Homo sapiens
  Payload ID: 18600
  Gene Name: TRPM8 channel-associated factor 1
  Uniprot ID: Q9Y4C2
  ENSP ID: ENSP00000348220
MATPSAAFEALMNGVTSWDVPEDAVPCELLLIGEASFPVMVNDMGQVLIAASSYGRGRLVVVSHEDYLVEAQLTPFLLNAVGWLCSSPGAPIGVHPSLAPLAKILEGSGVDAKVEPEVKDSLGVYCIDAYNETMTEKLVKFMKCGGGLLIGGQAWDWANQGEDERVLFTFPGNLVTSVAGIYFTDNKGDTSFFKVSKKMPKIPVLVSCEDDLSDDREELLHGISELDISNSDCFPSQLLVHGALAFPLGLDSYHGCVIAAARYGRGRVVVTGHKVLFTVGKLGPFLLNAVRWLDGGRRGKVVVQTELRTLSGLLAVGGIDTSIEPNLTSDASVYCFEPVSEVGVKELQEFVAEGGGLFVGAQAWWWAFKNPGVSPLARFPGNLLLNPFGISITSQSLNPGPFRTPKAGIRTYHFRSTLAEFQVIMGRKRGNVEKGWLAKLGPDGAAFLQIPAEEIPAYMSVHRLLRKLLSRYRLPVATRENPVINDCCRGAMLSLATGLAHSGSDLSLLVPEIEDMYSSPYLRPSESPITVEVNCTNPGTRYCWMSTGLYIPGRQIIEVSLPEAAASADLKIQIGCHTDDLTRASKLFRGPLVINRCCLDKPTKSITCLWGGLLYIIVPQNSKLGSVPVTVKGAVHAPYYKLGETTLEEWKRRIQENPGPWGELATDNIILTVPTANLRTLENPEPLLRLWDEVMQAVARLGAEPFPLRLPQRIVADVQISVGWMHAGYPIMCHLESVQELINEKLIRTKGLWGPVHELGRNQQRQEWEFPPHTTEATCNLWCVYVHETVLGIPRSRANIALWPPVREKRVRIYLSKGPNVKNWNAWTALETYLQLQEAFGWEPFIRLFTEYRNQTNLPTENVDKMNLWVKMFSHQVQKNLAPFFEAWAWPIQKEVATSLAYLPEWKENIMKLYLLTQM

SEQ ID NO: 93100 - protein, 150 aa, Homo sapiens
  Payload ID: 18600
  Gene Name: TRPM8 channel-associated factor 1
  ENSP ID: ENSP00000417600
MATPSAAFEALMNGVTSWDVPEDAVPCELLLIGEASFPVMVNDMGQVLIAASSYGRGRLVVVSHEDYLVEAQLTPFLLNAVGWLCSSPGAPIGVHPSLAPLAKILEGSGVDAKVEPEVKDSLGVYCIDAYNETMTEKLVKFMKCGGGLLI

SEQ ID NO: 93101 - protein, 75 aa, Homo sapiens
  Payload ID: 18600
  Gene Name: TRPM8 channel-associated factor 1
  ENSP ID: ENSP00000418432
MATPSAAFEALMNGVTSWDVPEDAVPCELLLIGEASFPVMVNDMGQVLIAASSYGRGRLVVVSHEDYLVEAQLTP

SEQ ID NO: 93102 - protein, 921 aa, Homo sapiens
  Payload ID: 18600
  Gene Name: TRPM8 channel-associated factor 1
  Uniprot ID: Q9Y4C2
  ENSP ID: ENSP00000419235
MATPSAAFEALMNGVTSWDVPEDAVPCELLLIGEASFPVMVNDMGQVLIAASSYGRGRLVVVSHEDYLVEAQLTPFLLNAVGWLCSSPGAPIGVHPSLAPLAKILEGSGVDAKVEPEVKDSLGVYCIDAYNETMTEKLVKFMKCGGGLLIGGQAWDWANQGEDERVLFTFPGNLVTSVAGIYFTDNKGDTSFFKVSKKMPKIPVLVSCEDDLSDDREELLHGISELDISNSDCFPSQLLVHGALAFPLGLDSYHGCVIAAARYGRGRVVVTGHKVLFTVGKLGPFLLNAVRWLDGGRRGKVVVQTELRTLSGLLAVGGIDTSIEPNLTSDASVYCFEPVSEVGVKELQEFVAEGGGLFVGAQAWWWAFKNPGVSPLARFPGNLLLNPFGISITSQSLNPGPFRTPKAGIRTYHFRSTLAEFQVIMGRKRGNVEKGWLAKLGPDGAAFLQIPAEEIPAYMSVHRLLRKLLSRYRLPVATRENPVINDCCRGAMLSLATGLAHSGSDLSLLVPEIEDMYSSPYLRPSESPITVEVNCTNPGTRYCWMSTGLYIPGRQIIEVSLPEAAASADLKIQIGCHTDDLTRASKLFRGPLVINRCCLDKPTKSITCLWGGLLYIIVPQNSKLGSVPVTVKGAVHAPYYKLGETTLEEWKRRIQENPGPWGELATDNIILTVPTANLRTLENPEPLLRLWDEVMQAVARLGAEPFPLRLPQRIVADVQISVGWMHAGYPIMCHLESVQELINEKLIRTKGLWGPVHELGRNQQRQEWEFPPHTTEATCNLWCVYVHETVLGIPRSRANIALWPPVREKRVRIYLSKGPNVKNWNAWTALETYLQLQEAFGWEPFIRLFTEYRNQTNLPTENVDKMNLWVKMFSHQVQKNLAPFFEAWAWPIQKEVATSLAYLPEWKENIMKLYLLTQMPH

SEQ ID NO: 93103 - protein, 145 aa, Homo sapiens
  Payload ID: 18600
  Gene Name: TRPM8 channel-associated factor 1
  ENSP ID: ENSP00000419622
MATPSAAFEALMNGVTSWDVPEDAVPCELLLIGEASFPVMVNDMGQVLIAASSYGRGRLVVVSHEDYLVEAQLTPFLLNAVGWLCSSPGAPIGVHPSLAPLAKILEGSGVDAKVEPEVKDSLGVYCIDAYNETMTEKLVKFMKCG

SEQ ID NO: 93104 - protein, 167 aa, Homo sapiens
  Payload ID: 18600
  Gene Name: TRPM8 channel-associated factor 1
  ENSP ID: ENSP00000420607
MATPSAAFEALMNGVTSWDVPEDAVPCELLLIGEASFPVMVNDMGQVLIAASSYGRGRLVVVSHEDYLVEAQLTPFLLNAVGWLCSSPGAPIGVHPSLAPLAKILEGSGVDAKVEPEVKDSLGVYCIDAYNETMTEKLVKFMKCGGGLLIGGQAWDWANQGEDERVL

SEQ ID NO: 93105 - protein, 845 aa, Homo sapiens
  Payload ID: 18601
  Gene Name: TRPM8 channel-associated factor 2
  Uniprot ID: A6NFQ2
  ENSP ID: ENSP00000349902
MATIAAAAFEALMDGVTCWDVPRGPIPSELLLIGEAAFPVMVNDKGQVLIAASSYGRGRLVVVSHEGYLSHTGLAPFLLNAVSWLCPCPGAPVGVHPSLAPLVNILQDAGLEAQVKPEPGEPLGVYCINAYNDTLTATLIQFVKHGGGLLIGGQAWYWASQHGPDKVLSRFPGNKVTSVAGVYFTDTYGDRDRFKVSKKVPKIPLHVRYGEDVRQDQQQLLEGISELDIRTGGVPSQLLVHGALAFPLGLDASLNCFLAAAHYGRGRVVLAAHECLLCAPKMGPFLLNAVRWLARGQTGKVGVNTNLKDLCPLLSEHGLQCSLEPHLNSDLCVYCCKAYSDKEAKQLQEFVAEGGGLLIGGQAWWWASQNPGHCPLAGFPGNIILNCFGLSILPQTLKAGCFPVPTPEMRSYHFRKALSQFQAILNHENGNLEKSCLAKLRVDGAAFLQIPAEGVPAYISLHRLLRKMLRGSGLPAVSRENPVASDSYEAAVLSLATGLAHSGTDCSQLAQGLGTWTCSSSLYPSKHPITVEINGINPGNNDCWVSTGLYLLEGQNAEVSLSEAAASAGLRVQIGCHTDDLTKARKLSRAPVVTHQCWMDRTERSVSCLWGGLLYVIVPKGSQLGPVPVTIRGAVPAPYYKLGKTSLEEWKRQMQENLAPWGELATDNIILTVPTTNLQALKDPEPVLRLWDEMMQAVARLAAEPFPFRRPERIVADVQISAGWMHSGYPIMCHLESVKEIINEMDMRSRGVWGPIHELGHNQQRHGWEFPPHTTEATCNLWSVYVHETVLGIPRAQAHEALSPPERERRIKAHLGKGAPLCDWNVWTALETYLQVLSRNSGRRG

SEQ ID NO: 93106 - protein, 815 aa, Homo sapiens
  Payload ID: 18601
  Gene Name: TRPM8 channel-associated factor 2
  Uniprot ID: A6NFQ2
  ENSP ID: ENSP00000389100
MKIFQKEFKFILKKCTPIQKYREENGNSSSSPHHQLQSHASGPRYGEDVRQDQQQLLEGISELDIRTGGVPSQLLVHGALAFPLGLDASLNCFLAAAHYGRGRVVLAAHECLLCAPKMGPFLLNAVRWLARGQTGKVGVNTNLKDLCPLLSEHGLQCSLEPHLNSDLCVYCCKAYSDKEAKQLQEFVAEGGGLLIGGQAWWWASQNPGHCPLAGFPGNIILNCFGLSILPQTLKAGCFPVPTPEMRSYHFRKALSQFQAILNHENGNLEKSCLAKLRVDGAAFLQIPAEGVPAYISLHRLLRKMLRGSGLPAVSRENPVASDSYEAAVLSLATGLAHSGTDCSQLAQGLGTWTCSSSLYPSKHPITVEINGINPESHSVIQVGMQWRDLSSCNLHLLGLSNSSLSASCVAGTTGTRHHAWLIFVFLVEREFHRKGNNDCWVSTGLYLLEGQNAEVSLSEAAASAGLRVQIGCHTDDLTKARKLSRAPVVTHQCWMDRTERSVSCLWGGLLYVIVPKGSQLGPVPVTIRGAVPAPYYKLGKTSLEEWKRQMQENLAPWGELATDNIILTVPTTNLQALKDPEPVLRLWDEMMQAVARLAAEPFPFRRPERIVADVQISAGWMHSGYPIMCHLESVKEIINEMDMRSRGVWGPIHELGHNQQRHGWEFPPHTTEATCNLWSVYVHETVLGIPRAQAHEALSPPERERRIKAHLGKGAPLCDWNVWTALETYLQLQEAFGWEPFTQLFAEYQTLSHLPKDNTGRMNLWVKKFSEKVKKNLVPFFEAWGWPIQKEVADSLASLPEWQENPMQVYLRARK

SEQ ID NO: 93107 - protein, 919 aa, Homo sapiens
  Payload ID: 18601
  Gene Name: TRPM8 channel-associated factor 2
  Uniprot ID: A6NFQ2
  ENSP ID: ENSP00000404265
MATIAAAAFEALMDGVTCWDVPRGPIPSELLLIGEAAFPVMVNDKGQVLIAASSYGRGRLVVVSHEGYLSHTGLAPFLLNAVSWLCPCPGAPVGVHPSLAPLVNILQDAGLEAQVKPEPGEPLGVYCINAYNDTLTATLIQFVKHGGGLLIGGQAWYWASQHGPDKVLSRFPGNKVTSVAGVYFTDTYGDRDRFKVSKKVPKIPLHVRYGEDVRQDQQQLLEGISELDIRTGGVPSQLLVHGALAFPLGLDASLNCFLAAAHYGRGRVVLAAHECLLCAPKMGPFLLNAVRWLARGQTGKVGVNTNLKDLCPLLSEHGLQCSLEPHLNSDLCVYCCKAYSDKEAKQLQEFVAEGGGLLIGGQAWWWASQNPGHCPLAGFPGNIILNCFGLSILPQTLKAGCFPVPTPEMRSYHFRKALSQFQAILNHENGNLEKSCLAKLRVDGAAFLQIPAEGVPAYISLHRLLRKMLRGSGLPAVSRENPVASDSYEAAVLSLATGLAHSGTDCSQLAQGLGTWTCSSSLYPSKHPITVEINGINPGNNDCWVSTGLYLLEGQNAEVSLSEAAASAGLRVQIGCHTDDLTKARKLSRAPVVTHQCWMDRTERSVSCLWGGLLYVIVPKGSQLGPVPVTIRGAVPAPYYKLGKTSLEEWKRQMQENLAPWGELATDNIILTVPTTNLQALKDPEPVLRLWDEMMQAVARLAAEPFPFRRPERIVADVQISAGWMHSGYPIMCHLESVKEIINEMDMRSRGVWGPIHELGHNQQRHGWEFPPHTTEATCNLWSVYVHETVLGIPRAQAHEALSPPERERRIKAHLGKGAPLCDWNVWTALETYLQLQEAFGWEPFTQLFAEYQTLSHLPKDNTGRMNLWVKKFSEKVKKNLVPFFEAWGWPIQKEVADSLASLPEWQENPMQVYLRARK

SEQ ID NO: 93108 - protein, 845 aa, Homo sapiens; identical to SEQ ID NO: 93105
  Payload ID: 18601
  Gene Name: TRPM8 channel-associated factor 2
  Uniprot ID: A6NFQ2
  ENSP ID: ENSP00000412724

SEQ ID NO: 93109 - protein, 660 aa, Homo sapiens
  Payload ID: 18601
  Gene Name: TRPM8 channel-associated factor 2
  ENSP ID: ENSP00000431079
  MOD_RES (1)..(1): Any amino acid
XTRPPRATAEPVRQSLGIRTAQGYGEDVRQDQQQLLEGISELDIRTGGVPSQLLVHGALAFPLGLDASLNCFLAAAHYGRGRVVLAAHECLLCAPKMGPFLLNAVRWLARGQTGKVGVNTNLKDLCPLLSEHGLQCSLEPHLNSDLCVYCCKAYSDKEAKQLQEFVAEGGGLLIGGQAWWWASQNPGHCPLAGFPGNIILNCFGLSILPQTLKAGCFPVPTPEMRSYHFRKALSQFQAILNHENGNLEKSCLAKLRVDGAAFLQIPAEGVPAYISLHRLLRKMLRGSGLPAVSRENPVASDSYEAAVLSLATGLAHSGTDCSQLAQGLGTWTCSSSLYPSKHPITVEINGINPGNNDCWVSTGLYLLEGQNAEVSLSEAAASAGLRVQIGCHTDDLTKARKLSRAPVVTHQCWMDRTERSVSCLWGGLLYVIVPKGSQLGPVPVTIRGAVPAPYYKLGKTSLEEWKRQMQENLAPWGELATDNIILTVPTTNLQALKDPEPVLRLWDEMMQAVARLAAEPFPFRRPERIVADVQISAGWMHSGYPIMCHLESVKEIINEMDMRSRGVWGPIHELGHNQQRHGWEFPPHTTEATCNLWSVYVHETVLGIPRAQAHEALSPPERERRIKAHLGKGAPLCDWNVWTALETYLQVLSRNSGRRG

SEQ ID NO: 93110 - protein, 815 aa, Homo sapiens; identical to SEQ ID NO: 93106
  Payload ID: 18601
  Gene Name: TRPM8 channel-associated factor 2
  Uniprot ID: A6NFQ2
  ENSP ID: ENSP00000441099

SEQ ID NO: 93111 - protein, 349 aa, Homo sapiens
  Payload ID: 18602
  Gene Name: TruB pseudouridine (psi) synthase family member 1
  Uniprot ID: Q8WWH5
  ENSP ID: ENSP00000298746
MAASEAAVVSSPSLKTDTSPVLETAGTVAAMAATPSARAAAAVVAAAARTGSEARVSKAALATKLLSLSGVFAVHKPKGPTSAELLNRLKEKLLAEAGMPSPEWTKRKKQTLKIGHGGTLDSAARGVLVVGIGSGTKMLTSMLSGSKRYTAIGELGKATDTLDSTGRVTEEKPYDKITQEDIEGILQKFTGNIMQVPPLYSALKKDGQRLSTLMKRGEVVEAKPARPVTVYSISLQKFQPPFFTLDVECGGGFYIRSLVSDIGKELSSCANVLELTRTKQGPFTLEEHALPEDKWTIDDIAQSLEHCSSLFPAELALKKSKPESNEQVLSCEYITLNEPKREDDVIKTC

SEQ ID NO: 93112 - protein, 331 aa, Homo sapiens
  Payload ID: 18603
  Gene Name: TruB pseudouridine (psi) synthase family member 2
  Uniprot ID: O95900
  ENSP ID: ENSP00000361982
MGSAGLSRLHGLFAVYKPPGLKWKHLRDTVELQLLKGLNARKPPAPKQRVRFLLGPMEGSEEKELTLTATSVPSFINHPLVCGPAFAHLKVGVGHRLDAQASGVLVLGVGHGCRLLTDMYNAHLTKDYTVRGLLGKATDDFREDGRLVEKTTYDHVTREKLDRILAVIQGSHQKALVMYSNLDLKTQEAYEMAVRGLIRPMNKSPMLITGIRCLYFAPPEFLLEVQCMHETQKELRKLVHEIGLELKTTAVCTQVRRTRDGFFTLDSALLRTQWDLTNIQDAIRAATPQVAAELEKSLSPGLDTKQLPSPGWSWDSQGPSSTLGLERGAGQ

SEQ ID NO: 93113 - protein, 566 aa, Homo sapiens
  Payload ID: 18604
  Gene Name: trypsin domain containing 1
  Uniprot ID: Q2T9J0
  ENSP ID: ENSP00000287078
MRRQWGSAMRAAEQAGCMVSASRAGQPEAGPWSCSGVILSRSPGLVLCHGGIFVPFLRAGSEVLTAAGAVFLPGDSCRDDLRLHVQWAPTAAGPGGGAERGRPGLCTPQCASLEPGPPAPSRGRPLQPRLPAELLLLLSCPAFWAHFARLFGDEAAEQWRFSSAARDDEVSEDEEADQLRALGWFALLGVRLGQEEVEEERGPAMAVSPLGAVPKGAPLLVCGSPFGAFCPDIFLNTLSCGVLSNVAGPLLLTDARCLPGTEGGGVFTARPAGALVALVVAPLCWKAGEWVGFTLLCAAAPLFRAARDALHRLPHSTAALAALLPPEVGVPWGLPLRDSGPLWAAAAVLVECGTVWGSGVAVAPRLVVTCRHVSPREAARVLVRSTTPKSVAIWGRVVFATQETCPYDIAVVSLEEDLDDVPIPVPAEHFHEGEAVSVVGFGVFGQSCGPSVTSGILSAVVQVNGTPVMLQTTCAVHSGSSGGPLFSNHSGNLLGIITSNTRDNNTGATYPHLNFSIPITVLQPALQQYSQTQDLGGLRELDRAAEPVRVVWRLQRPLAEAPRSKL

SEQ ID NO: 93114 - protein, 398 aa, Homo sapiens
  Payload ID: 18604
  Gene Name: trypsin domain containing 1
  Uniprot ID: Q2T9J0
  ENSP ID: ENSP00000335673
MRRQWGSAMRAAEQAGCMVSASRAGQPEAGPWSCSGVILSRSPGLVLCHGGIFVPFLRAGSEVLTAAGAVFLPGDSCRDDLRLHVQWAPTAAGPGGGAERGRPGLCTPQCASLEPGPPAPSRGRPLQPRLPAELLLLLSCPAFWAHFARLFGDEAAEQWRFSSAARDDEVSEDEEADQLRALGWFALLGVRLGQEEVEEERGPAMAVSPLGAVPKGAPLLVCGSPFGAFCPDIFLNTLSCGVLSNVAGPLLLTDARCLPGTEGGGVFTARPAGALVALVVAPLCWKAGEWVGFTLLCAAAPLFRAARDALHRLPHSTAALAALLPPEVGVPWGLPLRDSGPLWAAAAVLVECGTVWGSGVAVAPRLVVTCRHVSPREAARVLVRSTTPKHNHQQHPGQ

SEQ ID NO: 93115 - protein, 275 aa, Homo sapiens
  Payload ID: 18605
  Gene Name: tryptase alpha/beta 1
  Uniprot ID: Q15661
  ENSP ID: ENSP00000343577
MLNLLLLALPVLASRAYAAPAPGQALQRVGIVGGQEAPRSKWPWQVSLRVHGPYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 93116 - protein, 282 aa, Homo sapiens
  Payload ID: 18605
  Gene Name: tryptase alpha/beta 1
  ENSP ID: ENSP00000418247
MLLLAPQMLNLLLLALPVLASRAYAAPAPGQALQRVGIVGGQEAPRSKWPWQVSLRVHGPYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 93117 - protein, 213 aa, Homo sapiens
  Payload ID: 18605
  Gene Name: tryptase alpha/beta 1
  ENSP ID: ENSP00000456821
YWMHFCGGSLIHPQWVLTAAHCVGPVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 93118 - protein, 282 aa, Homo sapiens
  Payload ID: 18606
  Gene Name: tryptase beta 2 (gene/pseudogene)
  ENSP ID: ENSP00000478695
MLLLAPQMLNLLLLALPVLASRAYAAPAPGQALQRVGIVGGQEAPRSKWPWQVSLRVRDRYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 93119 - protein, 275 aa, Homo sapiens
  Payload ID: 18606
  Gene Name: tryptase beta 2 (gene/pseudogene)
  Uniprot ID: P20231
  ENSP ID: ENSP00000482743
MLNLLLLALPVLASRAYAAPAPGQALQRVGIVGGQEAPRSKWPWQVSLRVRDRYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKP

SEQ ID NO: 93120 - protein, 292 aa, Homo sapiens
  Payload ID: 18606
  Gene Name: tryptase beta 2 (gene/pseudogene)
  ENSP ID: ENSP00000484461
MLNLLLLALPVLASRAYAAPAPGQALQRVGIVGGQEAPRSKWPWQVSLRVRDRYWMHFCGGSLIHPQWVLTAAHCVGPDVKDLAALRVQLREQHLYYQDQLLPVSRIIVHPQFYTAQIGADIALLELEEPVNVSSHVHTVTLPPASETFPPGMPCWVTGWGDVDNDERLPPPFPLKQVKVPIMENHICDAKYHLGAYTGDDVRIVRDDMLCAGNTRRDSCQGDSGGPLVCKVNGTWLQAGVVSWGEGCAQPNRPGIYTRVTYYLDWIHHYVPKKPDGVSPCWPVWSRTPDLK

SEQ ID NO: 93121 - protein, 242 aa, Homo sapiens
  Payload ID: 18607
  Gene Name: tryptase delta 1
  Uniprot ID: Q9BZJ3
  ENSP ID: ENSP00000211076
MLLLAPQMLSLLLLALPVLASPAYVAPAPGQALQQTGIVGGQEAPRSKWPWQVSLRVRGPYWMHFCGGSLIHPQWVLTAAHCVEPDIKDLAALRVQLREQHLYYQDQLLPVSRIIVHPQFYIIQTGADIALLELEEPVNISSHIHTVTLPPASETFPPGMPCWVTGWGDVDNNVHLPPPYPLKEVEVPVVENHLCNAEYHTGLHTGHSFQIVRDDMLCAGSENHDSCQGDSGGPLVCKVNGT

SEQ ID NO: 93122 - protein, 235 aa, Homo sapiens
  Payload ID: 18607
  Gene Name: tryptase delta 1
  ENSP ID: ENSP00000380668
MLSLLLLALPVLASPAYVAPAPGQALQQTGIVGGQEAPRSKWPWQVSLRVRGPYWMHFCGGSLIHPQWVLTAAHCVEPDIKDLAALRVQLREQHLYYQDQLLPVSRIIVHPQFYIIQTGADIALLELEEPVNISSHIHTVTLPPASETFPPGMPCWVTGWGDVDNNVHLPPPYPLKEVEVPVVENHLCNAEYHTGLHTGHSFQIVRDDMLCAGSENHDSCQGDSGGPLVCKVNGT

SEQ ID NO: 93123 - protein, 321 aa, Homo sapiens
  Payload ID: 18608
  Gene Name: tryptase gamma 1
  Uniprot ID: Q9NRR2
  ENSP ID: ENSP00000234798
MALGACGLLLLLAVPGVSLRTLQPGCGRPQVSDAGGRIVGGHAAPAGAWPWQASLRLRRVHVCGGSLLSPQWVLTAAHCFSGSLNSSDYQVHLGELEITLSPHFSTVRQIILHSSPSGQPGTSGDIALVELSVPVTLSSRILPVCLPEASDDFCPGIRCWVTGWGYTREGEPLPPPYSLREVKVSVVDTETCRRDYPGPGGSILQPDMLCARGPGDACQDDSGGPLVCQVNGAWVQAGTVSWGEGCGRPNRPGVYTRVPAYVNWIRRHITASGGSESGYPRLPLLAGFFLPGLFLLLVSCVLLAKCLLHPSADGTPFPAPD

SEQ ID NO: 93124 - protein, 65 aa, Homo sapiens
  Payload ID: 18609
  Gene Name: tryptophan 2,3-dioxygenase
  ENSP ID: ENSP00000423394
MLKVVSRMHRVSVILKLLVQQFSILETMTALDFNDFREYLSPASGFQSLQFRLLENKIGVLQNMR

SEQ ID NO: 93125 - protein, 49 aa, Homo sapiens
  Payload ID: 18609
  Gene Name: tryptophan 2,3-dioxygenase
  ENSP ID: ENSP00000424384
MLKVVSRMHRVSVILKLLVQQFSILETMTALDFNDFREYLSPASGFQSL

SEQ ID NO: 93126 - protein, 406 aa, Homo sapiens
  Payload ID: 18609
  Gene Name: tryptophan 2,3-dioxygenase
  Uniprot ID: P48775
  ENSP ID: ENSP00000444788
MSGCPFLGNNFGYTFKKLPVEGSEEDKSQTGVNRASKGGLIYGNYLHLEKVLNAQELQSETKGNKIHDEHLFIITHQAYELWFKQILWELDSVREIFQNGHVRDERNMLKVVSRMHRVSVILKLLVQQFSILETMTALDFNDFREYLSPASGFQSLQFRLLENKIGVLQNMRVPYNRRHYRDNFKGEENELLLKSEQEKTLLELVEAWLERTPGLEPHGFNFWGKLEKNITRGLEEEFIRIQAKEESEEKEEQVAEFQKQKEVLLSLFDEKRHEHLLSKGERRLSYRALQGALMIYFYREEPRFQVPFQLLTSLMDIDSLMTKWRYNHVCMVHRMLGSKAGTGGSSGYHYLRSTVSDRYKVFVDLFNLSTYLIPRHWIPKMNPTIHKFLYTAEYCDSSYFSSDESD

SEQ ID NO: 93127 - protein, 406 aa, Homo sapiens; identical to SEQ ID NO: 93126
  Payload ID: 18609
  Gene Name: tryptophan 2,3-dioxygenase
  Uniprot ID: P48775
  ENSP ID: ENSP00000460086

SEQ ID NO: 93128 - protein, 49 aa, Homo sapiens; identical to SEQ ID NO: 93125
  Payload ID: 18609
  Gene Name: tryptophan 2,3-dioxygenase
  ENSP ID: ENSP00000461272

SEQ ID NO: 93129 - protein, 65 aa, Homo sapiens; identical to SEQ ID NO: 93124
  Payload ID: 18609
  Gene Name: tryptophan 2,3-dioxygenase
  ENSP ID: ENSP00000461534

SEQ ID NO: 93130 - protein, 444 aa, Homo sapiens
  Payload ID: 18610
  Gene Name: tryptophan hydroxylase 1
  Uniprot ID: P17752
  ENSP ID: ENSP00000250018
MIEDNKENKDHSLERGRASLIFSLKNEVGGLIKALKIFQEKHVNLLHIESRKSKRRNSEFEIFVDCDINREQLNDIFHLLKSHTNVLSVNLPDNFTLKEDGMETVPWFPKKISDLDHCANRVLMYGSELDADHPGFKDNVYRKRRKYFADLAMNYKHGDPIPKVEFTEEEIKTWGTVFQELNKLYPTHACREYLKNLPLLSKYCGYREDNIPQLEDVSNFLKERTGFSIRPVAGYLSPRDFLSGLAFRVFHCTQYVRHSSDPFYTPEPDTCHELLGHVPLLAEPSFAQFSQEIGLASLGASEEAVQKLATCYFFTVEFGLCKQDGQLRVFGAGLLSSISELKHALSGHAKVKPFDPKITCKQECLITTFQDVYFVSESFEDAKEKMREFTKTIKRPFGVKYNPYTRSIQILKDTKSITSAMNELQHDLDVVSDALAKVSRKPSI

SEQ ID NO: 93131 - protein, 206 aa, Homo sapiens
  Payload ID: 18610
  Gene Name: tryptophan hydroxylase 1
  ENSP ID: ENSP00000403831
MIEDNKENKDHSLERGRASLIFSLKNEVGGLIKALKIFQEKHVNLLHIESRKSKRRNSEFEIFVDCDINREQLNDIFHLLKSHTNVLSVNLPDNFTLKEDGMETVPWFPKKISDLDHCANRVLMYGSELDADHPGFKDNVYRKRRKYFADLAMNYKQAYRFFHPSCGWLLITKRFLIRFSLSSFSLHSICETQFRSLLYPRARYLP

SEQ ID NO: 93132 - protein, 165 aa, Homo sapiens
  Payload ID: 18610
  Gene Name: tryptophan hydroxylase 1
  ENSP ID: ENSP00000436081
MVLENYSKFIMIEDNKENKDHSLERGRASLIFSLKNEVGGLIKALKIFQEKHVNLLHIESRKSKRRNSEFEIFVDCDINREQLNDIFHLLKSHTNVLSVNLPDNFTLKEDGMETVPWFPKKISDLDHCANRVLMYGSELDADHPGFKDNVYRKRRKYFADLAMNY

SEQ ID NO: 93133 - protein, 490 aa, Homo sapiens
  Payload ID: 18611
  Gene Name: tryptophan hydroxylase 2
  Uniprot ID: Q8IWU9
  ENSP ID: ENSP00000329093
MQPAMMMFSSKYWARRGFSLDSAVPEEHQLLGSSTLNKPNSGKNDDKGNKGSSKREAATESGKTAVVFSLKNEVGGLVKALRLFQEKRVNMVHIESRKSRRRSSEVEIFVDCECGKTEFNELIQLLKFQTTIVTLNPPENIWTEEEELEDVPWFPRKISELDKCSHRVLMYGSELDADHPGFKDNVYRQRRKYFVDVAMGYKYGQPIPRVEYTEEETKTWGVVFRELSKLYPTHACREYLKNFPLLTKYCGYREDNVPQLEDVSMFLKERSGFTVRPVAGYLSPRDFLAGLAYRVFHCTQYIRHGSDPLYTPEPDTCHELLGHVPLLADPKFAQFSQEIGLASLGASDEDVQKLATCYFFTIEFGLCKQEGQLRAYGAGLLSSIGELKHALSDKACVKAFDPKTTCLQECLITTFQEAYFVSESFEEAKEKMRDFAKSITRPFSVYFNPYTQSIEILKDTRSIENVVQDLRSDLNTVCDALNKMNQYLGI

SEQ ID NO: 93134 - protein, 174 aa, Homo sapiens
  Payload ID: 18612
  Gene Name: tryptophan rich basic protein
  Uniprot ID: O00258
  ENSP ID: ENSP00000327716
MSSAAADHWAWLLVLSFVFGCNVLRILLPSFSSFMSRVLQKDAEQESQMRAEIQDMKQELSTVNMMDEFARYARLERKINKMTDKLKTHVKARTAQLAKIKWVISVAFYVLQAALMISLIWKYYSVPVAVVPSKWITPLDRLVAFPTRVAGGVGITCWILVCNKVVAIVLHPFS

SEQ ID NO: 93135 - protein, 140 aa, Homo sapiens
  Payload ID: 18612
  Gene Name: tryptophan rich basic protein
  Uniprot ID: O00258
  ENSP ID: ENSP00000370084
MSRVLQKDAEQESQMRAEIQDMKQELSTVNMMDEFARYARLERKINKMTDKLKTHVKARTAQLAKIKWVISVAFYVLQAALMISLIWKYYSVPVAVVPSKWITPLDRLVAFPTRVAGGVGITCWILVCNKVVAIVLHPFS

SEQ ID NO: 93136 - protein, 116 aa, Homo sapiens
  Payload ID: 18612
  Gene Name: tryptophan rich basic protein
  ENSP ID: ENSP00000370089
MSRVLQKDAEQESQMRAEIQDMKQELSTVNMMDEFARYARLERKINKMTDKLKTHVKARTAQLAKIKWVISVAFYVLQAALMISLIWKYYSVPVAVVPSKWITPLDRLVAFPTRVA

SEQ ID NO: 93137 - protein, 140 aa, Homo sapiens; identical to SEQ ID NO: 93135
  Payload ID: 18612
  Gene Name: tryptophan rich basic protein
  Uniprot ID: O00258
  ENSP ID: ENSP00000381737

SEQ ID NO: 93138 - protein, 35 aa, Homo sapiens
  Payload ID: 18612
  Gene Name: tryptophan rich basic protein
  ENSP ID: ENSP00000409030
MSRVLQKDAEQESQMRAEIQDMKQELSTVNMMDEF

SEQ ID NO: 93139 - protein, 81 aa, Homo sapiens
  Payload ID: 18612
  Gene Name: tryptophan rich basic protein
  ENSP ID: ENSP00000410228
  MOD_RES (1)..(1): Any amino acid
XTAQLAKIKWVISVAFYVLQAALMISLIWKYYSVPVAVVPSKWITPLDRLVAFPTRVAGDDGLIEFTTVTLESPKAWLVEA

SEQ ID NO: 93140 - protein, 15 aa, Homo sapiens
  Payload ID: 18612
  Gene Name: tryptophan rich basic protein
  ENSP ID: ENSP00000485087
  MOD_RES (1)..(1): Any amino acid
XRQGNLRLLHLEVNM

SEQ ID NO: 93141 - protein, 69 aa, Homo sapiens
  Payload ID: 18612
  Gene Name: tryptophan rich basic protein
  ENSP ID: ENSP00000485215
MSRVLQKDAEQESQMRAEIQDMKQELSTVNMMDEFARYARLERKINKMTDKLKTHGTVSLAAWRLHESG

SEQ ID NO: 93142 - protein, 172 aa, Homo sapiens
  Payload ID: 18612
  Gene Name: tryptophan rich basic protein
  ENSP ID: ENSP00000485555
MSSAAADHWAWLLVLSFVFGCNVLRILLPSFSSFMSRVLQKDAEQESQMRAEIQDMKQELSTVNMMDEFARYARLERKINKMTDKLKTHVKARTAQLAKIKWVISVAFYVLQAALMISLIWKYYSVPVAVVPSKWITPLDRLVAFPTRVAVFSSSIWTSKCFSSPDKSILEK

SEQ ID NO: 93143 - protein, 360 aa, Homo sapiens
  Payload ID: 18613
  Gene Name: tryptophanyl tRNA synthetase 2, mitochondrial
  Uniprot ID: Q9UGM6
  ENSP ID: ENSP00000235521
MALHSMRKARERWSFIRALHKGSAAAPALQKDSKKRVFSGIQPTGILHLGNYLGAIESWVRLQDEYDSVLYSIVDLHSITVPQDPAVLRQSILDMTAVLLACGINPEKSILFQQSQVSEHTQLSWILSCMVRLPRLQHLHQWKAKTTKQKHDGTVGLLTYPVLQAADILLYKSTHVPVGEDQVQHMELVQDLAQGFNKKYGEFFPVPESILTSMKKVKSLRDPSAKMSKSDPDKLATVRITDSPEEIVQKFRKAVTDFTSEVTYDPAGRAGVSNIVAVHAAVTGLSVEEVVRRSAGMNTARYKLAVADAVIEKFAPIKREIEKLKLDKDHLEKVLQIGSAKAKELAYTVCQEVKKLVGFL

SEQ ID NO: 93144 - protein, 220 aa, Homo sapiens
  Payload ID: 18613
  Gene Name: tryptophanyl tRNA synthetase 2, mitochondrial
  Uniprot ID: Q9UGM6
  ENSP ID: ENSP00000358434
MALHSMRKARERWSFIRALHKGSAAAPALQKDSKKRVFSGIQPTGILHLGNYLGAIESWVRLQDEYDSVLYSIVDLHSITVPQDPAVLRQSILDMTAVLLACGINPEKSILFQQSQVSEHTQLSWILSCMVRLPRLQHLHQWKAKTTKQKHDGTVGLLTYPVLQAADILLYKSTHVPVGEDQVQHMELVQDLAQGFNKKYGEFFPVPESILSMCVLVFLT

SEQ ID NO: 93145 - protein, 430 aa, Homo sapiens
  Payload ID: 18614
  Gene Name: tryptophanyl-tRNA synthetase
  Uniprot ID: P23381
  ENSP ID: ENSP00000339485
MLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 93146 - protein, 471 aa, Homo sapiens
  Payload ID: 18614
  Gene Name: tryptophanyl-tRNA synthetase
  Uniprot ID: P23381
  ENSP ID: ENSP00000347495
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 93147 - protein, 430 aa, Homo sapiens; identical to SEQ ID NO: 93145
  Payload ID: 18614
  Gene Name: tryptophanyl-tRNA synthetase
  Uniprot ID: P23381
  ENSP ID: ENSP00000351481

SEQ ID NO: 93148 - protein, 471 aa, Homo sapiens; identical to SEQ ID NO: 93146
  Payload ID: 18614
  Gene Name: tryptophanyl-tRNA synthetase
  Uniprot ID: P23381
  ENSP ID: ENSP00000376620

SEQ ID NO: 93149 - protein, 152 aa, Homo sapiens
  Payload ID: 18614
  Gene Name: tryptophanyl-tRNA synthetase
  ENSP ID: ENSP00000450427
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYEN

SEQ ID NO: 93150 - protein, 212 aa, Homo sapiens
  Payload ID: 18614
  Gene Name: tryptophanyl-tRNA synthetase
  ENSP ID: ENSP00000450500
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAY

SEQ ID NO: 93151 - protein, 86 aa, Homo sapiens
  Payload ID: 18614
  Gene Name: tryptophanyl-tRNA synthetase
  ENSP ID: ENSP00000450563
MPNSEPASLLELFNSIATQGELVRSLKAGNASKDEIDSAVKMLVSLKMSYKAAAGEDYKADCPPGNPAPTSNHGPDATEAEEDFVD

SEQ ID NO: 93152 - protein, 55 aa, Homo sapiens
  Payload ID: 18614
  Gene Name: tryptophanyl-tRNA synthetase
  ENSP ID: ENSP00000450623
MPNSEPASLLELFNSIATQGELVRSLKAGNASKDEIDSAVKMLVSLKMSYKAAAG

SEQ ID NO: 93153 - protein, 177 aa, Homo sapiens
  Payload ID: 18614
  Gene Name: tryptophanyl-tRNA synthetase
  ENSP ID: ENSP00000450934
MPNSEPASLLELFNSIATQGELVRSLKAGNASKAESHSVAQAGVHWHSLGSLQPLPPEFERFSCPGLDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDM

SEQ ID NO: 93154 - protein, 68 aa, Homo sapiens
  Payload ID: 18614
  Gene Name: tryptophanyl-tRNA synthetase
  ENSP ID: ENSP00000450978
MPNSEPASLLELFNSIATQGELVRSLKAGNASKDEIDSAVKMLVSLKMSYKAAAGEDYKADCPPGNPA

SEQ ID NO: 93155 - protein, 70 aa, Homo sapiens
  Payload ID: 18614
  Gene Name: tryptophanyl-tRNA synthetase
  ENSP ID: ENSP00000451027
MPNSEPASLLELFNSIATQGELVRSLKAGNASKDEIDSAVKMLVSLKMSYKAAAGEDYKADCPPGNPAPT

SEQ ID NO: 93156 - protein, 223 aa, Homo sapiens
  Payload ID: 18614
  Gene Name: tryptophanyl-tRNA synthetase
  ENSP ID: ENSP00000451251
MLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVK

SEQ ID NO: 93157 - protein, 150 aa, Homo sapiens
  Payload ID: 18614
  Gene Name: tryptophanyl-tRNA synthetase
  ENSP ID: ENSP00000451349
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAY

SEQ ID NO: 93158 - protein, 58 aa, Homo sapiens
  Payload ID: 18614
  Gene Name: tryptophanyl-tRNA synthetase
  ENSP ID: ENSP00000451377
MPNSEPASLLELFNSIATQGELVRSLKAGNASKDEIDSAVKMLVSLKMSYKAAAGEDY

SEQ ID NO: 93159 - protein, 114 aa, Homo sapiens
  Payload ID: 18614
  Gene Name: tryptophanyl-tRNA synthetase
  ENSP ID: ENSP00000451402
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDK

SEQ ID NO: 93160 - protein, 471 aa, Homo sapiens; identical to SEQ ID NO: 93146
  Payload ID: 18614
  Gene Name: tryptophanyl-tRNA synthetase
  Uniprot ID: P23381
  ENSP ID: ENSP00000451460

SEQ ID NO: 93161 - protein, 124 aa, Homo sapiens
  Payload ID: 18614
  Gene Name: tryptophanyl-tRNA synthetase
  ENSP ID: ENSP00000451469
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERAT

SEQ ID NO: 93162 - protein, 226 aa, Homo sapiens
  Payload ID: 18614
  Gene Name: tryptophanyl-tRNA synthetase
  ENSP ID: ENSP00000451490
MLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIF

SEQ ID NO: 93163 - protein, 140 aa, Homo sapiens
  Payload ID: 18614
  Gene Name: tryptophanyl-tRNA synthetase
  ENSP ID: ENSP00000451544
MLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTK

SEQ ID NO: 93164 - protein, 154 aa, Homo sapiens
  Payload ID: 18614
  Gene Name: tryptophanyl-tRNA synthetase
  ENSP ID: ENSP00000451599
MLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQM

SEQ ID NO: 93165 - protein, 36 aa, Homo sapiens
  Payload ID: 18614
  Gene Name: tryptophanyl-tRNA synthetase
  ENSP ID: ENSP00000451679
MPNSEPASLLELFNSIATQGELVRSLKAGNASKGKL

SEQ ID NO: 93166 - protein, 97 aa, Homo sapiens
  Payload ID: 18614
  Gene Name: tryptophanyl-tRNA synthetase
  ENSP ID: ENSP00000451716
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKG

SEQ ID NO: 93167 - protein, 58 aa, Homo sapiens; identical to SEQ ID NO: 93158
  Payload ID: 18614
  Gene Name: tryptophanyl-tRNA synthetase
  ENSP ID: ENSP00000451777

SEQ ID NO: 93168 - protein, 430 aa, Homo sapiens; identical to SEQ ID NO: 93145
  Payload ID: 18614
  Gene Name: tryptophanyl-tRNA synthetase
  Uniprot ID: P23381
  ENSP ID: ENSP00000451887

SEQ ID NO: 93169 - protein, 185 aa, Homo sapiens
  Payload ID: 18614
  Gene Name: tryptophanyl-tRNA synthetase
  ENSP ID: ENSP00000451891
  MOD_RES (1)..(1): Any amino acid
XKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVSSGPGRGQPAGSETCPGGHTHTHTTAQCFGPQPPSHRSNAELQDCQLCSLQNSRQPVLPT

SEQ ID NO: 93170 - protein, 105 aa, Homo sapiens
  Payload ID: 18614
  Gene Name: tryptophanyl-tRNA synthetase
  ENSP ID: ENSP00000451894
MPNSEPASLLELFNSIATQGELVRSLKAGNASKAESHSVAQAGVHWHSLGSLQPLPPEFERFSCPGLDEIDSAVKMLVSLKMSYKAAAGEDYKADCPPGNPAPTS

SEQ ID NO: 93171 - protein, 104 aa, Homo sapiens
  Payload ID: 18614
  Gene Name: tryptophanyl-tRNA synthetase
  ENSP ID: ENSP00000451906
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLI

SEQ ID NO: 93172 - protein, 40 aa, Homo sapiens
  Payload ID: 18614
  Gene Name: tryptophanyl-tRNA synthetase
  ENSP ID: ENSP00000451922
MPNSEPASLLELFNSIATQGELVRSLKAGNASKLGSFRWK

SEQ ID NO: 93173 - protein, 63 aa, Homo sapiens
  Payload ID: 18614
  Gene Name: tryptophanyl-tRNA synthetase
  ENSP ID: ENSP00000451953
MPNSEPASLLELFNSIATQGELVRSLKAGNASKDEIDSAVKMLVSLKMSYKAAAGEDYKADCP

SEQ ID NO: 93174 - protein, 25 aa, Homo sapiens
  Payload ID: 18614
  Gene Name: tryptophanyl-tRNA synthetase
  ENSP ID: ENSP00000452358
MPNSEPASLLELFNSIATQGELVRS

SEQ ID NO: 93175 - protein, 33 aa, Homo sapiens
  Payload ID: 18614
  Gene Name: tryptophanyl-tRNA synthetase
  ENSP ID: ENSP00000452379
MPNSEPASLLELFNSIATQGELVRSLKAGNASK

SEQ ID NO: 93176 - protein, 153 aa, Homo sapiens
  Payload ID: 18614
  Gene Name: tryptophanyl-tRNA synthetase
  ENSP ID: ENSP00000452519
MLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQ

SEQ ID NO: 93177 - protein, 107 aa, Homo sapiens
  Payload ID: 18614
  Gene Name: tryptophanyl-tRNA synthetase
  ENSP ID: ENSP00000452550
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRF

SEQ ID NO: 93178 - protein, 40 aa, Homo sapiens; identical to SEQ ID NO: 93172
  Payload ID: 18614
  Gene Name: tryptophanyl-tRNA synthetase
  ENSP ID: ENSP00000487316

SEQ ID NO: 93179 - protein, 346 aa, Homo sapiens
  Payload ID: 18615
  Gene Name: Ts translation elongation factor, mitochondrial
  Uniprot ID: P43897
  ENSP ID: ENSP00000313877
MSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKVQWLTPVNLALWEAEAGGSLEGFLNSSELSGLPAGPDREGSLKDQLALAIGKLGENMILKRAAWVKVPSGFYVGSYVHGAMQSPSLHKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 93180 - protein, 325 aa, Homo sapiens
  Payload ID: 18615
  Gene Name: Ts translation elongation factor, mitochondrial
  Uniprot ID: P43897
  ENSP ID: ENSP00000388330
MSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIGKLGENMILKRAAWVKVPSGFYVGSYVHGAMQSPSLHKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 93181 - protein, 168 aa, Homo sapiens
  Payload ID: 18615
  Gene Name: Ts translation elongation factor, mitochondrial
  ENSP ID: ENSP00000389162
MKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIGKLGENMILKRAAWVKVPSGFYVGSYVH

SEQ ID NO: 93182 - protein, 140 aa, Homo sapiens
  Payload ID: 18615
  Gene Name: Ts translation elongation factor, mitochondrial
  ENSP ID: ENSP00000390679
MKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAI

SEQ ID NO: 93183 - protein, 89 aa, Homo sapiens
  Payload ID: 18615
  Gene Name: Ts translation elongation factor, mitochondrial
  ENSP ID: ENSP00000406339
MSLLRSLRVFLVARTGSYPAGSLLRQSPQPRHTFYAGPRLSASASSKELLMKLRRKTGYSFVNCKKALETCGGDLKQTESCSVAQAGVQ

SEQ ID NO: 93184 - protein, 215 aa, Homo sapiens
  Payload ID: 18615
  Gene Name: Ts translation elongation factor, mitochondrial
  Uniprot ID: P43897
  ENSP ID: ENSP00000439342
MSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIGLPFQIGAVSELQLPESNFLQNTSS

SEQ ID NO: 93185 - protein, 167 aa, Homo sapiens
  Payload ID: 18615
  Gene Name: Ts translation elongation factor, mitochondrial
  Uniprot ID: P43897
  ENSP ID: ENSP00000440987
MSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKENWEKT

SEQ ID NO: 93186 - protein, 230 aa, Homo sapiens
  Payload ID: 18615
  Gene Name: Ts translation elongation factor, mitochondrial
  ENSP ID: ENSP00000448575
MSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIGSQARNQPVKMGGSNPCLMIRIGVSGSRPLGSAFPNWSCL

SEQ ID NO: 93187 - protein, 200 aa, Homo sapiens
  Payload ID: 18615
  Gene Name: Ts translation elongation factor, mitochondrial
  ENSP ID: ENSP00000450041
MSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIVLRTHHICMI

SEQ ID NO: 93188 - protein, 144 aa, Homo sapiens
  Payload ID: 18616
  Gene Name: TSC22 domain family, member 1
  Uniprot ID: Q15714
  ENSP ID: ENSP00000261489
MKSQWCRPVAMDLGVYQLRHFSISFLSSLLGTENASVRLDNSSSGASVVAIDNKIEQAMDLVKSHLMYAVREEVEVLKEQIKELIEKNSQLEQENNLLKTLASPEQLAQFQAQLQTGSPPATTQPQGTTQPPAQPASQGSGPTA

SEQ ID NO: 93189 - protein, 1073 aa, Homo sapiens
  Payload ID: 18616
  Gene Name: TSC22 domain family, member 1
  Uniprot ID: Q15714
  ENSP ID: ENSP00000397435
MHQPPESTAAAAAAADISARKMAHPAMFPRRGSGSGSASALNAAGTGVGSNATSSEDFPPPSLLQPPPPAASSTSGPQPPPPQSLNLLSQAQLQAQPLAPGGTQMKKKSGFQITSVTPAQISASISSNNSIAEDTESYDDLDESHTEDLSSSEILDVSLSRATDLGEPERSSSEETLNNFQEAETPGAVSPNQPHLPQPHLPHLPQQNVVINGNAHPHHLHHHHQIHHGHHLQHGHHHPSHVAVASASITGGPPSSPVSRKLSTTGSSDSITPVAPTSAVSSSGSPASVMTNMRAPSTTGGIGINSVTGTSTVNNVNITAVGSFNPNVTSSMLGNVNISTSNIPSAAGVSVGPGVTSGVNVNILSGMGNGTISSSAAVSSVPNAAAGMTGGSVSSQQQQPTVNTSRFRVVKLDSSSEPFKKGRWTCTEFYEKENAVPATEGVLINKVVETVKQNPIEVTSERESTSGSSVSSSVSTLSHYTESVGSGEMGAPTVVVQQQQQQQQQQQQQPALQGVTLQQMDFGSTGPQSIPAVSIPQSISQSQISQVQLQSQELSYQQKQGLQPVPLQATMSAATGIQPSPVNVVGVTSALGQQPSISSLAQPQLPYSQAAPPVQTPLPGAPPPQQLQYGQQQPMVSTQMAPGHVKSVTQNPASEYVQQQPILQTAMSSGQPSSAGVGAGTTVIPVAQPQGIQLPVQPTAVPAQPAGASVQPVGQAPAAVSAVPTGSQIANIGQQANIPTAVQQPSTQVPPSVIQQGAPPSSQVVPPAQTGIIHQGVQTSAPSLPQQLVIASQSSLLTVPPQPQGVEPVAQGIVSQQLPAVSSLPSASSISVTSQVSSTGPSGMPSAPTNLVPPQNIAQTPATQNGNLVQSVSQPPLIATNTNLPLAQQIPLSSTQFSAQSLAQAIGSQIEDARRAAEPSLVGLPQTISGDSGGMSAVSDGSSSSLAASASLFPLKVLPLTTPLVDGEDESSSGASVVAIDNKIEQAMDLVKSHLMYAVREEVEVLKEQIKELIEKNSQLEQENNLLKTLASPEQLAQFQAQLQTGSPPATTQPQGTTQPPAQPASQGSGPTA

SEQ ID NO: 93190 - protein, 149 aa, Homo sapiens
  Payload ID: 18616
  Gene Name: TSC22 domain family, member 1
  ENSP ID: ENSP00000417476
  MOD_RES (1)..(1): Any amino acid
XVPPQNIAQTPATQNGNLVQSVSQPPLIATNTNLPLAQQIPLSSTQFSAQSLAQAIGSQIEDARRAAEPSLVGLPQTISGDSGGMSAVSDGSSSSLAASASLFPLKVLPLTTPLVDGEDESSLFQCFSPTRGARSDPRTTDTAKTTESF

SEQ ID NO: 93191 - protein, 142 aa, Homo sapiens
  Payload ID: 18616
  Gene Name: TSC22 domain family, member 1
  ENSP ID: ENSP00000418739
MHQPPESTAAAAAAADISARKMAHPAMFPRRGSGSGSASALNAAGTGVGSNATSSEDFPPPSLLQPPPPAASSTSGPQPPPPQSLNLLSQAQLQAQPLAPGGTQMKKKSGFQITSVTPAQISASISSNNSIAEDTESYDDLD

SEQ ID NO: 93192 - protein, 41 aa, Homo sapiens
  Payload ID: 18616
  Gene Name: TSC22 domain family, member 1
  ENSP ID: ENSP00000419864
MKSQWCRPVAMDLGVYQLRHFSISFLSSLLGTENASVRLDN

SEQ ID NO: 93193 - protein, 570 aa, Homo sapiens
  Payload ID: 18616
  Gene Name: TSC22 domain family, member 1
  Uniprot ID: Q15714
  ENSP ID: ENSP00000437414
MHQPPESTAAAAAAADISARKMAHPAMFPRRGSGSGSASALNAAGTGVGSNATSSEDFPPPSLLQPPPPAASSTSGPQPPPPQSLNLLSQAQLQAQPLAPGGTQMKKKSGFQITSVTPAQISASISSNNSIAEDTESYDDLDESHTEDLSSSEILDVSLSRATDLGEPERSSSEETLNNFQEAETPGAVSPNQPHLPQPHLPHLPQQNVVINGNAHPHHLHHHHQIHHGHHLQHGHHHPSHVAVASASITGGPPSSPVSRKLSTTGSSDSITPVAPTSAVSSSGSPASVMTNMRAPSTTGGIGINSVTGTSTVNNVNITAVGSFNPNVTSSMLGNVNISTSNIPSAAGVSVGPGVTSGVNVNILSGMGNGTISSSAAVSSVPNAAAGMTGGSVSSQQQQPTVNTSRFRVVKLDSSSEPFKKGRWTCTEFYEKENAVPATEGVLINKVVETVKQNPIEVTSERESTSGSSVSSSVSTLSHYTESVGSGEMGAPTVVVQQQQQQQQQQQQQPALQGVTLQQMDFGSTGPQSIPAVSIPQSISQSQISQVQLQSQELSYLTMKVVLLIVYLCM

SEQ ID NO: 93194 - protein, 86 aa, Homo sapiens
  Payload ID: 18616
  Gene Name: TSC22 domain family, member 1
  ENSP ID: ENSP00000481585
MDLVKSHLMYAVREEVEVLKEQIKELIEKNSQLEQENNLLKTLASPEQLAQFQAQLQTGSPPATTQPQGTTQPPAQPASQGSGPTA

SEQ ID NO: 93195 - protein, 86 aa, Homo sapiens; identical to SEQ ID NO: 93194
  Payload ID: 18616
  Gene Name: TSC22 domain family, member 1
  ENSP ID: ENSP00000483407

SEQ ID NO: 93196 - protein, 780 aa, Homo sapiens
  Payload ID: 18617
  Gene Name: TSC22 domain family, member 2
  Uniprot ID: O75157
  ENSP ID: ENSP00000354543
MSKMPAKKKSCFQITSVTTAQVATSITEDTESLDDPDESRTEDVSSEIFDVSRATDYGPEEVCERSSSEETLNNVGDAETPGTVSPNLLLDGQLAAAAAAPANGGGVVSARSVSGALASTLAAAATSAPAPGAPGGPQLAGSSAGPVTAAPSQPPTTCSSRFRVIKLDHGSGEPYRRGRWTCMEYYERDSDSSVLTRSGDCIRHSSTFDQTAERDSGLGATGGSVVVVVASMQGAHGPESGTDSSLTAVSQLPPSEKMSQPTPAQPQSFSVGQPQPPPPPVGGAVAQSSAPLPPFPGAATGPQPMMAAAQPSQPQGAGPGGQTLPPTNVTLAQPAMSLPPQPGPAVGAPAAQQPQQFAYPQPQIPPGHLLPVQPSGQSEYLQQHVAGLQPPSPAQPSSTGAAASPATAATLPVGTGQNASSVGAQLMGASSQPSEAMAPRTGPAQGGQVAPCQPTGVPPATVGGVVQPCLGPAGAGQPQSVPPPQMGGSGPLSAVPGGPHAVVPGVPNVPAAVPAPSVPSVSTTSVTMPNVPAPLAQSQQLSSHTPVSRSSSIIQHVGLPLAPGTHSAPTSLPQSDLSQFQTQTQPLVGQVDDTRRKSEPLPQPPLSLIAENKPVVKPPVADSLANPLQLTPMNSLATSVFSIAIPVDGDEDRNPSTAFYQAFHLNTLKESKSLWDSASGGGVVAIDNKIEQAMDLVKSHLMYAVREEVEVLKEQIKELVERNSLLERENALLKSLSSNDQLSQLPTQQANPGSTSQQQAVIAQPPQPTQPPQQPNVSSA

SEQ ID NO: 93197 - protein, 204 aa, Homo sapiens
  Payload ID: 18617
  Gene Name: TSC22 domain family, member 2
  ENSP ID: ENSP00000417747
  MOD_RES (1)..(1): Any amino acid
XIQHVGLPLAPGTHSAPTSLPQSDLSQFQTQTQPLVGQVDDTRRKSEPLPQPPLSLIAENKPVVKPPVADSLANPLQLTPMNSLATSVFSIAIPVDGDEDSASGGGVVAIDNKIEQAMDLVKSHLMYAVREEVEVLKEQIKELVERNSLLERENALLKSLSSNDQLSQLPTQQANPGSTSQQQAVIAQPPQPTQPPQQPNVSSA

SEQ ID NO: 93198 - protein, 116 aa, Homo sapiens
  Payload ID: 18617
  Gene Name: TSC22 domain family, member 2
  ENSP ID: ENSP00000418149
  MOD_RES (1)..(1): Any amino acid
XLSSHTPVSRSSSIIQHVGLPLAPGTHSAPTSLPQSDLSQFQTQTQPLVGQVDDTRRKSEPLPQPPLSLIAENKPVVKPPVADSLANPLQLTPMNSLATSVFSIAIPVDGDEDRIW

SEQ ID NO: 93199 - protein, 81 aa, Homo sapiens
  Payload ID: 18617
  Gene Name: TSC22 domain family, member 2
  ENSP ID: ENSP00000420689
  MOD_RES (1)..(1): Any amino acid
XENKPVVKPPVADSLANPLQLTPMNSLATSVFSIAIPVDGDEDRNPSTAFYQAFHLNTLKESKSLWDRIFFRIQHRRRNVT

SEQ ID NO: 93200 - protein, 200 aa, Homo sapiens
  Payload ID: 18618
  Gene Name: TSC22 domain family, member 3
  Uniprot ID: Q99576
  ENSP ID: ENSP00000314655
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 93201 - protein, 110 aa, Homo sapiens
  Payload ID: 18618
  Gene Name: TSC22 domain family, member 3
  ENSP ID: ENSP00000361457
MAFQPPYSSSLFRKRDNASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 93202 - protein, 200 aa, Homo sapiens; identical to SEQ ID NO: 93200
  Payload ID: 18618
  Gene Name: TSC22 domain family, member 3
  Uniprot ID: Q99576
  ENSP ID: ENSP00000361458

SEQ ID NO: 93203 - protein, 200 aa, Homo sapiens; identical to SEQ ID NO: 93200
  Payload ID: 18618
  Gene Name: TSC22 domain family, member 3
  Uniprot ID: Q99576
  ENSP ID: ENSP00000361459

SEQ ID NO: 93204 - protein, 77 aa, Homo sapiens
  Payload ID: 18618
  Gene Name: TSC22 domain family, member 3
  ENSP ID: ENSP00000361466
MDLVKNHLMYAVREEVEILKEQIRELVEKNSQLERENTLLKTLASPEQLEKFQSCLSPEEPAPESPQVPEAPGGSAV

SEQ ID NO: 93205 - protein, 134 aa, Homo sapiens
  Payload ID: 18618
  Gene Name: TSC22 domain family, member 3
  Uniprot ID: Q99576
  ENSP ID: ENSP00000361474
MNTEMYQTPMEVAVYQLHNFSISFFSSLLGGDVVSVKLDNSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 93206 - protein, 132 aa, Homo sapiens
  Payload ID: 18618
  Gene Name: TSC22 domain family, member 3
  ENSP ID: ENSP00000421016
MRQDSLEPVLRDPCYLINEGICNRNIDQTMLSILLFFHSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 93207 - protein, 100 aa, Homo sapiens
  Payload ID: 18618
  Gene Name: TSC22 domain family, member 3
  ENSP ID: ENSP00000422060
MNTEMYQTPMEVAVYQLHNFSISFFSSLLGGDVVSVKLDNSASGASVVAIDNKIEQAMVSGITASFSSPDLAAAYVTLGRIEGMGEKALSQNPEEADSLP

SEQ ID NO: 93208 - protein, 58 aa, Homo sapiens
  Payload ID: 18618
  Gene Name: TSC22 domain family, member 3
  ENSP ID: ENSP00000422228
MAQSKLDCRSPVGLDCCNCCLDLAHRSGLQRGSSGENNNPGSPTVSNFRQLQEKLVFE

SEQ ID NO: 93209 - protein, 119 aa, Homo sapiens
  Payload ID: 18618
  Gene Name: TSC22 domain family, member 3
  ENSP ID: ENSP00000422636
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAIDNK

SEQ ID NO: 93210 - protein, 116 aa, Homo sapiens
  Payload ID: 18618
  Gene Name: TSC22 domain family, member 3
  ENSP ID: ENSP00000424653
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAI

SEQ ID NO: 93211 - protein, 122 aa, Homo sapiens
  Payload ID: 18618
  Gene Name: TSC22 domain family, member 3
  ENSP ID: ENSP00000425155
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAIDNKIEQ

SEQ ID NO: 93212 - protein, 84 aa, Homo sapiens
  Payload ID: 18618
  Gene Name: TSC22 domain family, member 3
  ENSP ID: ENSP00000425158
MAQSKLDCRSPVGLDCCNCCLDLAHRSGLQRGSSGENNNPGSPTVSNFRQLQEKLVFENLNTDKLNSIMRQDSLEPVLRDPCYL

SEQ ID NO: 93213 - protein, 25 aa, Homo sapiens
  Payload ID: 18618
  Gene Name: TSC22 domain family, member 3
  ENSP ID: ENSP00000425414
MDLVKNHLMYAVREEVEILKEQIRE

SEQ ID NO: 93214 - protein, 100 aa, Homo sapiens
  Payload ID: 18618
  Gene Name: TSC22 domain family, member 3
  ENSP ID: ENSP00000427075
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLS

SEQ ID NO: 93215 - protein, 124 aa, Homo sapiens
  Payload ID: 18618
  Gene Name: TSC22 domain family, member 3
  ENSP ID: ENSP00000427199
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAIDNKIEQAM

SEQ ID NO: 93216 - protein, 200 aa, Homo sapiens; identical to SEQ ID NO: 93200
  Payload ID: 18618
  Gene Name: TSC22 domain family, member 3
  Uniprot ID: Q99576
  ENSP ID: ENSP00000427427

SEQ ID NO: 93217 - protein, 395 aa, Homo sapiens
  Payload ID: 18619
  Gene Name: TSC22 domain family, member 4
  Uniprot ID: Q9Y3Q8
  ENSP ID: ENSP00000300181
MSGGKKKSSFQITSVTTDYEGPGSPGASDPPTPQPPTGPPPRLPNGEPSPDPGGKGTPRNGSPPPGAPSSRFRVVKLPHGLGEPYRRGRWTCVDVYERDLEPHSFGGLLEGIRGASGGAGGRSLDSRLELASLGLGAPTPPSGLSQGPTSWLRPPPTSPGPQARSFTGGLGQLVVPSKAKAEKPPLSASSPQQRPPEPETGESAGTSRAATPLPSLRVEAEAGGSGARTPPLSRRKAVDMRLRMELGAPEEMGQVPPLDSRPSSPALYFTHDASLVHKSPDPFGAVAAQKFSLAHSMLAISGHLDSDDDSGSGSLVGIDNKIEQAMDLVKSHLMFAVREEVEVLKEQIRELAERNAALEQENGLLRALASPEQLAQLPSSGVPRLGPPAPNGPSV

SEQ ID NO: 93218 - protein, 156 aa, Homo sapiens
  Payload ID: 18619
  Gene Name: TSC22 domain family, member 4
  Uniprot ID: Q9Y3Q8
  ENSP ID: ENSP00000377560
MRLRMELGAPEEMGQVPPLDSRPSSPALYFTHDASLVHKSPDPFGAVAAQKFSLAHSMLAISGHLDSDDDSGSGSLVGIDNKIEQAMDLVKSHLMFAVREEVEVLKEQIRELAERNAALEQENGLLRALASPEQLAQLPSSGVPRLGPPAPNGPSV

SEQ ID NO: 93219 - protein, 211 aa, Homo sapiens
  Payload ID: 18619
  Gene Name: TSC22 domain family, member 4
  ENSP ID: ENSP00000388168
  MOD_RES (1)..(1): Any amino acid
XLLSACLAPARPCSARGALSPPGIPFTASLSIGGVSKDPFPLGMAQPGVSVKSLVSSYETRVVGMAPGLPRKRGCASSPCSPRGASPIRGTSGPPPHRGLGGPGQRPSTRRGMDKTLLSLILYCHSGSGSLVGIDNKIEQAMDLVKSHLMFAVREEVEVLKEQIRELAERNAALEQENGLLRALASPEQLAQLPSSGVPRLGPPAPNGPSV

SEQ ID NO: 93220 - protein, 168 aa, Homo sapiens
  Payload ID: 18619
  Gene Name: TSC22 domain family, member 4
  ENSP ID: ENSP00000395795
  MOD_RES (1)..(1): Any amino acid
XHCLLSACLAPARPCSARGALSPPGIPFTASLSIGGVSKDPFPLGMAQPGVSVKSLVSSYETRVVGMAPGLPRKRGCASSPCSPRGASPIRGTSGPPPHRGLGGPGQRPSTRRGMDKTLLSLILYCHSGSGSLVGIDNKIEQAMPSRHWAGDEAPTPLTLCLSRGPQD

SEQ ID NO: 93221 - protein, 171 aa, Homo sapiens
  Payload ID: 18620
  Gene Name: TSEN15 tRNA splicing endonuclease subunit
  Uniprot ID: Q8WW01
  ENSP ID: ENSP00000355299
MEERGDSEPTPGCSGLGPGGVRGFGDGGGAPSWAPEDAWMGTHPKYLEMMELDIGDATQVYVAFLVYLDLMESKSWHEVNCVGLPELQLICLVGTEIEGEGLQTVVPTPITASLSHNRIREILKASRKLQGDPDLPMSFTLAIVESDSTIVYYKLTDGFMLPDPQNISLRR

SEQ ID NO: 93222 - protein, 129 aa, Homo sapiens
  Payload ID: 18620
  Gene Name: TSEN15 tRNA splicing endonuclease subunit
  Uniprot ID: Q8WW01
  ENSP ID: ENSP00000402002
MEERGDSEPTPGCSGLGPGGVRGFGDGGGAPSWAPEDAWMGTHPKYLEMMELDIGDATQVYVAFLVYLDLMESKSWHEVNCVGLPELQLICLVGTEIEGEGLQTVVPTPITASLSHNRIFLLEDDIHVS

SEQ ID NO: 93223 - protein, 136 aa, Homo sapiens
  Payload ID: 18620
  Gene Name: TSEN15 tRNA splicing endonuclease subunit
  ENSP ID: ENSP00000432397
  MOD_RES (1)..(1): Any amino acid
XERGDSEPTPGCSGLGPGGVRGFGDGGGAPSWAPEDAWMGTHPKYLEMMELDIGDATQVYVAFLVYLDLMESKSWHEVNCVGLPELQLICLVGTEIEGEGLQTVVPTPITASLSHNRYWRATFEEGKYLATLKDLH

SEQ ID NO: 93224 - protein, 119 aa, Homo sapiens
  Payload ID: 18620
  Gene Name: TSEN15 tRNA splicing endonuclease subunit
  ENSP ID: ENSP00000435144
MEERGDSEPTPGCSGLGPGGVRGFGDGGGAPSWAPEDAWMGTHPKYLEMMELDIGDATQVYVAFLVYLDLMESKSWHEVNCVGLPELQLICLVGTEIEGEGLQTVVPTPITASLSHNRW

SEQ ID NO: 93225 - protein, 134 aa, Homo sapiens
  Payload ID: 18620
  Gene Name: TSEN15 tRNA splicing endonuclease subunit
  ENSP ID: ENSP00000436996
MEERGDSEPTPGCSGLGPGGVRGFGDGGGAPSWAPEDAWMGTHPKYLEMMELDIGDATQVYVAFLVYLDLMESKSWHEVNCVGLPELQLICLVGTEIEGEGLQTVVPTPITASLSHNRIREILKASRKLQEYFS

SEQ ID NO: 93226 - protein, 465 aa, Homo sapiens
  Payload ID: 18621
  Gene Name: TSEN2 tRNA splicing endonuclease subunit
  Uniprot ID: Q8NCE0
  ENSP ID: ENSP00000284995
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVVNGDSGKSGGVGDPREPLGCLQEGSGCHPTTESFEKSVREDASPLPHVCCCKQDALILQRGLHHEDGSQHIGLLHPGDRGPDHEYVLVEEAECAMSEREAAPNEELVQRNRLICRRNPYRIFEYLQLSLEEAFFLVYALGCLSIYYEKEPLTIVKLWKAFTVVQPTFRTTYMAYHYFRSKGWVPKVGLKYGTDLLLYRKGPPFYHASYSVIIELVDDHFEGSLRRPLSWKSLAALSRVSVNVSKELMLCYLIKPSTMTDKEMESPECMKRIKVQEVILSRWVSSRERSDQDDL

SEQ ID NO: 93227 - protein, 465 aa, Homo sapiens; identical to SEQ ID NO: 93226
  Payload ID: 18621
  Gene Name: TSEN2 tRNA splicing endonuclease subunit
  Uniprot ID: Q8NCE0
  ENSP ID: ENSP00000385976

SEQ ID NO: 93228 - protein, 406 aa, Homo sapiens
  Payload ID: 18621
  Gene Name: TSEN2 tRNA splicing endonuclease subunit
  Uniprot ID: Q8NCE0
  ENSP ID: ENSP00000392029
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVRGLHHEDGSQHIGLLHPGDRGPDHEYVLVEEAECAMSEREAAPNEELVQRNRLICRRNPYRIFEYLQLSLEEAFFLVYALGCLSIYYEKEPLTIVKLWKAFTVVQPTFRTTYMAYHYFRSKGWVPKVGLKYGTDLLLYRKGPPFYHASYSVIIELVDDHFEGSLRRPLSWKSLAALSRVSVNVSKELMLCYLIKPSTMTDKEMESPECMKRIKVQEVILSRWVSSRERSDQDDL

SEQ ID NO: 93229 - protein, 378 aa, Homo sapiens
  Payload ID: 18621
  Gene Name: TSEN2 tRNA splicing endonuclease subunit
  ENSP ID: ENSP00000406238
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVVNGDSGKSGGVGDPREPLGCLQEGSGCHPTTESFEKSVREDASPLPHVCCCKQDALILQRGLHHEDGSQHIGLLHPGDRGPDHEYVLVEEAECAMSEREAAPNEELVQRNRLICRRNPYRIFEYLQLSLEEAFFLVYALGCLSIYYEKEPLTIVKLWKAFTVVQPTFRTTYMAYHYFRSKGWVPKVGLKYGTDLLLYRKGPPFYHA

SEQ ID NO: 93230 - protein, 402 aa, Homo sapiens
  Payload ID: 18621
  Gene Name: TSEN2 tRNA splicing endonuclease subunit
  Uniprot ID: Q8NCE0
  ENSP ID: ENSP00000407974
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVVNGDSGKSGGVGDPREPLGCLQEGSGCHPTTESFEKSVREDASPLPHVCCCKQDALILQRGLHHEDGSQHIGLLHPGDRGPDHEYVLVEEAECAMSEREAAPNEEAFFLVYALGCLSIYYEKEPLTIVKLWKAFTVVQPTFRTTYMAYHYFRSKGWVPKVGLKYGTDLLLYRKGPPFYHASYSVIIELVDDHFEGSLRRPLSWKSLAALSRVSVNVSKVTQHQLCHWSVT

SEQ ID NO: 93231 - protein, 101 aa, Homo sapiens
  Payload ID: 18621
  Gene Name: TSEN2 tRNA splicing endonuclease subunit
  ENSP ID: ENSP00000408528
KELMLCYLIKPSTMTDKEMESPECMKRIKVQSRSVVQAGVQCCDLGSLQPLPAGFKRFSCLSLLSSWDYRHAPPHTANFCIFSRDGVSLCWPGWSGTPDLK

SEQ ID NO: 93232 - protein, 81 aa, Homo sapiens
  Payload ID: 18621
  Gene Name: TSEN2 tRNA splicing endonuclease subunit
  ENSP ID: ENSP00000408744
  MOD_RES (1)..(1): Any amino acid
XLVDDHFEGSLRRPLSWKSLAALSRVSVNVSKELMLCYLIKPSTMTDKEMESPECMKRIKVQEVILSRWVSSRERSDQDDL

SEQ ID NO: 93233 - protein, 439 aa, Homo sapiens
  Payload ID: 18621
  Gene Name: TSEN2 tRNA splicing endonuclease subunit
  Uniprot ID: Q8NCE0
  ENSP ID: ENSP00000416510
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVVNGDSGKSGGVGDPREPLGCLQEGSGCHPTTESFEKSVREDASPLPHVCCCKQDALILQRGLHHEDGSQHIGLLHPGDRGPDHEYVLVEEAECAMSEREAAPNEEAFFLVYALGCLSIYYEKEPLTIVKLWKAFTVVQPTFRTTYMAYHYFRSKGWVPKVGLKYGTDLLLYRKGPPFYHASYSVIIELVDDHFEGSLRRPLSWKSLAALSRVSVNVSKELMLCYLIKPSTMTDKEMESPECMKRIKVQEVILSRWVSSRERSDQDDL

SEQ ID NO: 93234 - protein, 310 aa, Homo sapiens
  Payload ID: 18622
  Gene Name: TSEN34 tRNA splicing endonuclease subunit
  Uniprot ID: Q9BSV6
  ENSP ID: ENSP00000305524
MLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQELLEKITEGQAAKKQKLEQASGASSSQEAGSSQAAKEDETSDGQASGEQEEAGPSSSQAGPSNGVAPLPRSALLVQLATARPRPVKARPLDWRVQSKDWPHAGRPAHELRYSIYRDLWERGFFLSAAGKFGGDFLVYPGDPLRFHAHYIAQCWAPEDTIPLQDLVAAGRLGTSVRKTLLLCSPQPDGKVVYTSLQWASLQ

SEQ ID NO: 93235 - protein, 310 aa, Homo sapiens; identical to SEQ ID NO: 93234
  Payload ID: 18622
  Gene Name: TSEN34 tRNA splicing endonuclease subunit
  Uniprot ID: Q9BSV6
  ENSP ID: ENSP00000379667

SEQ ID NO: 93236 - protein, 310 aa, Homo sapiens; identical to SEQ ID NO: 93234
  Payload ID: 18622
  Gene Name: TSEN34 tRNA splicing endonuclease subunit
  Uniprot ID: Q9BSV6
  ENSP ID: ENSP00000379671

SEQ ID NO: 93237 - protein, 315 aa, Homo sapiens
  Payload ID: 18622
  Gene Name: TSEN34 tRNA splicing endonuclease subunit
  ENSP ID: ENSP00000397402
MRRMLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQELLEKITEGQAAKKQKLEQASGASSSQEAGSSQAAKEDETSDGQASGEQEEAGPSSSQAGPSNGVAPLPRSALLVQLATARPRPVKARPLDWRVQSKDWPHAGRPAHELRYSIYRDLWERGFFLSAAGKFGGDFLVYPGDPLRFHAHYIAQCWAPEDTIPLQDLVAAGRLGTSVRKTLLLCSPQPDGFKSQEVSINLVYKCS

SEQ ID NO: 93238 - protein, 242 aa, Homo sapiens
  Payload ID: 18622
  Gene Name: TSEN34 tRNA splicing endonuclease subunit
  ENSP ID: ENSP00000400743
MLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQELLEKITEGQAAKKQKLEQASGASSSQEAGSSQAAKEDETSDGQASGEQEEAGPSSSQAGPSNGVAPLPRSALLVQLATARPRPVKARPLDWRVQSKDWPHAGRPAHELRYSIYRDLWERGFFLSAAGKFGG

SEQ ID NO: 93239 - protein, 251 aa, Homo sapiens
  Payload ID: 18622
  Gene Name: TSEN34 tRNA splicing endonuclease subunit
  ENSP ID: ENSP00000408689
MRRMLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQELLEKITEGQAAKKQKLEQASGASSSQEAGSSQAAKEDETSDGQASGEQEEAGPSSSQAGPSNGVAPLPRSALLVQLATARPRPVKARPLDWRVQSKDWPHAGRPAHELRYSIYRDLWERGFFLSAAGKFGGDFLVYP

SEQ ID NO: 93240 - protein, 310 aa, Homo sapiens; identical to SEQ ID NO: 93234
  Payload ID: 18622
  Gene Name: TSEN34 tRNA splicing endonuclease subunit
  ENSP ID: ENSP00000477766

SEQ ID NO: 93241 - protein, 242 aa, Homo sapiens; identical to SEQ ID NO: 93238
  Payload ID: 18622
  Gene Name: TSEN34 tRNA splicing endonuclease subunit
  ENSP ID: ENSP00000477913

SEQ ID NO: 93242 - protein, 310 aa, Homo sapiens; identical to SEQ ID NO: 93234
  Payload ID: 18622
  Gene Name: TSEN34 tRNA splicing endonuclease subunit
  Uniprot ID: Q9BSV6
  ENSP ID: ENSP00000478156

SEQ ID NO: 93243 - protein, 315 aa, Homo sapiens; identical to SEQ ID NO: 93237
  Payload ID: 18622
  Gene Name: TSEN34 tRNA splicing endonuclease subunit
  ENSP ID: ENSP00000478203

SEQ ID NO: 93244 - protein, 315 aa, Homo sapiens; identical to SEQ ID NO: 93237
  Payload ID: 18622
  Gene Name: TSEN34 tRNA splicing endonuclease subunit
  ENSP ID: ENSP00000478451

SEQ ID NO: 93245 - protein, 310 aa, Homo sapiens; identical to SEQ ID NO: 93234
  Payload ID: 18622
  Gene Name: TSEN34 tRNA splicing endonuclease subunit
  Uniprot ID: Q9BSV6
  ENSP ID: ENSP00000478622

SEQ ID NO: 93246 - protein, 242 aa, Homo sapiens; identical to SEQ ID NO: 93238
  Payload ID: 18622
  Gene Name: TSEN34 tRNA splicing endonuclease subunit
  ENSP ID: ENSP00000478751

SEQ ID NO: 93247 - protein, 315 aa, Homo sapiens; identical to SEQ ID NO: 93237
  Payload ID: 18622
  Gene Name: TSEN34 tRNA splicing endonuclease subunit
  ENSP ID: ENSP00000479105

SEQ ID NO: 93248 - protein, 315 aa, Homo sapiens; identical to SEQ ID NO: 93237
  Payload ID: 18622
  Gene Name: TSEN34 tRNA splicing endonuclease subunit
  ENSP ID: ENSP00000479563

SEQ ID NO: 93249 - protein, 310 aa, Homo sapiens; identical to SEQ ID NO: 93234
  Payload ID: 18622
  Gene Name: TSEN34 tRNA splicing endonuclease subunit
  Uniprot ID: Q9BSV6
  ENSP ID: ENSP00000479576

SEQ ID NO: 93250 - protein, 310 aa, Homo sapiens; identical to SEQ ID NO: 93234
  Payload ID: 18622
  Gene Name: TSEN34 tRNA splicing endonuclease subunit
  Uniprot ID: Q9BSV6
  ENSP ID: ENSP00000479654

SEQ ID NO: 93251 - protein, 310 aa, Homo sapiens; identical to SEQ ID NO: 93234
  Payload ID: 18622
  Gene Name: TSEN34 tRNA splicing endonuclease subunit
  ENSP ID: ENSP00000480422

SEQ ID NO: 93252 - protein, 310 aa, Homo sapiens; identical to SEQ ID NO: 93234
  Payload ID: 18622
  Gene Name: TSEN34 tRNA splicing endonuclease subunit
  Uniprot ID: Q9BSV6
  ENSP ID: ENSP00000480503

SEQ ID NO: 93253 - protein, 310 aa, Homo sapiens; identical to SEQ ID NO: 93234
  Payload ID: 18622
  Gene Name: TSEN34 tRNA splicing endonuclease subunit
  Uniprot ID: Q9BSV6
  ENSP ID: ENSP00000480899

SEQ ID NO: 93254 - protein, 310 aa, Homo sapiens; identical to SEQ ID NO: 93234
  Payload ID: 18622
  Gene Name: TSEN34 tRNA splicing endonuclease subunit
  Uniprot ID: Q9BSV6
  ENSP ID: ENSP00000480964

SEQ ID NO: 93255 - protein, 310 aa, Homo sapiens; identical to SEQ ID NO: 93234
  Payload ID: 18622
  Gene Name: TSEN34 tRNA splicing endonuclease subunit
  ENSP ID: ENSP00000481068

SEQ ID NO: 93256 - protein, 310 aa, Homo sapiens; identical to SEQ ID NO: 93234
  Payload ID: 18622
  Gene Name: TSEN34 tRNA splicing endonuclease subunit
  ENSP ID: ENSP00000481374

SEQ ID NO: 93257 - protein, 252 aa, Homo sapiens
  Payload ID: 18622
  Gene Name: TSEN34 tRNA splicing endonuclease subunit
  ENSP ID: ENSP00000481573
MRRMLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQELLEKITEGQAAKKQKLEQASGASSSQEAGSSQAAKEDETSDGQASGEQEEAGPSSSQAGPSNGVAPLPRSALLVQLATARPRPVKARPLDWRVQSKDWPHAGRPAHELRYSIYRDLWERGFFLSAAGKFGGDFLVYPG

SEQ ID NO: 93258 - protein, 251 aa, Homo sapiens; identical to SEQ ID NO: 93239
  Payload ID: 18622
  Gene Name: TSEN34 tRNA splicing endonuclease subunit
  ENSP ID: ENSP00000481608

SEQ ID NO: 93259 - protein, 310 aa, Homo sapiens; identical to SEQ ID NO: 93234
  Payload ID: 18622
  Gene Name: TSEN34 tRNA splicing endonuclease subunit
  ENSP ID: ENSP00000481639

SEQ ID NO: 93260 - protein, 310 aa, Homo sapiens; identical to SEQ ID NO: 93234
  Payload ID: 18622
  Gene Name: TSEN34 tRNA splicing endonuclease subunit
  ENSP ID: ENSP00000482084

SEQ ID NO: 93261 - protein, 242 aa, Homo sapiens; identical to SEQ ID NO: 93238
  Payload ID: 18622
  Gene Name: TSEN34 tRNA splicing endonuclease subunit
  ENSP ID: ENSP00000482513

SEQ ID NO: 93262 - protein, 310 aa, Homo sapiens; identical to SEQ ID NO: 93234
  Payload ID: 18622
  Gene Name: TSEN34 tRNA splicing endonuclease subunit
  ENSP ID: ENSP00000482527

SEQ ID NO: 93263 - protein, 315 aa, Homo sapiens; identical to SEQ ID NO: 93237
  Payload ID: 18622
  Gene Name: TSEN34 tRNA splicing endonuclease subunit
  ENSP ID: ENSP00000482737

SEQ ID NO: 93264 - protein, 315 aa, Homo sapiens; identical to SEQ ID NO: 93237
  Payload ID: 18622
  Gene Name: TSEN34 tRNA splicing endonuclease subunit
  ENSP ID: ENSP00000483157

SEQ ID NO: 93265 - protein, 315 aa, Homo sapiens; identical to SEQ ID NO: 93237
  Payload ID: 18622
  Gene Name: TSEN34 tRNA splicing endonuclease subunit
  ENSP ID: ENSP00000483220

SEQ ID NO: 93266 - protein, 310 aa, Homo sapiens; identical to SEQ ID NO: 93234
  Payload ID: 18622
  Gene Name: TSEN34 tRNA splicing endonuclease subunit
  ENSP ID: ENSP00000483266

SEQ ID NO: 93267 - protein, 310 aa, Homo sapiens; identical to SEQ ID NO: 93234
  Payload ID: 18622
  Gene Name: TSEN34 tRNA splicing endonuclease subunit
  ENSP ID: ENSP00000483436

SEQ ID NO: 93268 - protein, 310 aa, Homo sapiens; identical to SEQ ID NO: 93234
  Payload ID: 18622
  Gene Name: TSEN34 tRNA splicing endonuclease subunit
  Uniprot ID: Q9BSV6
  ENSP ID: ENSP00000484225

SEQ ID NO: 93269 - protein, 315 aa, Homo sapiens; identical to SEQ ID NO: 93237
  Payload ID: 18622
  Gene Name: TSEN34 tRNA splicing endonuclease subunit
  ENSP ID: ENSP00000484239

SEQ ID NO: 93270 - protein, 310 aa, Homo sapiens; identical to SEQ ID NO: 93234
  Payload ID: 18622
  Gene Name: TSEN34 tRNA splicing endonuclease subunit
  ENSP ID: ENSP00000484465

SEQ ID NO: 93271 - protein, 315 aa, Homo sapiens; identical to SEQ ID NO: 93237
  Payload ID: 18622
  Gene Name: TSEN34 tRNA splicing endonuclease subunit
  ENSP ID: ENSP00000484555

SEQ ID NO: 93272 - protein, 310 aa, Homo sapiens; identical to SEQ ID NO: 93234
  Payload ID: 18622
  Gene Name: TSEN34 tRNA splicing endonuclease subunit
  Uniprot ID: Q9BSV6
  ENSP ID: ENSP00000484694

SEQ ID NO: 93273 - protein, 310 aa, Homo sapiens; identical to SEQ ID NO: 93234
  Payload ID: 18622
  Gene Name: TSEN34 tRNA splicing endonuclease subunit
  ENSP ID: ENSP00000484865

SEQ ID NO: 93274 - protein, 310 aa, Homo sapiens; identical to SEQ ID NO: 93234
  Payload ID: 18622
  Gene Name: TSEN34 tRNA splicing endonuclease subunit
  ENSP ID: ENSP00000484964

SEQ ID NO: 93275 - protein, 526 aa, Homo sapiens
  Payload ID: 18623
  Gene Name: TSEN54 tRNA splicing endonuclease subunit
  Uniprot ID: Q7Z6J9
  ENSP ID: ENSP00000327487
MEPEPEPAAVEVPAGRVLSARELFAARSRSQKLPQRSHGPKDFLPDGSAAQAERLRRCREELWQLLAEQRVERLGSLVAAEWRPEEGFVELKSPAGKFWQTMGFSEQGRQRLHPEEALYLLECGSIHLFHQDLPLSIQEAYQLLLTDHTVTFLQYQVFSHLKRLGYVVRRFQPSSVLSPYERQLNLDASVQHLEDGDGKRKRSSSSPRSINKKAKALDNSLQPKSLAASSPPPCSQPSQCPEEKPQESSPMKGPGGPFQLLGSLGPSPGPAREGVGCSWESGRAENGVTGAGKRRWNFEQISFPNMASDSRHTLLRAPAPELLPANVAGRETDAESWCQKLNQRKEKLSRREREHHAEAAQFQEDVNADPEVQRCSSWREYKELLQRRQVQRSQRRAPHLWGQPVTPLLSPGQASSPAVVLQHISVLQTTHLPDGGARLLEKSGGLEIIFDVYQADAVATFRKNNPGKPYARMCISGFDEPVPDLCSLKRLSYQSGDVPLIFALVDHGDISFYSFRDFTLPQDVGH

SEQ ID NO: 93276 - protein, 72 aa, Homo sapiens
  Payload ID: 18623
  Gene Name: TSEN54 tRNA splicing endonuclease subunit
  ENSP ID: ENSP00000406559
MGFSEQGRQRLHPEEALYLLECGSIHLFHQDLPLSIQEAYQLLLTDHTVTFLQYQVFSHLKRLGYVVRRFQP

SEQ ID NO: 93277 - protein, 259 aa, Homo sapiens
  Payload ID: 18623
  Gene Name: TSEN54 tRNA splicing endonuclease subunit
  ENSP ID: ENSP00000438169
  MOD_RES (1)..(1): Any amino acid
XNMASDSRHTLLRAPAPELLPANVAGRETDAESWCQKLNQRKEKLSRREREHHAEAAQFQEDVNADPEVQRCSSWREYKELLQRRQVQRSQRRAPHLWGQPVTPLLSPGQASSPGTPSACHIFEGHWQLRNHRTLERAWMNWDGLRLKEDVGGGSGPTSTVSSPAAAAGPVWEGLEMPWSFSISLCCRQHTFLMEVPGCWRSLGAWKSSLMFTRPTLWPHSERITLANPMPGCALVDLMSLSQTSAASSGCLTRVGMSL

SEQ ID NO: 93278 - protein, 142 aa, Homo sapiens
  Payload ID: 18623
  Gene Name: TSEN54 tRNA splicing endonuclease subunit
  ENSP ID: ENSP00000461928
RSHGPKDFLPDGSAAQAERLRRCREELWQLLAEQRVERLGSLVAAEWRPEEGFVELKSPAGKFWQTMGFSEQGRQRLHPEEALYLLECGSIHLFHQDLPLSIQEAYQLLLTDHTVTFLQYQVFSHLKRLGYVVRRFQPRSPG

SEQ ID NO: 93279 - protein, 178 aa, Homo sapiens
  Payload ID: 18623
  Gene Name: TSEN54 tRNA splicing endonuclease subunit
  ENSP ID: ENSP00000463619
MEPEPEPAAVEVPAGRVLRGSLVAAEWRPEEGFVELKSPAGKFWQTMGFSEQGRQRLHPEEALYLLECGSIHLFHQDLPLSIQEAYQLLLTDHTVTFLQYQVFSHLKRLGYVVRRFQPSSVLSPYERQLNLDASVQHLEDGDGKRKRSSSSPRQPPHPSARPSPRAAPGQRGWAGDRR

SEQ ID NO: 93280 - protein, 167 aa, Homo sapiens
  Payload ID: 18623
  Gene Name: TSEN54 tRNA splicing endonuclease subunit
  ENSP ID: ENSP00000464335
  MOD_RES (1)..(1): Any amino acid
XDFLPDGSAAQAERLRRCREELWQLLAEQRVERLLVAAEWRPEEGFVELKSPAVSGGLGDRGPPSLPSLPSLPCDTCSGPHTGQILADHGLLRAGPAAPSPGRGLVSSGVWLHPPLPPRPATVYPGSLPAAADRPHCDLPAVPGLQPPEEVGLCGSTIPTKLCPVPV

SEQ ID NO: 93281 - protein, 514 aa, Homo sapiens
  Payload ID: 18624
  Gene Name: t-SNARE domain containing 1
  ENSP ID: ENSP00000303437
MSYGSIARGGGLGSRGPFGGPSRQGCQPLECARCWTEYGIRHFPCPSPESKLQNRCVGKDGEGDLGPAGTPIVPRARKRGPGVAPEGSRMPEPTSSPTIGPRKDSAAGPHGRMAGPSTTRAKKRKPNFCPQETEVLVSKVSKHHQLLFGTGLLKAEPTRRYRVWSRILQAVNALGYCRRDVVDLKHKWRDLRAVVRRKLGDLRKAAHGPSPGSGKPQALALTPVEQVVAKTFSCQALPSEGFSLEPPRATQVDPCNLQELFQEMSANVFRINSSVTSLERSLQSLGTPSDTQELRDSLHTAQQETNKTIAASASSVKQMAELLRSSCPQERLQQERPQLDRLKTQLSDAIQCYGVVQKKIAEKSRALLPMAQRGSKQQSPQAPFAELADDEKVFNGSDNMWQGQEQALLPDITEEDLEAIRLREEAILQMESNLLDVNQIIKDLASMVSEQGEAVDSIEASLEAASSHAEAARQLLAGASRHQLQRHKIKCCFLSAGVTALLVIIIIIATSVRK

SEQ ID NO: 93282 - protein, 514 aa, Homo sapiens; identical to SEQ ID NO: 93281
  Payload ID: 18624
  Gene Name: t-SNARE domain containing 1
  ENSP ID: ENSP00000427770

SEQ ID NO: 93283 - protein, 513 aa, Homo sapiens
  Payload ID: 18624
  Gene Name: t-SNARE domain containing 1
  Uniprot ID: Q96NA8
  ENSP ID: ENSP00000428763
MSYGSIARGGGLGSRGPFGGPSRQGCQPLECARCWTEYGIRHFPCPSPESKLQNRCVGKDGEGDLGPAGTPIVPRARKRGPGVAPEGSRMPEPTSSPTIGPRKDSAAGPHGRMAGPSTTRAKKRKPNFCPQETEVLVSKVSKHHQLLFGTGLLKAEPTRRYRVWSRILQAVNALGYCRRDVVDLKHKWRDLRAVVRRKLGDLRKAAHGPSPGSGKPQALALTPVEQVVAKTFSCQALPSEGFSLEPPRATQVDPCNLQELFQEMSANVFRINSSVTSLERSLQSLGTPSDTQELRDSLHTAQQETNKTIAASASSVKQMAELLRSSCPQERLQQERPQLDRLKTQLSDAIQCYGVVQKKIAEKSRALLPMAQRGSKQSPQAPFAELADDEKVFNGSDNMWQGQEQALLPDITEEDLEAIRLREEAILQMESNLLDVNQIIKDLASMVSEQGEAVDSIEASLEAASSHAEAARQLLAGASRHQLQRHKIKCCFLSAGVTALLVIIIIIATSVRK

SEQ ID NO: 93284 - protein, 150 aa, Homo sapiens
  Payload ID: 18624
  Gene Name: t-SNARE domain containing 1
  ENSP ID: ENSP00000429626
MSYGSIARGGGLGSRGPFGGPSRQGCQPLECARCWTEYGIRHFPCPSPESKLQNRCVGKDGEGDLGPAGTPIVPRARKRGPGVAPEGSRMPEPTSSPTIGPRKDSAAGPHGRMAGPSTTRAKKRKPNFCPQETEVLVSKVSKHHQLLFGT

SEQ ID NO: 93285 - protein, 277 aa, Homo sapiens
  Payload ID: 18624
  Gene Name: t-SNARE domain containing 1
  ENSP ID: ENSP00000429679
MSYGSIARGGGLGSRGPFGGPSRQGCQPLATQVDPCNLQELFQEMSANVFRINSSVTSLERSLQSLGTPSDTQELRDSLHTAQQETNKTIAASASSVKQMAELLRSSCPERLQQERPQLDRLKTQLSDAIQCYGVVQKKIAEKSRALLPMAQRGSKQQSPQAPFAELADDEKVFNGSDNMWQGQEQALLPDITEEDLEAIRLREEAILQMESNLLDVNQIIKDLASMVSEQGEAVDSIEASLEAASSHAEAARQLLAGASRHQLMRRTRPPAACGCP

SEQ ID NO: 93286 - protein, 135 aa, Homo sapiens
  Payload ID: 18624
  Gene Name: t-SNARE domain containing 1
  ENSP ID: ENSP00000430789
MNMLSVEAAGPAICKKMSYGSIARGGGLGSRGPFGGPSRQGCQPLECARCWTEYGIRHFPCPSPESKLQNRCVGKDGEGDLGPAGTPIVPRARKRGPGVAPEGSRMPEPTSSPTIGPRKDSAAGPHGRMAGPSTT

SEQ ID NO: 93287 - protein, 138 aa, Homo sapiens
  Payload ID: 18625
  Gene Name: TSNAX-DISC1 readthrough (NMD candidate)
  ENSP ID: ENSP00000473307
MSNKEGSGGFRKRKHDNFPHNQRREGKDVNSSSPVMLAFKSFQQELDARHDKYERLVKLSRDITVESKRTIFLLHRITSAPDMEDILTESEIKLDGVRQKIFQVAQELSGEDMHQFHRAITTEVYRQDPTHRGSWDQG

SEQ ID NO: 93288 - protein, 186 aa, Homo sapiens
  Payload ID: 18625
  Gene Name: TSNAX-DISC1 readthrough (NMD candidate)
  ENSP ID: ENSP00000473367
MSNKEGSGGFRKRKHDNFPHNQRREGKDVNSSSPVMLAFKSFQQELDARHDKYERLVKLSRDITVESKRTIFLLHRITSAPDMEDILTESEIKLDGVRQKIFQVAQELSGEDMHQFHRAITTGLQEYVEAVSFQHFIKTRSLISMDEINKQLIFTTEDNGKENKTKFTGKILLTEALGIKADRSSI

SEQ ID NO: 93289 - protein, 186 aa, Homo sapiens; identical to SEQ ID NO: 93288
  Payload ID: 18625
  Gene Name: TSNAX-DISC1 readthrough (NMD candidate)
  ENSP ID: ENSP00000473456

SEQ ID NO: 93290 - protein, 40 aa, Homo sapiens
  Payload ID: 18625
  Gene Name: TSNAX-DISC1 readthrough (NMD candidate)
  ENSP ID: ENSP00000473476
MSNKEGSGGFRKRKHDNFPHNQRREGKDVNSSSPVMLAFK

SEQ ID NO: 93291 - protein, 188 aa, Homo sapiens
  Payload ID: 18625
  Gene Name: TSNAX-DISC1 readthrough (NMD candidate)
  ENSP ID: ENSP00000473532
MSNKEGSGGFRKRKHDNFPHNQRREGKDVNSSSPVMLAFKSFQQELDARHDKYERLVKLSRDITVESKRTIFLLHRITSAPDMEDILTESEIKLDGVRQKIFQVAQELSGEDMHQFHRAITTGLQEYVEAVSFQHFIKTRSLISMDEINKQLIFTTEDNGKENKTAAGIAYHLQRAFGGGGWHGGRAT

SEQ ID NO: 93292 - protein, 437 aa, Homo sapiens
  Payload ID: 18626
  Gene Name: TSPY-like 1
  Uniprot ID: Q9H0U9
  ENSP ID: ENSP00000357597
MSGLDGVKRTTPLQTHSIIISDQVPSDQDAHQYLRLRDQSEATQVMAEPGEGGSETVALPPPPPSEEGGVPQDAAGRGGTPQIRVVGGRGHVAIKAGQEEGQPPAEGLAAASVVMAADRSLKKGVQGGEKALEICGAQRSASELTAGAEAEAEEVKTGKCATVSAAVAERESAEVVKEGLAEKEVMEEQMEVEEQPPEGEEIEVAEEDRLEEEAREEEGPWPLHEALRMDPLEAIQLELDTVNAQADRAFQQLEHKFGRMRRHYLERRNYIIQNIPGFWMTAFRNHPQLSAMIRGQDAEMLRYITNLEVKELRHPRTGCKFKFFFRRNPYFRNKLIVKEYEVRSSGRVVSLSTPIIWRRGHEPQSFIRRNQDLICSFFTWFSDHSLPESDKIAEIIKEDLWPNPLQYYLLREGVRRARRRPLREPVEIPRPFGFQSG

SEQ ID NO: 93293 - protein, 693 aa, Homo sapiens
  Payload ID: 18627
  Gene Name: TSPY-like 2
  Uniprot ID: Q9H2G4
  ENSP ID: ENSP00000364591
MDRPDEGPPAKTRRLSSSESPQRDPPPPPPPPPLLRLPLPPPQQRPRLQEETEAAQVLADMRGVGLGPALPPPPPYVILEEGGIRAYFTLGAECPGWDSTIESGYGEAPPPTESLEALPTPEASGGSLEIDFQVVQSSSFGGEGALETCSAVGWAPQRLVDPKSKEEAIIIVEDEDEDERESMRSSRRRRRRRRRKQRKVKRESRERNAERMESILQALEDIQLDLEAVNIKAGKAFLRLKRKFIQMRRPFLERRDLIIQHIPGFWVKAFLNHPRISILINRRDEDIFRYLTNLQVQDLRHISMGYKMKLYFQTNPYFTNMVIVKEFQRNRSGRLVSHSTPIRWHRGQEPQARRHGNQDASHSFFSWFSNHSLPEADRIAEIIKNDLWVNPLRYYLRERGSRIKRKKQEMKKRKTRGRCEVVIMEDAPDYYAVEDIFSEISDIDETIHDIKISDFMETTDYFETTDNEITDINENICDSENPDHNEVPNNETTDNNESADDHETTDNNESADDNNENPEDNNKNTDDNEENPNNNENTYGNNFFKGGFWGSHGNNQDSSDSDNEADEASDDEDNDGNEGDNEGSDDDGNEGDNEGSDDDDRDIEYYEKVIEDFDKDQADYEDVIEIISDESVEEEGIEEGIQQDEDIYEEGNYEEEGSEDVWEEGEDSDDSDLEDVLQVPNGWANPGKRGKTG

SEQ ID NO: 93294 - protein, 250 aa, Homo sapiens
  Payload ID: 18627
  Gene Name: TSPY-like 2
  ENSP ID: ENSP00000462287
MDRPDEGPPAKTRRLSSSESPQRDPPPPPPPPPLLRLPLPPPQQRPRLQEETEAAQIIKNDLWVNPLRYYLRERGSRIKRKKQEMKKRKTRGRCEVVIMEDAPDYYAVEDIFSEISDIDETIHDIKISDFMETTDYFETTDNEITDINENICDSENPDHNEVPNNETTDNNESADDHETTDNNESADDNNENPEDNNKNTDDNEENPNNNENTYGNNFFKGGFWGSHGNNQDSSDSDNEADEASDDEDND

SEQ ID NO: 93295 - protein, 123 aa, Homo sapiens
  Payload ID: 18627
  Gene Name: TSPY-like 2
  ENSP ID: ENSP00000462635
  MOD_RES (1)..(1): Any amino acid
XEEAIIIVEDEDEDERESMRSSRRRRRRRRRKQRKVKRESRERNAERMESILQALEDIQLDLEAVNIKAGKAFLRLKRKFIQMRRPFLERRDLIIQHIPGFWVKALHSSVPQPPQNFNFDQPT

SEQ ID NO: 93296 - protein, 414 aa, Homo sapiens
  Payload ID: 18628
  Gene Name: TSPY-like 4
  Uniprot ID: Q9UJ04
  ENSP ID: ENSP00000410943
MSGLDGGNKLPLAQTGGLAAPDHASGDPDRDQCQGLREETEATQVMANTGGGSLETVAEGGASQDPVDCGPALRVPVAGSRGGAATKAGQEDAPPSTKGLEAASAAEAADSSQKNGCQLGEPRGPAGQKALEACGAGGLGSQMIPGKKAKEVTTKKRAISAAVEKEGEAGAAMEEKKVVQKEKKVAGGVKEETRPRAPKINNCMDSLEAIDQELSNVNAQADRAFLQLERKFGRMRRLHMQRRSFIIQNIPGFWVTAFRNHPQLSPMISGQDEDMLRYMINLEVEELKHPRAGCKFKFIFQGNPYFRNEGLVKEYERRSSGRVVSLSTPIRWHRGQDPQAHIHRNREGNTIPSFFNWFSDHSLLEFDRIAEIIKGELWPNPLQYYLMGEGPRRGIRGPPRQPVESARSFRFQSG

SEQ ID NO: 93297 - protein, 417 aa, Homo sapiens
  Payload ID: 18629
  Gene Name: TSPY-like 5
  Uniprot ID: Q86VY4
  ENSP ID: ENSP00000322802
MSGRSRGRKSSRAKNRGKGRAKARVRPAPDDAPRDPDPSQYQSLGEDTQAAQVQAGAGWGGLEAAASAQLLRLGEEAACRLPLDCGLALRARAAGDHGQAAARPGPGKAASLSERLAADTVFVGTAGTVGRPKNAPRVGNRRGPAGKKAPETCSTAGRGPQVIAGGRQKKGAAGENTSVSAGEEKKEERDAGSGPPATEGSMDTLENVQLKLENMNAQADRAYLRLSRKFGQLRLQHLERRNHLIQNIPGFWGQAFQNHPQLASFLNSQEKEVLSYLNSLEVEELGLARLGYKIKFYFDRNPYFQNKVLIKEYGCGPSGQVVSRSTPIQWLPGHDLQSLSQGNPENNRSFFGWFSNHSSIESDKIVEIINEELWPNPLQFYLLSEGARVEKGKEKEGRQGPGKQPMETTQPGVSQSN

SEQ ID NO: 93298 - protein, 410 aa, Homo sapiens
  Payload ID: 18630
  Gene Name: TSPY-like 6
  Uniprot ID: Q8N831
  ENSP ID: ENSP00000417919
MSLPESPHSPATLDYALEDPHQGQRSREKSKATEVMADMFDGRLEPIVFPPPRLPEEGVAPQDPADGGHTFHILVDAGRSHGAIKAGQEVTPPPAEGLEAASASLTTDGSLKNGFPGEETHGLGGEKALETCGAGRSESEVIAEGKAEDVKPEECAMFSAPVDEKPGGEEMDVAEENRAIDEVNREAGPGPGPGPLNVGLHLNPLESIQLELDSVNAEADRALLQVERRFGQIHEYYLEQRNDIIRNIPGFWVTAFRHHPQLSAMIRGQDAEMLSYLTNLEVKELRHPRTGCKFKFFFQRNPYFRNKLIVKVYEVRSFGQVVSFSTLIMWRRGHGPQSFIHRNRHVICSFFTWFSDHSLPESDRIAQIIKEDLWSNPLQYYLLGEDAHRARRRLVREPVEIPRPFGFQCG

SEQ ID NO: 93299 - protein, 804 aa, Homo sapiens
  Payload ID: 18631
  Gene Name: TSR1, 20S rRNA accumulation, homolog (S. cerevisiae)
  Uniprot ID: Q2NL82
  ENSP ID: ENSP00000301364
MAAHRPGPLKQQNKAHKGGRHRGRGSAQRDGKGRLALKTLSKKVRKELSRVDQRHRASQLRKQKKEAVLAEKRQLGGKDGPPHQVLVVPLHSRISLPEAMQLLQDRDTGTVHLNELGNTQNFMLLCPRLKHRWFFTSARPGDLHVVLDMAKVADTILFLLDPLEGWDSTGDYCLSCLFAQGLPTYTLAVQGISGLPLKKQIDTRKKLSKAVEKRFPHDKLLLLDTQQEAGMLLRQLANQKQQHLAFRDRRAYLFAHAVDFVPSEENNLVGTLKISGYVRGQTLNVNRLLHIVGYGDFQMKQIDAPGDPFPLNPRGIKPQKDPDMAMEICATDAVDDMEEGLKVLMKADPGRQESLQAEVIPDPMEGEQTWPTEEELSEAKDFLKESSKVVKKVPKGTSSYQAEWILDGGSQSGGEGDEYEYDDMEHEDFMEEESQDESSEEEEEYETMTIGESVHDDLYDKKVDEEAEAKMLEKYKQERLEEMFPDEVDTPRDVAARIRFQKYRGLKSFRTSPWDPKENLPQDYARIFQFQNFTNTRKSIFKEVEEKEVEGAEVGWYVTLHVSEVPVSVVECFRQGTPLIAFSLLPHEQKMSVLNMVVRRDPGNTEPVKAKEELIFHCGFRRFRASPLFSQHTAADKHKLQRFLTADMALVATVYAPITFPPASVLLFKQKSNGMHSLIATGHLMSVDPDRMVIKRVVLSGHPFKIFTKMAVVRYMFFNREDVLWFKPVELRTKWGRRGHIKEPLGTHGHMKCSFDGKLKSQDTVLMNLYKRVFPKWTYDPYVPEPVPWLKSEISSTVPQGGME

SEQ ID NO: 93300 - protein, 368 aa, Homo sapiens
  Payload ID: 18631
  Gene Name: TSR1, 20S rRNA accumulation, homolog (S. cerevisiae)
  ENSP ID: ENSP00000459012
MAAHRPGPLKQQNKAHKGGRHRGRGSAQRDGKGRLALKTLSKKVRKELSRVDQRHRASQLRKQKKEAVLAEKRQLGGKDGPPHQVLVVPLHSRISLPEAMQLLQDRDTGTVHLNELGNTQNFMLLCPRLKHRWFFTSARPGDLHVVLDMAKVADTILFLLDPLEGWDSTALAVQGISGLPLKKQIDTRKKLSKAVEKRFPHDKLLLLDTQQEAGMLLRQLANQKQQHLAFRDRRAYLFAHAVDFVPSEENNLVGTLKISGYVRGQTLNVNRLLHIVGYGDFQMKQIDAPGDPFPLNPRGIKPQKDPDMAMEICATDAVDDMEEGLKVLMKADPGRQESLQAEVIPDPMEGEQTWPTEEELSEAKGQYW

SEQ ID NO: 93301 - protein, 53 aa, Homo sapiens
  Payload ID: 18631
  Gene Name: TSR1, 20S rRNA accumulation, homolog (S. cerevisiae)
  ENSP ID: ENSP00000461192
  MOD_RES (1)..(1): Any amino acid
XEVEGAEVGWYVTLHVSEVPVSVVECFRQGTPLIAFSLLPHEQKRTNINCRDS

SEQ ID NO: 93302 - protein, 70 aa, Homo sapiens
  Payload ID: 18631
  Gene Name: TSR1, 20S rRNA accumulation, homolog (S. cerevisiae)
  ENSP ID: ENSP00000461498
MAAHRPGPLKQQNKAHKGGRHRGRGSAQRDGKGSGREETAGWQGWPSSSGTGGAPAQQNFPARGHAAASR

SEQ ID NO: 93303 - protein, 191 aa, Homo sapiens
  Payload ID: 18632
  Gene Name: TSR2, 20S rRNA accumulation, homolog (S. cerevisiae)
  Uniprot ID: Q969E8
  ENSP ID: ENSP00000364293
MAGAAEDARALFRAGVCAALEAWPALQIAVENGFGGVHSQEKAKWLGGAVEDYFMRNADLELDEVEDFLGELLTNEFDTVVEDGSLPQVSQQLQTMFHHFQRGDGAALREMASCITQRKCKVTATALKTARETDEDEDDVDSVEEMEVTATNDGAATDGVCPQPEPSDPDAQTIKEEDIVEDGWTIVRRKK

SEQ ID NO: 93304 - protein, 312 aa, Homo sapiens
  Payload ID: 18633
  Gene Name: TSR3, 20S rRNA accumulation, homolog (S. cerevisiae)
  Uniprot ID: Q9UJK0
  ENSP ID: ENSP00000007390
MGRRRAARGPGAEGGRPRHLPTRSLEAFAEEVGAALQASVEPGAADGEGGPGPAALPCTLAMWELGHCDPRRCTGRKLARLGLVRCLRLGHRFGGLVLSPVGKQYASPADRQLVAQSGVAVIDCSWARLDETPFGKMRGSHLRLLPYLVAANPVNYGRPYRLSCVEAFAATFCIVGFPDLAVILLRKFKWGKGFLDLNRQLLDKYAACGSPEEVLQAEQEFLANAKESPQEEEIDPFDVDSGREFGNPNRPVASTRLPSDTDDSDASEDPGPGAERGGASSSCCEEEQTQGRGAEARAPAEVWKGIKKRQRD

SEQ ID NO: 93305 - protein, 109 aa, Homo sapiens
  Payload ID: 18633
  Gene Name: TSR3, 20S rRNA accumulation, homolog (S. cerevisiae)
  ENSP ID: ENSP00000455722
  MOD_RES (1)..(1): Any amino acid
XPGAGALPAPGPQIRRSGAEPRGQAVRVPRRQTAGGAVWGRRHRLLLGQAGRDTVWEDAREPLAPVALPGGRQPRELWPALQTFLRGSVCCHLLHRRLSRPCCHFAAEV

SEQ ID NO: 93306 - protein, 125 aa, Homo sapiens
  Payload ID: 18634
  Gene Name: TSSK6 activating co-chaperone
  Uniprot ID: Q96A04
  ENSP ID: ENSP00000357234
MERHTSHPNRKVPAKEEANAVPLCRAKPSPSYINLQASSPPATFLNIQTTKLPSVDHKPKECLGLLECMYANLQLQTQLAQQQMAVLEHLQASVTQLAPGRGSNNSSLPALSPNPLLNHLPQFSK

SEQ ID NO: 93307 - protein, 125 aa, Homo sapiens; identical to SEQ ID NO: 93306
  Payload ID: 18634
  Gene Name: TSSK6 activating co-chaperone
  Uniprot ID: Q96A04
  ENSP ID: ENSP00000357235

SEQ ID NO: 93308 - protein, 125 aa, Homo sapiens; identical to SEQ ID NO: 93306
  Payload ID: 18634
  Gene Name: TSSK6 activating co-chaperone
  Uniprot ID: Q96A04
  ENSP ID: ENSP00000357236

SEQ ID NO: 93309 - protein, 125 aa, Homo sapiens; identical to SEQ ID NO: 93306
  Payload ID: 18634
  Gene Name: TSSK6 activating co-chaperone
  Uniprot ID: Q96A04
  ENSP ID: ENSP00000357237

SEQ ID NO: 93310 - protein, 125 aa, Homo sapiens; identical to SEQ ID NO: 93306
  Payload ID: 18634
  Gene Name: TSSK6 activating co-chaperone
  Uniprot ID: Q96A04
  ENSP ID: ENSP00000357238

SEQ ID NO: 93311 - protein, 100 aa, Homo sapiens
  Payload ID: 18634
  Gene Name: TSSK6 activating co-chaperone
  ENSP ID: ENSP00000476780
MERHTSHPNRKVPAKEEANAVPLCRAKPSPSYINLQASSPPATFLNIQTTKLPSAQGMPRTPGMYVCKPPASDPARPTTDGCFGTFTGICDTTGSWEGKQ

SEQ ID NO: 93312 - protein, 100 aa, Homo sapiens; identical to SEQ ID NO: 93311
  Payload ID: 18634
  Gene Name: TSSK6 activating co-chaperone
  ENSP ID: ENSP00000477010

SEQ ID NO: 93313 - protein, 100 aa, Homo sapiens; identical to SEQ ID NO: 93311
  Payload ID: 18634
  Gene Name: TSSK6 activating co-chaperone
  ENSP ID: ENSP00000477074

SEQ ID NO: 93314 - protein, 353 aa, Homo sapiens
  Payload ID: 18635
  Gene Name: tsukushi, small leucine rich proteoglycan
  Uniprot ID: Q8WUA8
  ENSP ID: ENSP00000332668
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSISPTAFSRLRYLESLDLSHNGLTALPAESFTSSPLSDVNLSHNQLREVSVSAFTTHSQGRALHVDLSHNLIHRLVPHPTRAGLPAPTIQSLNLAWNRLHAVPNLRDLPLRYLSLDGNPLAVIGPGAFAGLGGLTHLSLASLQRLPELAPSGFRELPGLQVLDLSGNPKLNWAGAEVFSGLSSLQELDLSGTNLVPLPEALLLHLPALQSVSVGQDVRCRRLVREGTYPRRPGSSPKVALHCVDTRDSAARGPTIL

SEQ ID NO: 93315 - protein, 353 aa, Homo sapiens; identical to SEQ ID NO: 93314
  Payload ID: 18635
  Gene Name: tsukushi, small leucine rich proteoglycan
  Uniprot ID: Q8WUA8
  ENSP ID: ENSP00000434847

SEQ ID NO: 93316 - protein, 105 aa, Homo sapiens
  Payload ID: 18635
  Gene Name: tsukushi, small leucine rich proteoglycan
  ENSP ID: ENSP00000434873
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSISPTAFS

SEQ ID NO: 93317 - protein, 150 aa, Homo sapiens
  Payload ID: 18635
  Gene Name: tsukushi, small leucine rich proteoglycan
  ENSP ID: ENSP00000435133
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSISPTAFSRLRYLESLDLSHNGLTALPAESFTSSPLSDVNLSHNQLREVSVSA

SEQ ID NO: 93318 - protein, 353 aa, Homo sapiens; identical to SEQ ID NO: 93314
  Payload ID: 18635
  Gene Name: tsukushi, small leucine rich proteoglycan
  Uniprot ID: Q8WUA8
  ENSP ID: ENSP00000482145

SEQ ID NO: 93319 - protein, 856 aa, Homo sapiens
  Payload ID: 18636
  Gene Name: TTK protein kinase
  Uniprot ID: P33981
  ENSP ID: ENSP00000230510
MESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANCKKFAFVHISFAQFELSQGNVKKSKQLLQKAVERGAVPLEMLEIALRNLNLQKKQLLSEEEKKNLSASTVLTAQESFSGSLGHLQNRNNSCDSRGQTTKARFLYGENMPPQDAEIGYRNSLRQTNKTKQSCPFGRVPVNLLNSPDCDVKTDDSVVPCFMKRQTSRSECRDLVVPGSKPSGNDSCELRNLKSVQNSHFKEPLVSDEKSSELIITDSITLKNKTESSLLAKLEETKEYQEPEVPESNQKQWQSKRKSECINQNPAASSNHWQIPELARKVNTEKHTTFEQPVFSVSKQSPPISTSKWFDPKSICKTPSSNTLDDYMSCFRTPVVKNDFPPACQLSTPYGQPACFQQQQHQILATPLQNLQVLASSSANECISVKGRIYSILKQIGSGGSSKVFQVLNEKKQIYAIKYVNLEEADNQTLDSYRNEIAYLNKLQQHSDKIIRLYDYEITDQYIYMVMECGNIDLNSWLKKKKSIDPWERKSYWKNMLEAVHTIHQHGIVHSDLKPANFLIVDGMLKLIDFGIANQMQPDTTSVVKDSQVGTVNYMPPEAIKDMSSSRENGKSKSKISPKSDVWSLGCILYYMTYGKTPFQQIINQISKLHAIIDPNHEIEFPDIPEKDLQDVLKCCLKRDPKQRISIPELLAHPYVQIQTHPVNQMAKGTTEEMKYVLGQLVGLNSPNSILKAAKTLYEHYSGGESHNSSSSKTFEKKRGKK

SEQ ID NO: 93320 - protein, 857 aa, Homo sapiens
  Payload ID: 18636
  Gene Name: TTK protein kinase
  Uniprot ID: P33981
  ENSP ID: ENSP00000358813
MESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANCKKFAFVHISFAQFELSQGNVKKSKQLLQKAVERGAVPLEMLEIALRNLNLQKKQLLSEEEKKNLSASTVLTAQESFSGSLGHLQNRNNSCDSRGQTTKARFLYGENMPPQDAEIGYRNSLRQTNKTKQSCPFGRVPVNLLNSPDCDVKTDDSVVPCFMKRQTSRSECRDLVVPGSKPSGNDSCELRNLKSVQNSHFKEPLVSDEKSSELIITDSITLKNKTESSLLAKLEETKEYQEPEVPESNQKQWQSKRKSECINQNPAASSNHWQIPELARKVNTEQKHTTFEQPVFSVSKQSPPISTSKWFDPKSICKTPSSNTLDDYMSCFRTPVVKNDFPPACQLSTPYGQPACFQQQQHQILATPLQNLQVLASSSANECISVKGRIYSILKQIGSGGSSKVFQVLNEKKQIYAIKYVNLEEADNQTLDSYRNEIAYLNKLQQHSDKIIRLYDYEITDQYIYMVMECGNIDLNSWLKKKKSIDPWERKSYWKNMLEAVHTIHQHGIVHSDLKPANFLIVDGMLKLIDFGIANQMQPDTTSVVKDSQVGTVNYMPPEAIKDMSSSRENGKSKSKISPKSDVWSLGCILYYMTYGKTPFQQIINQISKLHAIIDPNHEIEFPDIPEKDLQDVLKCCLKRDPKQRISIPELLAHPYVQIQTHPVNQMAKGTTEEMKYVLGQLVGLNSPNSILKAAKTLYEHYSGGESHNSSSSKTFEKKRGKK

SEQ ID NO: 93321 - protein, 79 aa, Homo sapiens
  Payload ID: 18636
  Gene Name: TTK protein kinase
  ENSP ID: ENSP00000421406
MESEDLSGRELTIDSIMNKVRDIKNKFKNEDLTDELSLNKISADTTECRLHDGRVFVCYIHRTLNGVWHMITRELLTKL

SEQ ID NO: 93322 - protein, 150 aa, Homo sapiens
  Payload ID: 18636
  Gene Name: TTK protein kinase
  ENSP ID: ENSP00000421636
MESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANCKKFAFVHISFA

SEQ ID NO: 93323 - protein, 856 aa, Homo sapiens; identical to SEQ ID NO: 93319
  Payload ID: 18636
  Gene Name: TTK protein kinase
  Uniprot ID: P33981
  ENSP ID: ENSP00000422936

SEQ ID NO: 93324 - protein, 139 aa, Homo sapiens
  Payload ID: 18636
  Gene Name: TTK protein kinase
  ENSP ID: ENSP00000424851
MESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANC

SEQ ID NO: 93325 - protein, 175 aa, Homo sapiens
  Payload ID: 18636
  Gene Name: TTK protein kinase
  ENSP ID: ENSP00000427483
MESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANCKKFAFVHISFAQFELSQGNVKKSKQLLQKAVERGAV

SEQ ID NO: 93326 - protein, 79 aa, Homo sapiens; identical to SEQ ID NO: 93321
  Payload ID: 18636
  Gene Name: TTK protein kinase
  ENSP ID: ENSP00000487202

SEQ ID NO: 93327 - protein, 455 aa, Homo sapiens
  Payload ID: 18637
  Gene Name: Tu translation elongation factor, mitochondrial
  Uniprot ID: P49411
  ENSP ID: ENSP00000322439
MTTMAAATLLRATPHFSGLAAGRTFLLQGLLRLLKAPALPLLCRGLAVEAKKTYVRDKPHVNVGTIGHVDHGKTTLTAAITKILAEGGGAKFKKYEEIDNAPEERARGITINAAHVEYSTAARHYAHTDCPGHADYVKNMITGTAPLDGCILVVAANDGPMPQTREHLLLARQIGVEHVVVYVNKADAVQDSEMVELVELEIRELLTEFGYKGEETPVIVGSALCALEGRDPELGLKSVQKLLDAVDTYIPVPARDLEKPFLLPVEAVYSVPGRGTVVTGTLERGILKKGDECELLGHSKNIRTVVTGIEMFHKSLERAEAGDNLGALVRGLKREDLRRGLVMVKPGSIKPHQKVEAQVYILSKEEGGRHKPFVSHFMPVMFSLTWDMACRIILPPEKELAMPGEDLKFNLILRQPMILEKGQRFTLRDGNRTIGTGLVTNTLAMTEEEKNIKWG

SEQ ID NO: 93328 - protein, 101 aa, Homo sapiens
  Payload ID: 18637
  Gene Name: Tu translation elongation factor, mitochondrial
  ENSP ID: ENSP00000455007
MTTMAAATLLRATPHFSGLAAGRTFLLQGLLRLLKAPALPLLCRGLAVEAKKTYVRDKPHVNVGTIGHVDHGKTTLTAAITKKYDHRHCTPRRLHPGGSSQ

SEQ ID NO: 93329 - protein, 506 aa, Homo sapiens
  Payload ID: 18638
  Gene Name: tubby bipartite transcription factor
  Uniprot ID: P50607
  ENSP ID: ENSP00000299506
MTSKPHSDWIPYSVLDDEGRNLRQQKLDRQRALLEQKQKKKRQEPLMVQANADGRPRSRRARQSEEQAPLVESYLSSSGSTSYQVQEADSLASVQLGATRPTAPASAKRTKAAATAGGQGGAARKEKKGKHKGTSGPAALAEDKSEAQGPVQILTVGQSDHAQDAGETAAGGGERPSGQDLRATMQRKGISSSMSFDEDEEDEEENSSSSSQLNSNTRPSSATSRKSVREAASAPSPTAPEQPVDVEVQDLEEFALRPAPQGITIKCRITRDKKGMDRGMYPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVSIRPRNEHETLLARWQNKNTESIIELQNKTPVWNDDTQSYVLNFHGRVTQASVKNFQIIHGNDPDYIVMQFGRVAEDVFTMDYNYPLCALQAFAIALSSFDSKLACE

SEQ ID NO: 93330 - protein, 561 aa, Homo sapiens
  Payload ID: 18638
  Gene Name: tubby bipartite transcription factor
  Uniprot ID: P50607
  ENSP ID: ENSP00000305426
MGARTPLPSFWVSFFAETGILFPGGTPWPMGSQHSKQHRKPGPLKRGHRRDRRTTRRKYWKEGREIARVLDDEGRNLRQQKLDRQRALLEQKQKKKRQEPLMVQANADGRPRSRRARQSEEQAPLVESYLSSSGSTSYQVQEADSLASVQLGATRPTAPASAKRTKAAATAGGQGGAARKEKKGKHKGTSGPAALAEDKSEAQGPVQILTVGQSDHAQDAGETAAGGGERPSGQDLRATMQRKGISSSMSFDEDEEDEEENSSSSSQLNSNTRPSSATSRKSVREAASAPSPTAPEQPVDVEVQDLEEFALRPAPQGITIKCRITRDKKGMDRGMYPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVSIRPRNEHETLLARWQNKNTESIIELQNKTPVWNDDTQSYVLNFHGRVTQASVKNFQIIHGNDPDYIVMQFGRVAEDVFTMDYNYPLCALQAFAIALSSFDSKLACE

SEQ ID NO: 93331 - protein, 512 aa, Homo sapiens
  Payload ID: 18638
  Gene Name: tubby bipartite transcription factor
  ENSP ID: ENSP00000434400
MEGVSSHRTLSYSRWSYDSVLDDEGRNLRQQKLDRQRALLEQKQKKKRQEPLMVQANADGRPRSRRARQSEEQAPLVESYLSSSGSTSYQVQEADSLASVQLGATRPTAPASAKRTKAAATAGGQGGAARKEKKGKHKGTSGPAALAEDKSEAQGPVQILTVGQSDHAQDAGETAAGGGERPSGQDLRATMQRKGISSSMSFDEDEEDEEENSSSSSQLNSNTRPSSATSRKSVREAASAPSPTAPEQPVDVEVQDLEEFALRPAPQGITIKCRITRDKKGMDRGMYPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVSIRPRNEHETLLARWQNKNTESIIELQNKTPVWNDDTQSYVLNFHGRVTQASVKNFQIIHGNDPDYIVMQFGRVAEDVFTMDYNYPLCALQAFAIALSSFDSKLACE

SEQ ID NO: 93332 - protein, 542 aa, Homo sapiens
  Payload ID: 18639
  Gene Name: tubby like protein 1
  Uniprot ID: O00294
  ENSP ID: ENSP00000229771
MPLRDETLREVWASDSGHEEESLSPEAPRRPKQRPAPAQRLRKKRTEAPESPCPTGSKPRKPGAGRTGRPREEPSPDPAQARAPQTVYARFLRDPEAKKRDPRETFLVARAPDAEDEEEEEEEDEEDEEEEAEEKKEKILLPPKKPLREKSSADLKERRAKAQGPRGDLGSPDPPPKPLRVRNKEAPAGEGTKMRKTKKKGSGEADKDPSGSPASARKSPAAMFLVGEGSPDKKALKKKGTPKGARKEEEEEEEAATVIKKSNQKGKAKGKGKKKAKEERAPSPPVEVDEPREFVLRPAPQGRTVRCRLTRDKKGMDRGMYPSYFLHLDTEKKVFLLAGRKRKRSKTANYLISIDPTNLSRGGENFIGKLRSNLLGNRFTVFDNGQNPQRGYSTNVASLRQELAAVIYETNVLGFRGPRRMTVIIPGMSAENERVPIRPRNASDGLLVRWQNKTLESLIELHNKPPVWNDDSGSYTLNFQGRVTQASVKNFQIVHADDPDYIVLQFGRVAEDAFTLDYRYPLCALQAFAIALSSFDGKLACE

SEQ ID NO: 93333 - protein, 489 aa, Homo sapiens
  Payload ID: 18639
  Gene Name: tubby like protein 1
  Uniprot ID: O00294
  ENSP ID: ENSP00000319414
MPLRDETLREVWASDSGHEEESLSPEAPRRPKQRPAPAQRLRKKRTEAPESPCPTGSKPRKPGEEEEEEEDEEDEEEEAEEKKEKILLPPKKPLREKSSADLKERRAKAQGPRGDLGSPDPPPKPLRVRNKEAPAGEGTKMRKTKKKGSGEADKDPSGSPASARKSPAAMFLVGEGSPDKKALKKKGTPKGARKEEEEEEEAATVIKKSNQKGKAKGKGKKKAKEERAPSPPVEVDEPREFVLRPAPQGRTVRCRLTRDKKGMDRGMYPSYFLHLDTEKKVFLLAGRKRKRSKTANYLISIDPTNLSRGGENFIGKLRSNLLGNRFTVFDNGQNPQRGYSTNVASLRQELAAVIYETNVLGFRGPRRMTVIIPGMSAENERVPIRPRNASDGLLVRWQNKTLESLIELHNKPPVWNDDSGSYTLNFQGRVTQASVKNFQIVHADDPDYIVLQFGRVAEDAFTLDYRYPLCALQAFAIALSSFDGKLACE

SEQ ID NO: 93334 - protein, 161 aa, Homo sapiens
  Payload ID: 18639
  Gene Name: tubby like protein 1
  ENSP ID: ENSP00000406765
MPLRDETLREVWASDSGHEEESLSPEAPRRPKQRPAPAQRLRKKRTEAPESPCPTGSKPRKPGEFLPAEEEEEEEDEEDEEEEAEEKKEKILLPPKKPLREKSSADLKERRAKAQGPRGDLGSPDPPPKPLRVRNKEAPAGEGTKMRKTKKKGSGEADKDP

SEQ ID NO: 93335 - protein, 540 aa, Homo sapiens
  Payload ID: 18639
  Gene Name: tubby like protein 1
  ENSP ID: ENSP00000477534
MPLRDETLREVWASDSGHEEESLSPEAPRRPKQRPAPAQRLRKKRTEAPESPCPTGSKPRKPGAGRTGRPREEPSPDPAQARAPQTVYARFLRDPEAKKRDPRETFLVARAPDAEDEEEEEEEDEEDEEEEAEEKKEKILLPPKKPLREKSSADLKERRAKAQGPRGDLGSPDPPPKPLRVRNKEAPAGEGTKMRKTKKKGSGEADKDPSGSPASARKSPAAMFLVGEGSPDKKALKKKGTPKGARKEEEEEEEAATVIKKSNQKGKAKGKGKKKEERAPSPPVEVDEPREFVLRPAPQGRTVRCRLTRDKKGMDRGMYPSYFLHLDTEKKVFLLAGRKRKRSKTANYLISIDPTNLSRGGENFIGKLRSNLLGNRFTVFDNGQNPQRGYSTNVASLRQELAAVIYETNVLGFRGPRRMTVIIPGMSAENERVPIRPRNASDGLLVRWQNKTLESLIELHNKPPVWNDDSGSYTLNFQGRVTQASVKNFQIVHADDPDYIVLQFGRVAEDAFTLDYRYPLCALQAFAIALSSFDGKLACE

SEQ ID NO: 93336 - protein, 520 aa, Homo sapiens
  Payload ID: 18640
  Gene Name: tubby like protein 2
  Uniprot ID: O00295
  ENSP ID: ENSP00000221399
MSQDNDTLMRDILGHELAAMRLQKLEQQRRLFEKKQRQKRQELLMVQANPDASPWLWRSCLREERLLGDRGLGNPFLRKKVSEAHLPSGIHSALGTVSCGGDGRGERGLPTPRTEAVFRNLGLQSPFLSWLPDNSDAELEEVSVENGSVSPPPFKQSPRIRRKGWQAHQRPGTRAEGESDSQDMGDAHKSPNMGPNPGMDGDCVYENLAFQKEEDLEKKREASESTGTNSSAAHNEELSKALKGEGGTDSDHMRHEASLAIRSPCPGLEEDMEAYVLRPALPGTMMQCYLTRDKHGVDKGLFPLYYLYLETSDSLQRFLLAGRKRRRSKTSNYLISLDPTHLSRDGDNFVGKVRSNVFSTKFTIFDNGVNPDREHLTRNTARIRQELGAVCYEPNVLGYLGPRKMTVILPGTNSQNQRINVQPLNEQESLLSRYQRGDKQGLLLLHNKTPSWDKENGVYTLNFHGRVTRASVKNFQIVDPKHQEHLVLQFGRVGPDTFTMDFCFPFSPLQAFSICLSSFN

SEQ ID NO: 93337 - protein, 230 aa, Homo sapiens
  Payload ID: 18640
  Gene Name: tubby like protein 2
  ENSP ID: ENSP00000428420
MSQDNDTLMRDILGHELAAMRLQKLEQQRRLFEKKQRQKRQELLMVQANPDASPWLWRSCLREERLLGDRVFRNLGLQSPFLSWLPDNSDAELEEVSVENGSVSPPPFKQSPRIRRKGWQAHQRPGTRAEGESDSQDMGDAHKSPNMGPNPGMDGDCVYENLAFQKEEDLEKKREASESTGTNSSAAHNEELSKALKGEGGTDSDHMRHEASLAIRSPCPGLEEDMEAYV

SEQ ID NO: 93338 - protein, 187 aa, Homo sapiens
  Payload ID: 18640
  Gene Name: tubby like protein 2
  ENSP ID: ENSP00000428535
MRLQKLEQQRRLFEKKQRQKRQELLMVQANPDASPWLWRSCLREERLLGDRGLGNPFLRKKVSEAHLPSGIHSALGTVSCGGDGRGERGLPTPRTEAVFRNLGLQSPFLSWLPDNSDAELEEVSVENGSVSPPPFKQSPRIRRKGWQAHQRPGTRAEGESDSQDMGDAHKSPNMGPNPGMDGDCVYE

SEQ ID NO: 93339 - protein, 80 aa, Homo sapiens
  Payload ID: 18640
  Gene Name: tubby like protein 2
  ENSP ID: ENSP00000429131
WDKENGVYTLNFHGRVTRASVKNFQIVDPKHRELLETSLAGPEEHLVLQFGRVGPDTFTMDFCFPFSPLQAFSICLSSFN

SEQ ID NO: 93340 - protein, 210 aa, Homo sapiens
  Payload ID: 18640
  Gene Name: tubby like protein 2
  ENSP ID: ENSP00000430040
MSQDNDTLMRDILGHELAAMRLQKLEQQRRLFEKKQRQKRQELLMVQANPDASPWLWRSCLREERLLGLGNPFLRKKVSEAHLPSGIHSALGTVSCGGDGRGERGLPTPRTEAVFRNLGLQSPFLSWLPDNSDAELEEVSVENGSVSPPPFKQSPRIRRKGWQAHQRPGTRAEGESDSQDMGDAHKSPNMGPNPGMDGDCVYENLAFQKE

SEQ ID NO: 93341 - protein, 501 aa, Homo sapiens
  Payload ID: 18641
  Gene Name: tubby like protein 3
  Uniprot ID: O75386
  ENSP ID: ENSP00000380321
MEASRCRLSPSGDSVFHEEMMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTDTGTSGSATAAQPADNLLGDIDDLEDFVYSPAPQGVTVRCRIIRDKRGMDRGLFPTYYMYLEKEENQKIFLLAARKRKKSKTANYLISIDPVDLSREGESYVGKLRSNLMGTKFTVYDRGICPMKGRGLVGAAHTRQELAAISYETNVLGFKGPRKMSVIIPGMTLNHKQIPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDKCIQTLRMQELCELHRQHHSAASLVHRTVCQRWVGHPWRLLPQTSLLWTDLSPPPVVPAPHQISM

SEQ ID NO: 93342 - protein, 442 aa, Homo sapiens
  Payload ID: 18641
  Gene Name: tubby like protein 3
  Uniprot ID: O75386
  ENSP ID: ENSP00000410051
MEASRCRLSPSGDSVFHEEMMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTDTGTSGSATAAQPADNLLGDIDDLEDFVYSPAPQGVTVRCRIIRDKRGMDRGLFPTYYMYLEKEENQKIFLLAARKRKKSKTANYLISIDPVDLSREGESYVGKLRSNLMGTKFTVYDRGICPMKGRGLVGAAHTRQELAAISYETNVLGFKGPRKMSVIIPGMTLNHKQIPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDSKLACE

SEQ ID NO: 93343 - protein, 39 aa, Homo sapiens
  Payload ID: 18641
  Gene Name: tubby like protein 3
  ENSP ID: ENSP00000437899
MEASRCRLSPSGDSVFHEEMMKMRQAKLDYQVLMVQLLS

SEQ ID NO: 93344 - protein, 109 aa, Homo sapiens
  Payload ID: 18641
  Gene Name: tubby like protein 3
  ENSP ID: ENSP00000440364
  MOD_RES (1)..(1): Any amino acid
XPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDRVPLTAI

SEQ ID NO: 93345 - protein, 133 aa, Homo sapiens
  Payload ID: 18641
  Gene Name: tubby like protein 3
  ENSP ID: ENSP00000441319
  MOD_RES (1)..(1): Any amino acid
XIPGMTLNHKQIPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDTDWPAPILVKSGCDHICDQL

SEQ ID NO: 93346 - protein, 39 aa, Homo sapiens; identical to SEQ ID NO: 93343
  Payload ID: 18641
  Gene Name: tubby like protein 3
  ENSP ID: ENSP00000441599

SEQ ID NO: 93347 - protein, 137 aa, Homo sapiens
  Payload ID: 18641
  Gene Name: tubby like protein 3
  ENSP ID: ENSP00000442631
MGTKFTVYDRGICPMKGRGLVGAAHTRQELAAISYETNVLGFKGPRKMSVIIPGMTLNHKQIPYQPQNNHDSLLSRWQNRTMENLVELHNKAPVWNSDTQSYVLNFRGRVTQASVKNFQIVHKNDPDYIVMQFGRVA

SEQ ID NO: 93348 - protein, 170 aa, Homo sapiens
  Payload ID: 18641
  Gene Name: tubby like protein 3
  Uniprot ID: O75386
  ENSP ID: ENSP00000444110
MMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTFSSFCQKTEDTGYRHFRFCYCRPTS

SEQ ID NO: 93349 - protein, 440 aa, Homo sapiens
  Payload ID: 18641
  Gene Name: tubby like protein 3
  ENSP ID: ENSP00000482208
MEASRCRLSPSGDSVFHEEMMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTDTGLPVLLLPPNQLITSWETDDLEDFVYSPAPQGVTVRCRIIRDKRGMDRGLPHLLYVLGKEENQKIFLLAARKRKKSKTANYLISIDPVDLSREGESYVGKLRSNLMGTKFTVYDRGICPMKGRGLVGAAHTRQELAAISYETNVLGFKGPRKMSVIIPGMTLNHKQIPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDSKLACE

SEQ ID NO: 93350 - protein, 678 aa, Homo sapiens
  Payload ID: 18642
  Gene Name: tubby like protein 4
  Uniprot ID: Q9NRJ4
  ENSP ID: ENSP00000356061
MYAAVEHGPVLCSDSNILCLSWKGRVPKSEKEKPVCRRRYYEEGWLATGNGRGVVGVTFTSSHCRRDRSTPQRINFNLRGHNSEVVLVRWNEPYQKLATCDADGGIFVWIQYEGRWSVELVNDRGAQVSDFTWSHDGTQALISYRDGFVLVGSVSGQRHWSSEINLESQITCGIWTPDDQQVLFGTADGQVIVMDCHGRMLAHVLLHESDGVLGMSWNYPIFLVEDSSESDTDSDDYAPPQDGPAAYPIPVQNIKPLLTVSFTSGDISLMNNYDDLSPTVIRSGLKEVVAQWCTQGDLLAVAGMERQTQLGELPNGPLLKSAMVKFYNVRGEHIFTLDTLVQRPIISICWGHRDSRLLMASGPALYVVRVEHRVSSLQLLCQQAIASTLREDKDVSKLTLPPRLCSYLSTAFIPTIKPPIPDPNNMRDFVSYPSAGNERLHCTMKRTEDDPEVGGPCYTLYLEYLGGLVPILKGRRISKLRPEFVIMDPRTDSKPDEIYGNSLISTVIDSCNCSDSSDIELSDDWAAKKSPKISRASKSPKLPRISIEARKSPKLPRAAQELSRSPRLPLRKPSVGSPSLTRREFPFEDITQHNYLAQVTSNIWGTKFKIVGLAAFLPTNLGAVIYKTSLLHLQPRQMTIYLPEVRKISMDYINLPVFNPNVFSEDEDDLPGDAVWTD

SEQ ID NO: 93351 - protein, 1543 aa, Homo sapiens
  Payload ID: 18642
  Gene Name: tubby like protein 4
  Uniprot ID: Q9NRJ4
  ENSP ID: ENSP00000356064
MYAAVEHGPVLCSDSNILCLSWKGRVPKSEKEKPVCRRRYYEEGWLATGNGRGVVGVTFTSSHCRRDRSTPQRINFNLRGHNSEVVLVRWNEPYQKLATCDADGGIFVWIQYEGRWSVELVNDRGAQVSDFTWSHDGTQALISYRDGFVLVGSVSGQRHWSSEINLESQITCGIWTPDDQQVLFGTADGQVIVMDCHGRMLAHVLLHESDGVLGMSWNYPIFLVEDSSESDTDSDDYAPPQDGPAAYPIPVQNIKPLLTVSFTSGDISLMNNYDDLSPTVIRSGLKEVVAQWCTQGDLLAVAGMERQTQLGELPNGPLLKSAMVKFYNVRGEHIFTLDTLVQRPIISICWGHRDSRLLMASGPALYVVRVEHRVSSLQLLCQQAIASTLREDKDVSKLTLPPRLCSYLSTAFIPTIKPPIPDPNNMRDFVSYPSAGNERLHCTMKRTEDDPEVGGPCYTLYLEYLGGLVPILKGRRISKLRPEFVIMDPRTDSKPDEIYGNSLISTVIDSCNCSDSSDIELSDDWAAKKSPKISRASKSPKLPRISIEARKSPKLPRAAQELSRSPRLPLRKPSVGSPSLTRREFPFEDITQHNYLAQVTSNIWGTKFKIVGLAAFLPTNLGAVIYKTSLLHLQPRQMTIYLPEVRKISMDYINLPVFNPNVFSEDEDDLPVTGASGVPENSPPCTVNIPIAPIHSSAQAMSPTQSIGLVQSLLANQNVQLDVLTNQTTAVGTAEHAGDSATQYPVSNRYSNPGQVIFGSVEMGRIIQNPPPLSLPPPPQGPMQLSTVGHGDRDHEHLQKSAKALRPTPQLAAEGDAVVFSAPQEVQVTKINPPPPYPGTIPAAPTTAAPPPPLPPPQPPVDVCLKKGDFSLYPTSVHYQTPLGYERITTFDSSGNVEEVCRPRTRMLCSQNTYTLPGPGSSATLRLTATEKKVPQPCSSATLNRLTVPRYSIPTGDPPPYPEIASQLAQGRGAAQRSDNSLIHATLRRNNREATLKMAQLADSPRAPLQPLAKSKGGPGGVVTQLPARPPPALYTCSQCSGTGPSSQPGASLAHTASASPLASQSSYSLLSPPDSARDRTDYVNSAFTEDEALSQHCQLEKPLRHPPLPEAAVTLKRPPPYQWDPMLGEDVWVPQERTAQTSGPNPLKLSSLMLSQGQHLDVSRLPFISPKSPASPTATFQTGYGMGVPYPGSYNNPPLPGVQAPCSPKDALSPTQFAQQEPAVVLQPLYPPSLSYCTLPPMYPGSSTCSSLQLPPVALHPWSSYSACPPMQNPQGTLPPKPHLVVEKPLVSPPPADLQSHLGTEVMVETADNFQEVLSLTESPVPQRTEKFGKKNRKRLDSRAEEGSVQAITEGKVKKEARTLSDFNSLISSPHLGREKKKVKSQKDQLKSKKLNKTNEFQDSSESEPELFISGDELMNQSQGSRKGWKSKRSPRAAGELEEAKCRRASEKEDGRLGSQGFVYVMANKQPLWNEATQVYQLDFGGRVTQESAKNFQIELEGRQVMQFGRIDGSAYILDFQYPFSAVQAFAVALANVTQRLK

SEQ ID NO: 93352 - protein, 216 aa, Homo sapiens
  Payload ID: 18642
  Gene Name: tubby like protein 4
  ENSP ID: ENSP00000481804
  MOD_RES (1)..(1): Any amino acid
XPLLKSAMVKFYNVRGEHIFTLDTLVQRPIISICWGHRDSRLLMASGPALYVVRVEHRVSSLQLLCQQAIASTLREDKDVSKLTLPPRLCSYLSTAFIPTIKPPIPDPNNMRDFVSYPSAGNERLHCTMKRTEDDPEVGGPCYTLYLEYLGGLVPILKGRRISKLRPEFVIMDPRTDSKPGSALRPASHPSCPGLLRSSPGPHGCPCASPLWARPA

SEQ ID NO: 93353 - protein, 1164 aa, Homo sapiens
  Payload ID: 18643
  Gene Name: tuberous sclerosis 1
  Uniprot ID: Q92574
  ENSP ID: ENSP00000298552
MAQQANVGELLAMLDSPMLGVRDDVTAVFKENLNSDRGPMLVNTLVDYYLETSSQPALHILTTLQEPHDKHLLDRINEYVGKAATRLSILSLLGHVIRLQPSWKHKLSQAPLLPSLLKCLKMDTDVVVLTTGVLVLITMLPMIPQSGKQHLLDFFDIFGRLSSWCLKKPGHVAEVYLVHLHASVYALFHRLYGMYPCNFVSFLRSHYSMKENLETFEEVVKPMMEHVRIHPELVTGSKDHELDPRRWKRLETHDVVIECAKISLDPTEASYEDGYSVSHQISARFPHRSADVTTSPYADTQNSYGCATSTPYSTSRLMLLNMPGQLPQTLSSPSTRLITEPPQATLWSPSMVCGMTTPPTSPGNVPPDLSHPYSKVFGTTAGGKGTPLGTPATSPPPAPLCHSDDYVHISLPQATVTPPRKEERMDSARPCLHRQHHLLNDRGSEEPPGSKGSVTLSDLPGFLGDLASEEDSIEKDKEEAAISRELSEITTAEAEPVVPRGGFDSPFYRDSLPGSQRKTHSAASSSQGASVNPEPLHSSLDKLGPDTPKQAFTPIDLPCGSADESPAGDRECQTSLETSIFTPSPCKIPPPTRVGFGSGQPPPYDHLFEVALPKTAHHFVIRKTEELLKKAKGNTEEDGVPSTSPMEVLDRLIQQGADAHSKELNKLPLPSKSVDWTHFGGSPPSDEIRTLRDQLLLLHNQLLYERFKRQQHALRNRRLLRKVIKAAALEEHNAAMKDQLKLQEKDIQMWKVSLQKEQARYNQLQEQRDTMVTKLHSQIRQLQHDREEFYNQSQELQTKLEDCRNMIAELRIELKKANNKVCHTELLLSQVSQKLSNSESVQQQMEFLNRQLLVLGEVNELYLEQLQNKHSDTTKEVEMMKAAYRKELEKNRSHVLQQTQRLDTSQKRILELESHLAKKDHLLLEQKKYLEDVKLQARGQLQAAESRYEAQKRITQVFELEILDLYGRLEKDGLLKKLEEEKAEAAEAAEERLDCCNDGCSDSMVGHNEEASGHNGETKTPRPSSARGSSGSRGGGGSSSSSSELSTPEKPPHQRAGPFSSRWETTMGEASASIPTTVGSLPSSKSFLGMKARELFRNKSESQCDEDGMTSSLSESLKTELGKDLGVEAKIPLNLDGPHPSPPTPDSVGQLHIMDYNETHHEHS

SEQ ID NO: 93354 - protein, 366 aa, Homo sapiens
  Payload ID: 18643
  Gene Name: tuberous sclerosis 1
  ENSP ID: ENSP00000386093
MAQQANVGELLAMLDSPMLGVRDDVTAVFKENLNSDRGPMLVNTLVDYYLETSSQPALHILTTLQEPHDKHLLDRINEYVGKAATRLSILSLLGHVIRLQPSWKHKLSQAPLLPSLLKCLKMDTDVVVLTTGVLVLITMLPMIPQSGKQHLLDFFDIFGRLSSWCLKKPGHVAEVYLVHLHASVYALFHRLYGMYPCNFVSFLRSHYSMKENLETFEEVVKPMMEHVRIHPELVTGSKDHELDPRRWKRLETHDVVIECAKISLDPTEASYEDGYSVSHQISARFPHRSADVTTSPYADTQNSYGCATSTPYSTSRLMLLNMPGQLPQTLSSPSTRLITEPPQVWCQLVCLLSPLLSGEADPLGQI

SEQ ID NO: 93355 - protein, 1164 aa, Homo sapiens; identical to SEQ ID NO: 93353
  Payload ID: 18643
  Gene Name: tuberous sclerosis 1
  Uniprot ID: Q92574
  ENSP ID: ENSP00000394524

SEQ ID NO: 93356 - protein, 1113 aa, Homo sapiens
  Payload ID: 18643
  Gene Name: tuberous sclerosis 1
  Uniprot ID: Q92574
  ENSP ID: ENSP00000444017
MAQQANVGELLAMLDSPMLGVRDDVTAVFKENLNSDRGPMLVNTLVDYYLETSSQPALHILTTLQEPHDKMDTDVVVLTTGVLVLITMLPMIPQSGKQHLLDFFDIFGRLSSWCLKKPGHVAEVYLVHLHASVYALFHRLYGMYPCNFVSFLRSHYSMKENLETFEEVVKPMMEHVRIHPELVTGSKDHELDPRRWKRLETHDVVIECAKISLDPTEASYEDGYSVSHQISARFPHRSADVTTSPYADTQNSYGCATSTPYSTSRLMLLNMPGQLPQTLSSPSTRLITEPPQATLWSPSMVCGMTTPPTSPGNVPPDLSHPYSKVFGTTAGGKGTPLGTPATSPPPAPLCHSDDYVHISLPQATVTPPRKEERMDSARPCLHRQHHLLNDRGSEEPPGSKGSVTLSDLPGFLGDLASEEDSIEKDKEEAAISRELSEITTAEAEPVVPRGGFDSPFYRDSLPGSQRKTHSAASSSQGASVNPEPLHSSLDKLGPDTPKQAFTPIDLPCGSADESPAGDRECQTSLETSIFTPSPCKIPPPTRVGFGSGQPPPYDHLFEVALPKTAHHFVIRKTEELLKKAKGNTEEDGVPSTSPMEVLDRLIQQGADAHSKELNKLPLPSKSVDWTHFGGSPPSDEIRTLRDQLLLLHNQLLYERFKRQQHALRNRRLLRKVIKAAALEEHNAAMKDQLKLQEKDIQMWKVSLQKEQARYNQLQEQRDTMVTKLHSQIRQLQHDREEFYNQSQELQTKLEDCRNMIAELRIELKKANNKVCHTELLLSQVSQKLSNSESVQQQMEFLNRQLLVLGEVNELYLEQLQNKHSDTTKEVEMMKAAYRKELEKNRSHVLQQTQRLDTSQKRILELESHLAKKDHLLLEQKKYLEDVKLQARGQLQAAESRYEAQKRITQVFELEILDLYGRLEKDGLLKKLEEEKAEAAEAAEERLDCCNDGCSDSMVGHNEEASGHNGETKTPRPSSARGSSGSRGGGGSSSSSSELSTPEKPPHQRAGPFSSRWETTMGEASASIPTTVGSLPSSKSFLGMKARELFRNKSESQCDEDGMTSSLSESLKTELGKDLGVEAKIPLNLDGPHPSPPTPDSVGQLHIMDYNETHHEHS

SEQ ID NO: 93357 - protein, 1807 aa, Homo sapiens
  Payload ID: 18644
  Gene Name: tuberous sclerosis 2
  Uniprot ID: P49815
  ENSP ID: ENSP00000219476
MAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSLRIARPPKQGLNNSPPVKEFKESSAAEAFRCRSISVSEHVVRSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTVASFSSLYQSSCQGQLHRSVSWADSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 93358 - protein, 1784 aa, Homo sapiens
  Payload ID: 18644
  Gene Name: tuberous sclerosis 2
  Uniprot ID: P49815
  ENSP ID: ENSP00000344383
MAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSLRIARPPKQGLNNSPPVKEFKESSAAEAFRCRSISVSEHVVRSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 93359 - protein, 1692 aa, Homo sapiens
  Payload ID: 18644
  Gene Name: tuberous sclerosis 2
  Uniprot ID: P49815
  ENSP ID: ENSP00000371978
MECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 93360 - protein, 1740 aa, Homo sapiens
  Payload ID: 18644
  Gene Name: tuberous sclerosis 2
  Uniprot ID: P49815
  ENSP ID: ENSP00000384468
MAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 93361 - protein, 125 aa, Homo sapiens
  Payload ID: 18644
  Gene Name: tuberous sclerosis 2
  ENSP ID: ENSP00000387937
  MOD_RES (1)..(1): Any amino acid
XAIVQGQVRPRATLGWVTSGCPLTVLSLLGRVWTPASGERLGVLRALFFKVIKDYPSNEDLHERLEVFKALTDNGRHITYLEEELADFVLQWMDVGLSSEFLLVLVNLVKFNSCYLDEYIARMVQ

SEQ ID NO: 93362 - protein, 1704 aa, Homo sapiens
  Payload ID: 18644
  Gene Name: tuberous sclerosis 2
  Uniprot ID: P49815
  ENSP ID: ENSP00000399232
MAKPTSKDSGLKEKFKILLGLGTPRPNPRSAEGKQTEFIITAEILRELSMECGLNNRIRMIGQICEVAKTKKFEEGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 93363 - protein, 108 aa, Homo sapiens
  Payload ID: 18644
  Gene Name: tuberous sclerosis 2
  ENSP ID: ENSP00000406980
MAKPTSKDSGLKEKFKILLGLGTPRPNPRSAEGKQTEFIITAEILRELSMECGLNNRIRMIGQICEVAKTKKFEEDDLSAVRPDRVLCGHRGLPAGAGRRGLLQLPAG

SEQ ID NO: 93364 - protein, 1751 aa, Homo sapiens
  Payload ID: 18644
  Gene Name: tuberous sclerosis 2
  ENSP ID: ENSP00000454487
MEGFSGASWSTMAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 93365 - protein, 196 aa, Homo sapiens
  Payload ID: 18644
  Gene Name: tuberous sclerosis 2
  ENSP ID: ENSP00000454997
SAAGTELGAPCRMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQESSLLNLISYRAQSIHPAKDGWIQNLQALMERFFRSESRGAVRIKVLDVLSFVLLINRQ

SEQ ID NO: 93366 - protein, 535 aa, Homo sapiens
  Payload ID: 18644
  Gene Name: tuberous sclerosis 2
  ENSP ID: ENSP00000455817
  MOD_RES (1)..(1): Any amino acid
XLWDLPPSLLSVPSCGSGLELEDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 93367 - protein, 30 aa, Homo sapiens
  Payload ID: 18644
  Gene Name: tuberous sclerosis 2
  ENSP ID: ENSP00000455997
ISYRAQSIHPAKDGWIQNLQALMERFFRRS

SEQ ID NO: 93368 - protein, 32 aa, Homo sapiens
  Payload ID: 18644
  Gene Name: tuberous sclerosis 2
  ENSP ID: ENSP00000458541
  MOD_RES (1)..(1): Any amino acid
XFITKVGSGPVKAVSLGRPGLALPLAVHGRAE

SEQ ID NO: 93369 - protein, 35 aa, Homo sapiens
  Payload ID: 18644
  Gene Name: tuberous sclerosis 2
  ENSP ID: ENSP00000460310
DFVPFITKVGSGPVKAVSLGRPGLALPLAVHGRAE

SEQ ID NO: 93370 - protein, 129 aa, Homo sapiens
  Payload ID: 18645
  Gene Name: tubulin folding cofactor A
  Uniprot ID: O75347
  ENSP ID: ENSP00000306362
MADPRVRQIKIKTGVVKRLVKEKVMYEKEAKQQEEKIEKMRAEDGENYDIKKQAEILQESRMMIPDCQRRLEAAYLDLQRILVSKDFCVMFKFFFSIQYMESQKFKYLTLRTSWQYFLFTCPLYRYILK

SEQ ID NO: 93371 - protein, 108 aa, Homo sapiens
  Payload ID: 18645
  Gene Name: tubulin folding cofactor A
  Uniprot ID: O75347
  ENSP ID: ENSP00000369736
MADPRVRQIKIKTGVVKRLVKEKVMYEKEAKQQEEKIEKMRAEDGENYDIKKQAEILQESRMMIPDCQRRLEAAYLDLQRILENEKDLEEAEEYKEARLVLDSVKLEA

SEQ ID NO: 93372 - protein, 26 aa, Homo sapiens
  Payload ID: 18645
  Gene Name: tubulin folding cofactor A
  ENSP ID: ENSP00000429046
MADPRVRQIKIKTGVVKRQRSYKNPG

SEQ ID NO: 93373 - protein, 119 aa, Homo sapiens
  Payload ID: 18645
  Gene Name: tubulin folding cofactor A
  ENSP ID: ENSP00000429083
MLTRTSWFHGFFSWFSSSICWSTLSKFLRLVKEKVMYEKEAKQQEEKIEKMRAEDGENYDIKKQAEILQESRMMIPDCQRRLEAAYLDLQRILENEKDLEEAEEYKEARLVLDSVKLEA

SEQ ID NO: 93374 - protein, 79 aa, Homo sapiens
  Payload ID: 18645
  Gene Name: tubulin folding cofactor A
  ENSP ID: ENSP00000429288
MADPRVRQIKIKTGVVKRLVKEKVMYEKEAKQQEEKIEKMRAEDGENYDIKKQENEKDLEEAEEYKEARLVLDSVKLEA

SEQ ID NO: 93375 - protein, 84 aa, Homo sapiens
  Payload ID: 18645
  Gene Name: tubulin folding cofactor A
  ENSP ID: ENSP00000429313
MYEKEAKQQEEKIEKMRAEDGENYDIKKQAEILQESRMMIPDCQRRLEAAYLDLQRILENEKDLEEAEEYKEARLVLDSVKLEA

SEQ ID NO: 93376 - protein, 131 aa, Homo sapiens
  Payload ID: 18645
  Gene Name: tubulin folding cofactor A
  ENSP ID: ENSP00000429793
MADPRVRQIKIKTGVVKRLVKEKVMYEKEAKQQEEKIEKMRAEDGENYDIKKQAGLQLLASSDPPTPASQSPGMISAEILQESRMMIPDCQRRLEAAYLDLQRILENEKDLEEAEEYKEARLVLDSVKLEA

SEQ ID NO: 93377 - protein, 244 aa, Homo sapiens
  Payload ID: 18646
  Gene Name: tubulin folding cofactor B
  Uniprot ID: Q99426
  ENSP ID: ENSP00000221855
MEVTGVSAPTVTVFISSSLNTFRSEKRYSRSLTIAEFKCKLELLVGSPASCMELELYGVDDKFYSKLDQEDALLGSYPVDDGCRIHVIDHSGARLGEYEDVSRVEKYTISQEAYDQRQDTVRSFLKRSKLGRYNEEERAQQEAEAAQRLAEEKAQASSIPVGSRCEVRAAGQSPRRGTVMYVGLTDFKPGYWIGVRYDEPLGKNDGSVNGKRYFECQAKYGAFVKPAVVTVGDFPEEDYGLDEI

SEQ ID NO: 93378 - protein, 191 aa, Homo sapiens
  Payload ID: 18646
  Gene Name: tubulin folding cofactor B
  ENSP ID: ENSP00000465447
MEVTGVSAPTVTVFISSSLNTFRSEKRYSRSLTIAEFKCKLELLVGSPASCMELELYGVDDKFYSKLDQEDALLGSYPVDDGCRIHVIDHSGARLGEYEDVSRVEKYTISQEAYDQRQDTVRSFLKRSKLGRYNEEERAQQEAEAAQRLAEEKAQASSIPVGSRCEVSQISSLATGLVSAMMSHWGKMMAV

SEQ ID NO: 93379 - protein, 133 aa, Homo sapiens
  Payload ID: 18646
  Gene Name: tubulin folding cofactor B
  ENSP ID: ENSP00000465979
SLNTFRSEKRYSRSLTIAEFKCKLELLVGSPASCMELELYGVDDKFYSKLDQEDALLGSYPVDDGCRIHSLALSPRLACSGMISAHCNLRLPGSSDSPASASRVGGITDARHYTRVIDHSGARLGEYEDVSRV

SEQ ID NO: 93380 - protein, 169 aa, Homo sapiens
  Payload ID: 18646
  Gene Name: tubulin folding cofactor B
  ENSP ID: ENSP00000467172
MELELYGVDDKFYSKLDQEDALLGSYPVDDGCRIHVIDHSGARLGEYEDVSRVEKYTISQEAYDQRQDTVRSFLKRSKLGRYNEEERAQQEAEAAQRLAEEKAQASSIPVGSRCEVRAAGQSPRRGTVMYVGLTDFKPGYWIGVRYDEPLGKNDGSVNGKRYFECQAKY

SEQ ID NO: 93381 - protein, 193 aa, Homo sapiens
  Payload ID: 18646
  Gene Name: tubulin folding cofactor B
  Uniprot ID: Q99426
  ENSP ID: ENSP00000467487
MELELYGVDDKFYSKLDQEDALLGSYPVDDGCRIHVIDHSGARLGEYEDVSRVEKYTISQEAYDQRQDTVRSFLKRSKLGRYNEEERAQQEAEAAQRLAEEKAQASSIPVGSRCEVRAAGQSPRRGTVMYVGLTDFKPGYWIGVRYDEPLGKNDGSVNGKRYFECQAKYGAFVKPAVVTVGDFPEEDYGLDEI

SEQ ID NO: 93382 - protein, 45 aa, Homo sapiens
  Payload ID: 18646
  Gene Name: tubulin folding cofactor B
  ENSP ID: ENSP00000467825
MELELYGVDDKFYSKLDQEDALLGSYPVDDGCRIHKLAGRGGRCL

SEQ ID NO: 93383 - protein, 60 aa, Homo sapiens
  Payload ID: 18646
  Gene Name: tubulin folding cofactor B
  ENSP ID: ENSP00000468055
MELELYGVDDKFYSKLDQEDALLGSYPVDDGCRIHVSQISSLATGLVSAMMSHWGKMMAV

SEQ ID NO: 93384 - protein, 45 aa, Homo sapiens; identical to SEQ ID NO: 93382
  Payload ID: 18646
  Gene Name: tubulin folding cofactor B
  ENSP ID: ENSP00000485894

SEQ ID NO: 93385 - protein, 346 aa, Homo sapiens
  Payload ID: 18647
  Gene Name: tubulin folding cofactor C
  Uniprot ID: Q15814
  ENSP ID: ENSP00000361967
MESVSCSAAAVRTGDMESQRDLSLVPERLQRREQERQLEVERRKQKRQNQEVEKENSHFFVATFVRERAAVEELLERAESVERLEEAASRLQGLQKLINDSVFFLAAYDLRQGQEALARLQAALAERRRGLQPKKRFAFKTRGKDAASSTKVDAAPGIPPAVESIQDSPLPKKAEGDLGPSWVCGFSNLESQVLEKRASELHQRDVLLTELSNCTVRLYGNPNTLRLTKAHSCKLLCGPVSTSVFLEDCSDCVLAVACQQLRIHSTKDTRIFLQVTSRAIVEDCSGIQFAPYTWSYPEIDKDFESSGLDRSKNNWNDVDDFNWLARDMASPNWSILPEEERNIQWD

SEQ ID NO: 93386 - protein, 1192 aa, Homo sapiens
  Payload ID: 18648
  Gene Name: tubulin folding cofactor D
  Uniprot ID: Q9BTW9
  ENSP ID: ENSP00000347719
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCEMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 93387 - protein, 1230 aa, Homo sapiens
  Payload ID: 18648
  Gene Name: tubulin folding cofactor D
  ENSP ID: ENSP00000440671
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVDFPSATLVCVGTVQMYAHTHLRLGAPGPHCAHGSALPRFCEMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 93388 - protein, 237 aa, Homo sapiens
  Payload ID: 18648
  Gene Name: tubulin folding cofactor D
  ENSP ID: ENSP00000458365
VIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQADLVIVPQMPPEHTVQGCHLSDVPMGARSCLLSGIKTIPHMSWTAGDLVALGV

SEQ ID NO: 93389 - protein, 260 aa, Homo sapiens
  Payload ID: 18648
  Gene Name: tubulin folding cofactor D
  ENSP ID: ENSP00000458512
AQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNESHPFAVKLLALCKKEIKNSKDIQKLLSGIAVFCEMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 93390 - protein, 141 aa, Homo sapiens
  Payload ID: 18648
  Gene Name: tubulin folding cofactor D
  ENSP ID: ENSP00000458535
MIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGW

SEQ ID NO: 93391 - protein, 211 aa, Homo sapiens
  Payload ID: 18648
  Gene Name: tubulin folding cofactor D
  ENSP ID: ENSP00000458556
MGLRPMEGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQM

SEQ ID NO: 93392 - protein, 244 aa, Homo sapiens
  Payload ID: 18648
  Gene Name: tubulin folding cofactor D
  ENSP ID: ENSP00000458599
MIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSP

SEQ ID NO: 93393 - protein, 68 aa, Homo sapiens
  Payload ID: 18648
  Gene Name: tubulin folding cofactor D
  ENSP ID: ENSP00000458916
  MOD_RES (1)..(1): Any amino acid
XLLTYSDVVGADVLDEVVTVLSDTAWDAELAVVREQRNRLCDLLGVPRPQLVPQVTLSPSQHEVPVLP

SEQ ID NO: 93394 - protein, 117 aa, Homo sapiens
  Payload ID: 18648
  Gene Name: tubulin folding cofactor D
  ENSP ID: ENSP00000459063
MTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQM

SEQ ID NO: 93395 - protein, 134 aa, Homo sapiens
  Payload ID: 18648
  Gene Name: tubulin folding cofactor D
  ENSP ID: ENSP00000460450
MIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRG

SEQ ID NO: 93396 - protein, 256 aa, Homo sapiens
  Payload ID: 18648
  Gene Name: tubulin folding cofactor D
  ENSP ID: ENSP00000460949
MIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDG

SEQ ID NO: 93397 - protein, 109 aa, Homo sapiens
  Payload ID: 18648
  Gene Name: tubulin folding cofactor D
  ENSP ID: ENSP00000461167
MIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGL

SEQ ID NO: 93398 - protein, 251 aa, Homo sapiens
  Payload ID: 18648
  Gene Name: tubulin folding cofactor D
  ENSP ID: ENSP00000461680
MGLRPMEGTFPHGIDILTTADYFAVGNRSNCFLVIRVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQ

SEQ ID NO: 93399 - protein, 504 aa, Homo sapiens
  Payload ID: 18648
  Gene Name: tubulin folding cofactor D
  ENSP ID: ENSP00000487631
DAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVDFPSATLACVGTVQMCAHTHLRLGAPGPHCAHGSALPRFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 93400 - protein, 92 aa, Homo sapiens
  Payload ID: 18648
  Gene Name: tubulin folding cofactor D
  ENSP ID: ENSP00000487671
DAAVSALAALCSEYYMKEPGEADPAIQEELITQYLAELRNPEEMTRCGFSLALGALPGFLLKGRLQQVLTGLRAVTHTSPEDVSFAESRRDG

SEQ ID NO: 93401 - protein, 466 aa, Homo sapiens
  Payload ID: 18648
  Gene Name: tubulin folding cofactor D
  ENSP ID: ENSP00000487976
DAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 93402 - protein, 68 aa, Homo sapiens; identical to SEQ ID NO: 93393
  Payload ID: 18648
  Gene Name: tubulin folding cofactor D
  ENSP ID: ENSP00000488013
  MOD_RES (1)..(1): Any amino acid

SEQ ID NO: 93403 - protein, 260 aa, Homo sapiens
  Payload ID: 18648
  Gene Name: tubulin folding cofactor D
  ENSP ID: ENSP00000488546
AQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNESHPFAVKLLALCKKEIKNSKDIQKLLSGIAVFCGMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 93404 - protein, 66 aa, Homo sapiens
  Payload ID: 18648
  Gene Name: tubulin folding cofactor D
  ENSP ID: ENSP00000488631
DAAVSALAALCSEYYMKEPGEADPAIQEELITQYLAELRNPEEMTRCGFSLALGALPGFLLKGRLQ

SEQ ID NO: 93405 - protein, 80 aa, Homo sapiens
  Payload ID: 18648
  Gene Name: tubulin folding cofactor D
  ENSP ID: ENSP00000488836
DAAVSALAALCSEYYMKEPGEADPAIQEELITQYLAELRNPEEMTRCGFSLALGALPGFLLKGRLQQVLTGLRAVTHTSP

SEQ ID NO: 93406 - protein, 527 aa, Homo sapiens
  Payload ID: 18649
  Gene Name: tubulin folding cofactor E
  Uniprot ID: Q15813
  ENSP ID: ENSP00000355560
MSDTLTADVIGRRVEVNGEHATVRFAGVVPPVAGPWLGVEWDNPERGKHDGSHEGTVYFKCRHPTGGSFIRPNKVNFGTDFLTAIKNRYVLEDGPEEDRKEQIVTIGNKPVETIGFDSIMKQQSQLSKLQEVSLRNCAVSCAGEKGGVAEACPNIRKVDLSKNLLSSWDEVIHIADQLRHLEVLNVSENKLKFPSGSVLTGTLSVLKVLVLNQTGITWAEVLRCVAGCPGLEELYLESNNIFISERPTDVLQTVKLLDLSSNQLIDENQLYLIAHLPRLEQLILSDTGISSLHFPDAGIGCKTSMFPSLKYLVVNDNQISQWSFFNELEKLPSLRALSCLRNPLTKEDKEAETARLLIIASIGQLKTLNKCEILPEERRRAELDYRKAFGNEWKQAGGHKDPEKNRLSEEFLTAHPRYQFLCLKYGAPEDWELKTQQPLMLKNQLLTLKIKYPHQLDQKVLEKQLPGSMTIQKVKGLLSRLLKVPVSDLLLSYESPKKPGREIELENDLKSLQFYSVENGDCLLVRW

SEQ ID NO: 93407 - protein, 527 aa, Homo sapiens; identical to SEQ ID NO: 93406
  Payload ID: 18649
  Gene Name: tubulin folding cofactor E
  Uniprot ID: Q15813
  ENSP ID: ENSP00000384571

SEQ ID NO: 93408 - protein, 578 aa, Homo sapiens
  Payload ID: 18649
  Gene Name: tubulin folding cofactor E
  Uniprot ID: Q15813
  ENSP ID: ENSP00000439170
MSDTLTADVIGRRVEVNGEHATVRFAGVVPPVAGPWLGVEWDNPERGKHDGSHEGTVYFKCRHPTGGSFIRPNKVNFGTDFLTAIKNRYVLEDGPEEDRKEQIVTIGNKPVETIGFDSIMKQQSQLSKLQEVSLRNCAVSCAGEKGGVAEACPNIRKVDLSKNLLSSWDEVIHIADQLRHLEVLNVSENKLKFPSGSVLTGTLSVLKVLVLNQTGITWAEAHAQCGGSRHGLDMQKDASKFVDLCVLQKCSTSNCIISAKDHTSMRMNVAKVLRCVAGCPGLEELYLESNNIFISERPTDVLQTVKLLDLSSNQLIDENQLYLIAHLPRLEQLILSDTGISSLHFPDAGIGCKTSMFPSLKYLVVNDNQISQWSFFNELEKLPSLRALSCLRNPLTKEDKEAETARLLIIASIGQLKTLNKCEILPEERRRAELDYRKAFGNEWKQAGGHKDPEKNRLSEEFLTAHPRYQFLCLKYGAPEDWELKTQQPLMLKNQLLTLKIKYPHQLDQKVLEKQLPGSMTIQKVKGLLSRLLKVPVSDLLLSYESPKKPGREIELENDLKSLQFYSVENGDCLLVRW

SEQ ID NO: 93409 - protein, 527 aa, Homo sapiens; identical to SEQ ID NO: 93406
  Payload ID: 18649
  Gene Name: Tubulin folding cofactor E
  ENSP ID: ENSP00000488933

SEQ ID NO: 93410 - protein, 527 aa, Homo sapiens; identical to SEQ ID NO: 93406
  Payload ID: 18649
  Gene Name: Tubulin folding cofactor E
  ENSP ID: ENSP00000489110

SEQ ID NO: 93411 - protein, 578 aa, Homo sapiens; identical to SEQ ID NO: 93408
  Payload ID: 18649
  Gene Name: Tubulin folding cofactor E
  ENSP ID: ENSP00000489157

SEQ ID NO: 93412 - protein, 118 aa, Homo sapiens
  Payload ID: 18650
  Gene Name: tubulin folding cofactor E-like
  ENSP ID: ENSP00000284259
MDQPSGRSFMQVLCEKYSPENFPYRRGPGMGVHVPATPQGSPMKDRLNLPSVLVLNSCGITCAGDEKEIAAFCAHVSELDLSDNKLEDWHEKEHVLGPSLGFANLSSTTAKLLGRRST

SEQ ID NO: 93413 - protein, 424 aa, Homo sapiens
  Payload ID: 18650
  Gene Name: tubulin folding cofactor E-like
  Uniprot ID: Q5QJ74
  ENSP ID: ENSP00000403925
MDQPSGRSFMQVLCEKYSPENFPYRRGPGMGVHVPATPQGSPMKDRLNLPSVLVLNSCGITCAGDEKEIAAFCAHVSELDLSDNKLEDWHEVSKIVSNVPQLEFLNLSSNPLNLSVLERTCAGSFSGVRKLVLNNSKASWETVHMILQELPDLEELFLCLNDYETVSCPSICCHSLKLLHITDNNLQDWTEIRKLGVMFPSLDTLVLANNHLNAIEEPDDSLARLFPNLRSISLHKSGLQSWEDIDKLNSFPKLEEVRLLGIPLLQPYTTEERRKLVIARLPSVSKLNGSVVTDGEREDSERFFIRYYVDVPQEEVPFRYHELITKYGKLEPLAEVDLRPQSSAKVEVHFNDQVEEMSIRLDQTVAELKKQLKTLVQLPTSNMLLYYFDHEAPFGPEEMKYSSRALHSFGIRDGDKIYVESKTK

SEQ ID NO: 93414 - protein, 118 aa, Homo sapiens; identical to SEQ ID NO: 93412
  Payload ID: 18650
  Gene Name: tubulin folding cofactor E-like
  ENSP ID: ENSP00000431156

SEQ ID NO: 93415 - protein, 83 aa, Homo sapiens
  Payload ID: 18650
  Gene Name: tubulin folding cofactor E-like
  ENSP ID: ENSP00000431803
MDQPSGRSFMQVLCEKYSPENFPYRRGPGMGVHVPATPQGSPMKDRLNLPSVLVLNSCGITCAGDEKEIAAFCAHVSELDLSD

SEQ ID NO: 93416 - protein, 238 aa, Homo sapiens
  Payload ID: 18650
  Gene Name: tubulin folding cofactor E-like
  ENSP ID: ENSP00000432783
MDQPSGRSFMQVLCEKYSPENFPYRRGPGMGVHVPATPQGSPMKDRLNLPSVLVLNSCGITCAGDEKEIAAFCAHVSELDLSDNKLEDWHEVSKIVSNVPQLEFLNLSSNPLNLSVLERTCAGSFSGVRKLVLNNSKASWETVHMILQELPDLEELFLCLNDYETVSCPSICCHSLKLLHITDNNLQDWTEIRKLGVMFPSLDTLVLANNHLNAIEEPDDSLARLFPNLRSISLHKSG

SEQ ID NO: 93417 - protein, 101 aa, Homo sapiens
  Payload ID: 18650
  Gene Name: tubulin folding cofactor E-like
  ENSP ID: ENSP00000433365
MDQPSGRSFMQVLCEKYSPENFPYRRGPGMGVHVPATPQGSPMKDRLNLPSVLVLNSCGITCAGDEKEIAAFCAHVSELDLSDNKLEDWHEVCSPGKTLIN

SEQ ID NO: 93418 - protein, 109 aa, Homo sapiens
  Payload ID: 18650
  Gene Name: tubulin folding cofactor E-like
  ENSP ID: ENSP00000436419
MGKKGLQSWEDIDKLNSFPKLEEVRLLGIPLLQPYTTEERRKLVIARLPSVSKLNGSVVTDGEREDSERFFIRYYVDVPQEEVPFRYHELITKYGKLEPLAEVDLRPQS

SEQ ID NO: 93419 - protein, 424 aa, Homo sapiens; identical to SEQ ID NO: 93413
  Payload ID: 18650
  Gene Name: tubulin folding cofactor E-like
  Uniprot ID: Q5QJ74
  ENSP ID: ENSP00000437184

SEQ ID NO: 93420 - protein, 290 aa, Homo sapiens
  Payload ID: 18651
  Gene Name: tubulin polyglutamylase complex subunit 1
  Uniprot ID: Q6ZTW0
  ENSP ID: ENSP00000352265
MAAVEKRRQAVPPPAGFTDSGRQSVSRAAGAAESEEDFLRQVGVTEMLRAALLKVLEARPEEPIAFLAHYFENMGLRSPVNGGAGEPPGQLLLQQQRLGRALWHLRLAHHSQRAAFNNNVSVAYECLSAGGRRKRPGLDGRTYSELLRRICRDGQAPEEVVAPLLRKVQCRDHEAVPLSVFRAGTLTCFVLLEFVARAGALFQLLEDSAAAVADRRVGQAVLDTLEGALQASDAAAPARFLEAGSRLGPDSLALALDRAVGGRRPSAPMTREEFLERAAALFIAKVKPVG

SEQ ID NO: 93421 - protein, 300 aa, Homo sapiens
  Payload ID: 18652
  Gene Name: tubulin polyglutamylase complex subunit 2
  Uniprot ID: Q68CL5
  ENSP ID: ENSP00000335144
MEEEASSPGLGCSKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTAYYRLLITHLGLPQWQYAFTSYGISPQAKQWFSMYKPITYNTNLLTEETDSFVNKLDPSKVFKSKNKIVIPKKKGPVQPAGGQKGPSGPSGPSTSSTSKSSSGSGNPTRK

SEQ ID NO: 93422 - protein, 257 aa, Homo sapiens
  Payload ID: 18652
  Gene Name: tubulin polyglutamylase complex subunit 2
  Uniprot ID: Q68CL5
  ENSP ID: ENSP00000372530
MEEEASSPGLGCSKPHLEKLTLGITRILESSPGVTEVTIIEKPPAERHMISSWEQKNNCVMPEDVKNFYLMTNGFHMTWSVKLDASDDQPEKPHFDSRSVIFELDSCNGSGKVCLVYKSGKPALAEDTEIWFLDRALYWHFLTDTFTAYYRLLITHLGLPQWQYAFTSYGISPQAKQWFSMYKPITYNTNLLTEETDSFVNKLDPSKVFKSKNKIVIPKKKGPVQPAGGQKGPSGPSGPSTSSTSKSSSGSGNPTRK

SEQ ID NO: 93423 - protein, 304 aa, Homo sapiens
  Payload ID: 18652
  Gene Name: tubulin polyglutamylase complex subunit 2
  Uniprot ID: Q68CL5
  ENSP ID: ENSP00000464780
MEEEASSPGLGCSKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTAYYRLLITHLGLPQWQYAFTSYGISPQAKITYNIKMNRRKCVHWKLAVEPLQWELRSCVSAGMGTGHKQRVSSMKPRSCSVCSRRQSNSMGTTVSQSFLSYGKNVLFFTVRCCF

SEQ ID NO: 93424 - protein, 43 aa, Homo sapiens
  Payload ID: 18652
  Gene Name: tubulin polyglutamylase complex subunit 2
  ENSP ID: ENSP00000465090
MEEEASSPGLGCSKPHLEKLTLGITRILEKPPAERHMISSWEQ

SEQ ID NO: 93425 - protein, 75 aa, Homo sapiens
  Payload ID: 18652
  Gene Name: tubulin polyglutamylase complex subunit 2
  ENSP ID: ENSP00000465449
MEEEASSPGLGCSKPHLEKLTLGITRILESSPGVTEVTIIEKPPAERHMISSWEQMKKQRLKEFKEFGRHSGSCL

SEQ ID NO: 93426 - protein, 248 aa, Homo sapiens
  Payload ID: 18652
  Gene Name: tubulin polyglutamylase complex subunit 2
  ENSP ID: ENSP00000465551
MEEEASSPGLGCSKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTAYYRLLITHLGLPQWQYAFTSYGISPQAKALLGLFDGSSPPVDLNNPRGRTGIRSRRF

SEQ ID NO: 93427 - protein, 49 aa, Homo sapiens
  Payload ID: 18652
  Gene Name: tubulin polyglutamylase complex subunit 2
  ENSP ID: ENSP00000465987
MEEEASSPGLGCSKPHLEKLTLGITRILGQGTHRPTPNSRSWRNRLTSQ

SEQ ID NO: 93428 - protein, 119 aa, Homo sapiens
  Payload ID: 18652
  Gene Name: tubulin polyglutamylase complex subunit 2
  ENSP ID: ENSP00000466788
MEEEASSPGLGCSKPHLEKLTLGITRILESSPGVTEVTIIEKPPAERHMISSWEQKNNCVMPEDVKNFYLMTNGFHMTWSVKLDVFSANKENMELPSLYLHPNHRRLEPSKKTAKFSSL

SEQ ID NO: 93429 - protein, 227 aa, Homo sapiens
  Payload ID: 18652
  Gene Name: tubulin polyglutamylase complex subunit 2
  Uniprot ID: Q68CL5
  ENSP ID: ENSP00000466973
MEEEASSPGLGCSKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTAYYRLLITHLGLPQWQYAFTSYGISPQAKVREEHLPL

SEQ ID NO: 93430 - protein, 30 aa, Homo sapiens
  Payload ID: 18652
  Gene Name: tubulin polyglutamylase complex subunit 2
  ENSP ID: ENSP00000467163
MEEEASSPGLGCSKPHLEKLTLGITRILGL

SEQ ID NO: 93431 - protein, 208 aa, Homo sapiens
  Payload ID: 18652
  Gene Name: tubulin polyglutamylase complex subunit 2
  ENSP ID: ENSP00000467204
  MOD_RES (1)..(1): Any amino acid
XKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTAYYRLLITHLGLPQWQYAFTSYGISPQAKV

SEQ ID NO: 93432 - protein, 265 aa, Homo sapiens
  Payload ID: 18652
  Gene Name: tubulin polyglutamylase complex subunit 2
  Uniprot ID: Q68CL5
  ENSP ID: ENSP00000467392
MEEEASSPGLGCSKPHLEKLTLGITRILESSPGVTEVTIIEKPPAERHMISSWEQKNNCVMPEDVKNFYLMTNGFHMTWSVKLDDLEDDTHEASDDQPEKPHFDSRSVIFELDSCNGSGKVCLVYKSGKPALAEDTEIWFLDRALYWHFLTDTFTAYYRLLITHLGLPQWQYAFTSYGISPQAKQWFSMYKPITYNTNLLTEETDSFVNKLDPSKVFKSKNKIVIPKKKGPVQPAGGQKGPSGPSGPSTSSTSKSSSGSGNPTRK

SEQ ID NO: 93433 - protein, 30 aa, Homo sapiens; identical to SEQ ID NO: 93430
  Payload ID: 18652
  Gene Name: tubulin polyglutamylase complex subunit 2
  ENSP ID: ENSP00000467995

SEQ ID NO: 93434 - protein, 188 aa, Homo sapiens
  Payload ID: 18652
  Gene Name: tubulin polyglutamylase complex subunit 2
  ENSP ID: ENSP00000468292
  MOD_RES (1)..(1): Any amino acid
XAERHMISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTAYYRLLITHLGLPQWQYAFTSYGISPQAKAWGLATSKESAA

SEQ ID NO: 93435 - protein, 232 aa, Homo sapiens
  Payload ID: 18652
  Gene Name: tubulin polyglutamylase complex subunit 2
  ENSP ID: ENSP00000478553
MEEEASSPGLGCSKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTAYYRLLITHLGLPQWQYAFTSYGISPQAKPKGSEGRSKRGCF

SEQ ID NO: 93436 - protein, 83 aa, Homo sapiens
  Payload ID: 18652
  Gene Name: tubulin polyglutamylase complex subunit 2
  ENSP ID: ENSP00000479065
  MOD_RES (1)..(1): Any amino acid
XFELDSCNGSGKVCLVYKSGKPALAEDTEIWFLDRALYWHFLTDTFTAYYRLLITHLGLPQWQYAFTSYGISPQAKVIKHNRL

SEQ ID NO: 93437 - protein, 162 aa, Homo sapiens
  Payload ID: 18652
  Gene Name: tubulin polyglutamylase complex subunit 2
  ENSP ID: ENSP00000482262
KNNCVMPEDVKNFYLMTNGFHMTWSVKLDASDDQPEKPHFDSRSVIFELDSCNGSGKVCLVYKSGKPALAEDTEIWFLDRALYWHFLTDTFTAYYRLLITHLGLPQWQYAFTSYGISPQAKQWFSMYKPITYNTNLLTEETDSFVNKLDPSKVFKSKNKIVI

SEQ ID NO: 93438 - protein, 59 aa, Homo sapiens
  Payload ID: 18652
  Gene Name: tubulin polyglutamylase complex subunit 2
  ENSP ID: ENSP00000483592
  MOD_RES (1)..(1): Any amino acid
XFLDRALYWHFLTDTFTAYYRLLITHLGLPQWQYAFTSYGISPQAKPKGSEGRSKRGCF

SEQ ID NO: 93439 - protein, 130 aa, Homo sapiens
  Payload ID: 18652
  Gene Name: tubulin polyglutamylase complex subunit 2
  ENSP ID: ENSP00000484407
MEEEASSPGLGCSKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEDNL

SEQ ID NO: 93440 - protein, 219 aa, Homo sapiens
  Payload ID: 18653
  Gene Name: tubulin polymerization promoting protein
  Uniprot ID: O94811
  ENSP ID: ENSP00000353785
MADKAKPAKAANRTPPKSPGDPSKDRAAKRLSLESEGAGEGAAASPELSALEEAFRRFAVHGDARATGREMHGKNWSKLCKDCQVIDGRNVTVTDVDIVFSKIKGKSCRTITFEQFQEALEELAKKRFKDKSSEEAVREVHRLIEGKAPIISGVTKAISSPTVSRLTDTTKFTGSHKERFDPSGKGKGKAGRVDLVDESGYVSGYKHAGTYDQKVQGGK

SEQ ID NO: 93441 - protein, 170 aa, Homo sapiens
  Payload ID: 18654
  Gene Name: tubulin polymerization-promoting protein family member 2
  Uniprot ID: P59282
  ENSP ID: ENSP00000317595
MASEAEKTFHRFAAFGESSSSGTEMNNKNFSKLCKDCGIMDGKTVTSTDVDIVFSKVKAKNARTITFQQFKEAVKELGQKRFKGKSPDEVLENIYGLMEGKDPATTGATKATTVGAVDRLTDTSKYTGTHKERFDESGKGKGIAGREEMTDNTGYVSGYKGSGTYDKKTK

SEQ ID NO: 93442 - protein, 119 aa, Homo sapiens
  Payload ID: 18654
  Gene Name: tubulin polymerization-promoting protein family member 2
  ENSP ID: ENSP00000421438
EKTFHRFAAFGESSSSGTEMNNKNFSKLCKDCGIMDGKTVTSTDVDIVFSKVKAKNARTITFQQFKEAVKELGQKRFKGKSPDEVLENIYGLMEGKDPATTGATLLPRTGWKNIFGVKR

SEQ ID NO: 93443 - protein, 137 aa, Homo sapiens
  Payload ID: 18654
  Gene Name: tubulin polymerization-promoting protein family member 2
  ENSP ID: ENSP00000423171
MASEAEKTFHRFAAFGESSSSGTEMNNKNFSKLCKDCGIMDGKTVTSTDVDIVFSKVKAKNARTITFQQFKEAVKELGQKRFKGKSPDEVLENIYGLMEGKDPATTGATWMLSSRLDSTHTPTPVRLNSNISLIQLQ

SEQ ID NO: 93444 - protein, 137 aa, Homo sapiens
  Payload ID: 18654
  Gene Name: tubulin polymerization-promoting protein family member 2
  ENSP ID: ENSP00000427504
MASEAEKTFHRFAAFGESSSSGTEMNNKNFSKLCKDCGIMDGKTVTSTDVDIVFSKVKAKNARTITFQQFKEAVKELGQKRFKGKSPDEVLENIYGLMEGKDPATTGATVSDSLHPLDPTSLNPHCSSLPSLTLPTV

SEQ ID NO: 93445 - protein, 170 aa, Homo sapiens; identical to SEQ ID NO: 93441
  Payload ID: 18654
  Gene Name: tubulin polymerization-promoting protein family member 2
  Uniprot ID: P59282
  ENSP ID: ENSP00000435356

SEQ ID NO: 93446 - protein, 110 aa, Homo sapiens
  Payload ID: 18654
  Gene Name: tubulin polymerization-promoting protein family member 2
  ENSP ID: ENSP00000436874
  MOD_RES (1)..(1): Any amino acid
XHRFAAFGESSSSGTEMNNKNFSKLCKDCGIMDGKTVTSTDVDIVFSKVKAKNARTITFQQFKEAVKELGQKRFKGKSPDEVLENIYGLMEGKDPATTGATFPWLPMQET

SEQ ID NO: 93447 - protein, 63 aa, Homo sapiens
  Payload ID: 18654
  Gene Name: tubulin polymerization-promoting protein family member 2
  ENSP ID: ENSP00000451899
  MOD_RES (1)..(1): Any amino acid
XRTITFQQFKEAVKELGQKRFKGKSPDEVLENIYGLMEGKDPATTGATLLPRTGWKNIFGVKR

SEQ ID NO: 93448 - protein, 176 aa, Homo sapiens
  Payload ID: 18655
  Gene Name: tubulin polymerization-promoting protein family member 3
  Uniprot ID: Q9BW30
  ENSP ID: ENSP00000290942
MAASTDMAGLEESFRKFAIHGDPKASGQEMNGKNWAKLCKDCKVADGKSVTGTDVDIVFSKVKGKSARVINYEEFKKALEELATKRFKGKSKEEAFDAICQLVAGKEPANVGVTKAKTGGAVDRLTDTSRYTGSHKERFDESGKGKGIAGRQDILDDSGYVSAYKNAGTYDAKVKK

SEQ ID NO: 93449 - protein, 176 aa, Homo sapiens; identical to SEQ ID NO: 93448
  Payload ID: 18655
  Gene Name: tubulin polymerization-promoting protein family member 3
  Uniprot ID: Q9BW30
  ENSP ID: ENSP00000377529

SEQ ID NO: 93450 - protein, 176 aa, Homo sapiens; identical to SEQ ID NO: 93448
  Payload ID: 18655
  Gene Name: tubulin polymerization-promoting protein family member 3
  Uniprot ID: Q9BW30
  ENSP ID: ENSP00000457275

SEQ ID NO: 93451 - protein, 176 aa, Homo sapiens; identical to SEQ ID NO: 93448
  Payload ID: 18655
  Gene Name: tubulin polymerization-promoting protein family member 3
  Uniprot ID: Q9BW30
  ENSP ID: ENSP00000462435

SEQ ID NO: 93452 - protein, 377 aa, Homo sapiens
  Payload ID: 18656
  Gene Name: tubulin tyrosine ligase
  Uniprot ID: Q8NG68
  ENSP ID: ENSP00000233336
MYTFVVRDENSSVYAEVSRLLLATGHWKRLRRDNPRFNLMLGERNRLPFGRLGHEPGLVQLVNYYRGADKLCRKASLVKLIKTSPELAESCTWFPESYVIYPTNLKTPVAPAQNGIQPPISNSRTDEREFFLASYNRKKEDGEGNVWIAKSSAGAKGEGILISSEASELLDFIDNQGQVHVIQKYLEHPLLLEPGHRKFDIRSWVLVDHQYNIYLYREGVLRTASEPYHVDNFQDKTCHLTNHCIQKEYSKNYGKYEEGNEMFFKEFNQYLTSALNITLESSILLQIKHIIRNCLLSVEPAISTKHLPYQSFQLFGFDFMVDEELKVWLIEVNGAPACAQKLYAELCQGIVDIAISSVFPPPDVEQPQTQPAAFIKL

SEQ ID NO: 93453 - protein, 423 aa, Homo sapiens
  Payload ID: 18657
  Gene Name: tubulin tyrosine ligase-like family member 1
  Uniprot ID: O95922
  ENSP ID: ENSP00000266254
MAGKVKWVTDIEKSVLINNFEKRGWVQVTENEDWNFYWMSVQTIRNVFSVEAGYRLSDDQIVNHFPNHYELTRKDLMVKNIKRYRKELEKEGSPLAEKDENGKYLYLDFVPVTYMLPADYNLFVEEFRKSPSSTWIMKPCGKAQGKGIFLINKLSQIKKWSRDSKTSSFVSQSNKEAYVISLYINNPLLIGGRKFDLRLYVLVSTYRPLRCYMYKLGFCRFCTVKYTPSTSELDNMFVHLTNVAIQKHGEDYNHIHGGKWTVSNLRLYLESTRGKEVTSKLFDEIHWIIVQSLKAVAPVMNNDKHCFECYGYDIIIDDKLKPWLIEVNASPSLTSSTANDRILKYNLINDTLNIAVPNGEIPDCKWNKSPPKEVLGNYEILYDEELAQGDGADRELRSRQGQSLGPRAGRSRDSGRAVLTTWK

SEQ ID NO: 93454 - protein, 394 aa, Homo sapiens
  Payload ID: 18657
  Gene Name: tubulin tyrosine ligase-like family member 1
  Uniprot ID: O95922
  ENSP ID: ENSP00000333734
MAGKVKWVTDIEKSVLINNFEKRGWVQVTENEDWNFYWMSVQTIRNVFSVEAGYRLSDDQIVNHFPNHYELTRKDLMVKNIKRYRKELEKEGSPLAEKDENGKYLYLDFVPVTYMLPADYNLFVEEFRKSPSSTWIMKPCGKAQGKGIFLINKLSQIKKWSRDSKTSSFVSQSNKEAYVISLYINNPLLIGGRKFDLRLYVLVSTYRPLRCYMYKLGFCRFCTVKYTPSTSELDNMFVHLTNVAIQKHGEDYNHIHGGKWTVSNLRLYLESTRGKEVTSKLFDEIHWIIVQSLKAVAVNASPSLTSSTANDRILKYNLINDTLNIAVPNGEIPDCKWNKSPPKEVLGNYEILYDEELAQGDGADRELRSRQGQSLGPRAGRSRDSGRAVLTTWK

SEQ ID NO: 93455 - protein, 59 aa, Homo sapiens
  Payload ID: 18657
  Gene Name: tubulin tyrosine ligase-like family member 1
  Uniprot ID: O95922
  ENSP ID: ENSP00000401518
MAGKVKWVTDIEKSVLINNFEKRGWVQVTENEDWNFYWLLDLPEFRYRSCLNEFPDFRV

SEQ ID NO: 93456 - protein, 59 aa, Homo sapiens; identical to SEQ ID NO: 93455
  Payload ID: 18657
  Gene Name: tubulin tyrosine ligase-like family member 1
  Uniprot ID: O95922
  ENSP ID: ENSP00000403332

SEQ ID NO: 93457 - protein, 404 aa, Homo sapiens
  Payload ID: 18658
  Gene Name: tubulin tyrosine ligase-like family member 10
  Uniprot ID: Q6ZVT0
  ENSP ID: ENSP00000368590
MGSSQEEGLRCQPSQPDHDADGHCGPDLEGAERASATPGPPGLLNSHRPADSDDTNAAGPSAALLEGLLLGGGKPSPHSTRPGPFFYIGGSNGATIISSYCKSKGWQRIHDSRRDDYTLKWCEVKSRDSYGSFREGEQLLYQLPNNKLLTTKIGLLSTLRGRARAMSKASKVPGGVQARLEKDAAAPALEDLPWTSPGYLRPQRVLRMEEFFPETYRLDLKHEREAFFTLFDETQIWICKPTASNQGKGIFLLRNQEEVAALQAKTRSMEDDPIHHKTPFRGPQARVVQRYIQNPLLVDGRKFDVRSYLLIACTTPYMIFFGHGYARLTLSLYDPHSSDLGGHLTNQFMQKKSPLYMLLKEHTVWSMEHLNRYISDTFWKARGLAKDWVFTTLKVRPLCPPVWE

SEQ ID NO: 93458 - protein, 673 aa, Homo sapiens
  Payload ID: 18658
  Gene Name: tubulin tyrosine ligase-like family member 10
  Uniprot ID: Q6ZVT0
  ENSP ID: ENSP00000368591
MDHSCTRFIHRRGPPTRTRAGFKRGKRPRIQQRPRARVSGTIPASRLHPAPASQPGPCPAPGHCPVGPAHERPMGSSQEEGLRCQPSQPDHDADGHCGPDLEGAERASATPGPPGLLNSHRPADSDDTNAAGPSAALLEGLLLGGGKPSPHSTRPGPFFYIGGSNGATIISSYCKSKGWQRIHDSRRDDYTLKWCEVKSRDSYGSFREGEQLLYQLPNNKLLTTKIGLLSTLRGRARAMSKASKVPGGVQARLEKDAAAPALEDLPWTSPGYLRPQRVLRMEEFFPETYRLDLKHEREAFFTLFDETQIWICKPTASNQGKGIFLLRNQEEVAALQAKTRSMEDDPIHHKTPFRGPQARVVQRYIQNPLLVDGRKFDVRSYLLIACTTPYMIFFGHGYARLTLSLYDPHSSDLGGHLTNQFMQKKSPLYMLLKEHTVWSMEHLNRYISDTFWKARGLAKDWVFTTLKKRMQQIMAHCFLAAKPKLDCKLGYFDLIGCDFLIDDNFKVWLLEMNSNPALHTNCEVLKEVIPGVVIETLDLVLETFRKSLRGQKMLPLLSQRRFVLLHNGEADPRPHLGGSCSLRRWPPLPTRQAKSSGPPMPHAPDQPGARRPAPPPLVPQRPRPPGPDLDSAHDGEPQAPGTEQSGTGNRHPAQEPSPGTAKEEREEPENARP

SEQ ID NO: 93459 - protein, 673 aa, Homo sapiens; identical to SEQ ID NO: 93458
  Payload ID: 18658
  Gene Name: tubulin tyrosine ligase-like family member 10
  Uniprot ID: Q6ZVT0
  ENSP ID: ENSP00000368592

SEQ ID NO: 93460 - protein, 45 aa, Homo sapiens
  Payload ID: 18658
  Gene Name: tubulin tyrosine ligase-like family member 10
  ENSP ID: ENSP00000464269
  MOD_RES (1)..(1): Any amino acid
XNRYISDTFWKARGLAKDWVFTTLKCLTQDRSCTSLLSEFLAVNL

SEQ ID NO: 93461 - protein, 800 aa, Homo sapiens
  Payload ID: 18659
  Gene Name: tubulin tyrosine ligase-like family member 11
  Uniprot ID: Q8NHH1
  ENSP ID: ENSP00000321346
MAAAASVTGRVTWAASPMRSLGLGRRLSLPGPRLDAVTAAVNPSLSDHGNGLGRGTRGSGCSGGSLVADWGGGAAAAAAVALALAPALSTMRRGSSESELAARWEAEAVAAAKAAAKAEAEATAETVAEQVRVDAGAAGEPECKAGEEQPKVLAPAPAQPSAAEEGNTQVLQRPPPTLPPSKPKPVQGLCPHGKPRDKGRSCKRSSGHGSGENGSQRPVTVDSSKARTSLDALKISIRQLKWKEFPFGRRLPCDIYWHGVSFHDNDIFSGQVNKFPGMTEMVRKITLSRAVRTMQNLFPEEYNFYPRSWILPDEFQLFVAQVQMVKDDDPSWKPTFIVKPDGGCQGDGIYLIKDPSDIRLAGTLQSRPAVVQEYICKPLLIDKLKFDIRLYVLLKSLDPLEIYIAKDGLSRFCTEPYQEPTPKNLHRIFMHLTNYSLNIHSGNFIHSDSASTGSKRTFSSILCRLSSKGVDIKKVWSDIISVVIKTVIALTPELKVFYQSDIPTGRPGPTCFQILGFDILLMKNLKPILLEVNANPSMRIEHEHELSPGVFENVPSLVDEEVKVAVIRDTLRLMDPLKKKRENQSQQLEKPFAGKEDALDGELTSAPDCNANPEAHLPSICLKQVFPKYAKQFNYLRLVDRMANLFIRFLGIKGTMKLGPTGFRTFIRSCKLSSSSLSMAAVDILYIDITRRWNSMTLDQRDSGMCLQAFVEAFFFLAQRKFKMLPLHEQVASLIDLCEYHLSLLDEKRLVCGRGVPSGGRPPHRGPPQEPSPSAQPAGDNPPPRTSCANKLSHPRHTLS

SEQ ID NO: 93462 - protein, 538 aa, Homo sapiens
  Payload ID: 18659
  Gene Name: tubulin tyrosine ligase-like family member 11
  Uniprot ID: Q8NHH1
  ENSP ID: ENSP00000362881
MAAAASVTGRVTWAASPMRSLGLGRRLSLPGPRLDAVTAAVNPSLSDHGNGLGRGTRGSGCSGGSLVADWGGGAAAAAAVALALAPALSTMRRGSSESELAARWEAEAVAAAKAAAKAEAEATAETVAEQVRVDAGAAGEPECKAGEEQPKVLAPAPAQPSAAEEGNTQVLQRPPPTLPPSKPKPVQGLCPHGKPRDKGRSCKRSSGHGSGENGSQRPVTVDSSKARTSLDALKISIRQLKWKEFPFGRRLPCDIYWHGVSFHDNDIFSGQVNKFPGMTEMVRKITLSRAVRTMQNLFPEEYNFYPRSWILPDEFQLFVAQVQMVKDDDPSWKPTFIVKPDGGCQGDGIYLIKDPSDIRLAGTLQSRPAVVQEYICKPLLIDKLKFDIRLYVLLKSLDPLEIYIAKDGLSRFCTEPYQEPTPKNLHRIFMHLTNYSLNIHSGNFIHSDSASTGSKRTFSSILCRLSSKGVDIKKVWSDIISVVIKTVIALTPELKVFYQSDIPTGRPGPTCFQVTIASSQPAFPALTGLKRALWLRVG

SEQ ID NO: 93463 - protein, 122 aa, Homo sapiens
  Payload ID: 18659
  Gene Name: tubulin tyrosine ligase-like family member 11
  ENSP ID: ENSP00000478392
  MOD_RES (1)..(1): Any amino acid
XSSGHGSGENGSQRPVTVDSSKARTSLDALKISIRQLKWKEFPFGRRLPCDIYWHGVSFHDNDIFSGQVNKFPGMTEMVRKITLSRAVRTMQNLFPEESTSANLSLSTSSSLIFVCMSYSSP

SEQ ID NO: 93464 - protein, 66 aa, Homo sapiens
  Payload ID: 18659
  Gene Name: tubulin tyrosine ligase-like family member 11
  ENSP ID: ENSP00000478658
  MOD_RES (1)..(1): Any amino acid
XVTVDSSKARTSLDALKISIRQLKWKEFPFGRRLPCDIYWHGVSFHDNDIFSGQVNKFPGSNGERR

SEQ ID NO: 93465 - protein, 239 aa, Homo sapiens
  Payload ID: 18659
  Gene Name: tubulin tyrosine ligase-like family member 11
  ENSP ID: ENSP00000479407
  MOD_RES (1)..(1): Any amino acid
XSDHGNGLGRGTRGSGCSGGSLVADWGGGAAAAAAVALALAPALSTMRRGSSESELAARWEAEAVAAAKAAAKAEAEATAETVAEQVRVDAGAAGEPECKAGEEQPKVLAPAPAQPSAAEEGNTQVLQRPPPTLPPSKPKPVQGLCPHGKPRDKGRSCKRSSGHGSGENGSQRPVTVDSSKARTSLDALKISIRQLKWKEFPFGRRLPCDIYWHGVSFHDNDIFSGQVNKFPGSNGERR

SEQ ID NO: 93466 - protein, 644 aa, Homo sapiens
  Payload ID: 18660
  Gene Name: tubulin tyrosine ligase-like family member 12
  Uniprot ID: Q14166
  ENSP ID: ENSP00000216129
MEAERGPERRPAERSSPGQTPEEGAQALAEFAALHGPALRASGVPERYWGRLLHKLEHEVFDAGEVFGIMQVEEVEEEEDEAAREVRKQQPNPGNELCYKVIVTRESGLQAAHPNSIFLIDHAWTCRVEHARQQLQQVPGLLHRMANLMGIEFHGELPSTEAVALVLEEMWKFNQTYQLAHGTAEEKMPVWYIMDEFGSRIQHADVPSFATAPFFYMPQQVAYTLLWPLRDLDTGEEVTRDFAYGETDPLIRKCMLLPWAPTDMLDLSSCTPEPPAEHYQAILEENKEKLPLDINPVVHPHGHIFKVYTDVQQVASSLTHPRFTLTQSEADADILFNFSHFKDYRKLSQERPGVLLNQFPCENLLTVKDCLASIARRAGGPEGPPWLPRTFNLRTELPQFVSYFQQRERWGEDNHWICKPWNLARSLDTHVTKSLHSIIRHRESTPKVVSKYIESPVLFLREDVGKVKFDIRYIVLLRSVRPLRLFVYDVFWLRFSNRAFALNDLDDYEKHFTVMNYDPDVVLKQVHCEEFIPEFEKQYPEFPWTDVQAEIFRAFTELFQVACAKPPPLGLCDYPSSRAMYAVDLMLKWDNGPDGRRVMQPQILEVNFNPDCERACRYHPTFFNDVFSTLFLDQPGGCHVTCLV

SEQ ID NO: 93467 - protein, 65 aa, Homo sapiens
  Payload ID: 18660
  Gene Name: tubulin tyrosine ligase-like family member 12
  ENSP ID: ENSP00000476297
MYAVDLMLKWDNGPDGRRVMQPQILEVNFNPDCERACRYHPTFFNDVFSTLFLDQPGGCHVTCLV

SEQ ID NO: 93468 - protein, 592 aa, Homo sapiens
  Payload ID: 18661
  Gene Name: tubulin tyrosine ligase-like family member 2
  Uniprot ID: Q9BWV7
  ENSP ID: ENSP00000239587
MRGRDLCSSTQSQALGSLRTTTPAFTLNIPSEANHTEQPPAGLGARLQEAGVSIPPRRGRPTPTLEKKKKPHLMAEDEPSGALLKPLVFRVDETTPAVVQSVLLERGWNKFDKQEQNAEDWNLYWRTSSFRMTEHNSVKPWQQLNHHPGTTKLTRKDCLAKHLKHMRRMYGTSLYQFIPLTFVMPNDYTKFVAEYFQERQMLGTKHSYWICKPAELSRGRGILIFSDFKDFIFDDMYIVQKYISNPLLIGRYKCDLRIYVCVTGFKPLTIYVYQEGLVRFATEKFDLSNLQNNYAHLTNSSINKSGASYEKIKEVIGHGCKWTLSRFFSYLRSWDVDDLLLWKKIHRMVILTILAIAPSVPFAANCFELFGFDILIDDNLKPWLLEVNYSPALTLDCSTDVLVKRKLVHDIIDLIYLNGLRNEGREASNATHGNSNIDAAKSDRGGLDAPDCLPYDSLSFTSRMYNEDDSVVEKAVSVRPEAAPASQLEGEMSGQDFHLSTREMPQSKPKLRSRHTPHKTLMPYASLFQSHSCKTKTSPCVLSDRGKAPDPQAGNFVLVFPFNEATLGASRNGLNVKRIIQELQKLMNKQHS

SEQ ID NO: 93469 - protein, 50 aa, Homo sapiens
  Payload ID: 18661
  Gene Name: tubulin tyrosine ligase-like family member 2
  ENSP ID: ENSP00000423198
MRGRDLCSSTQSQALGSMTPEIPGVESHGLTLQLDPGQMESCSGALSCKQ

SEQ ID NO: 93470 - protein, 592 aa, Homo sapiens; identical to SEQ ID NO: 93468
  Payload ID: 18661
  Gene Name: tubulin tyrosine ligase-like family member 2
  Uniprot ID: Q9BWV7
  ENSP ID: ENSP00000424130

SEQ ID NO: 93471 - protein, 520 aa, Homo sapiens
  Payload ID: 18662
  Gene Name: tubulin tyrosine ligase-like family member 3
  ENSP ID: ENSP00000312148
  MOD_RES (1)..(1): Any amino acid
XFDDLLKFDDLDGTHALMSRMVQNEIPYFIWTTRRDVLDCRFLSKDQMINHYARAGSFTTKVGLCLNLRNLPWFDEVDANSFFPRCYCLGAEDDKKAFIEDFWLTAARNVLKLVVKSEWKSYPIQAVEEEASGDKQPKKQEKNPVLVSPEFVDEALCACEEYLSNLAHMDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPVTTSPASTPRPSCLLPMYSDTRARSSDDSTASWWALRPCRPQARP

SEQ ID NO: 93472 - protein, 352 aa, Homo sapiens
  Payload ID: 18662
  Gene Name: tubulin tyrosine ligase-like family member 3
  Uniprot ID: Q9Y4R7
  ENSP ID: ENSP00000373338
MDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPVTTSPASTPRPSCLLPMYSDTRARSSDDSTASWWALRPCRPQARP

SEQ ID NO: 93473 - protein, 189 aa, Homo sapiens
  Payload ID: 18662
  Gene Name: tubulin tyrosine ligase-like family member 3
  ENSP ID: ENSP00000389904
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMSRMVQNEIPYFIWTTRRDVLDCRFLSKDQMINHYARAGSFTTKVGLCLNLRNLPWFDEVDANSFFPRCYCLGAEDDKKAFIGKE

SEQ ID NO: 93474 - protein, 915 aa, Homo sapiens
  Payload ID: 18662
  Gene Name: tubulin tyrosine ligase-like family member 3
  ENSP ID: ENSP00000392549
MQGPDAPLLLSARELGPGRRGSASWYRQEGGAVCNWLRKPQPLEPRTSFPSARRSEFRPPRRLPWAGPASAQSEEGHAGGRCQAGSPAPARRLSGAFKTLVPGTHAQGASDTHPLGPPHTPVLDPSPQDGFPVLWRGSSKASHMNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMVGLCLNLRNLPWFDEVDANSFFPRCYCLGAEDDKKAFIEDFWLTAARNVLKLVVKSEWKSYPIQAVEEEASGDKQPKKQEKNPVLVSPEFVDEALCACEEYLSNLAHMDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPAVEVPQYVGIRLLVEGFTIKKPMAMCHRRMGVRPAVPLLTQRGSGEARHHFPSLHTKAQLPSPHVLRHQGQVLRRQHSKLVGTKALSTTGKALRTLPTAKVFISLPPNLDFKVAPSILKPRKAPALLCLRGPQLEVPCCLCPLKSEQFLAPVGRSRPKANSRPDCDKPRAEACPMKRLSPLKPLPLVGTFQRRRGLGDMKLGKPLLRFPTALVLDPTPNKKKQVKYLGLDSIAVGGSRVDGARPCTPGSTARA

SEQ ID NO: 93475 - protein, 115 aa, Homo sapiens
  Payload ID: 18662
  Gene Name: tubulin tyrosine ligase-like family member 3
  ENSP ID: ENSP00000394481
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMSRMVQNEIPY

SEQ ID NO: 93476 - protein, 203 aa, Homo sapiens
  Payload ID: 18662
  Gene Name: tubulin tyrosine ligase-like family member 3
  ENSP ID: ENSP00000395912
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMSRMVQNEIPYFIWTTRRDVLDCRFLSKDQMINHYARAGSFTTKVGLCLNLRNLPWFDEVDANSFFPRCYCLGAEDDKKAFIETGFHCVSQDGLDLLTS

SEQ ID NO: 93477 - protein, 118 aa, Homo sapiens
  Payload ID: 18662
  Gene Name: tubulin tyrosine ligase-like family member 3
  ENSP ID: ENSP00000396606
  MOD_RES (1)..(1): Any amino acid
XLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMRRGRTQAPRHSGPAL

SEQ ID NO: 93478 - protein, 619 aa, Homo sapiens
  Payload ID: 18662
  Gene Name: tubulin tyrosine ligase-like family member 3
  ENSP ID: ENSP00000398097
SRMVQNEIPYFIWTTRRDVLDCRFLSKDQMINHYARAGSFTTKVGLCLNLRNLPWFDEVDANSFFPRCYCLGAEDDKKAFIEDFWLTAARNVLKLVVKSEWKSYPIQAVEEEASGDKQPKKQEKNPVLVSPEFVDEALCACEEYLSNLAHMDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPAVEVPQYVGIRLLVEGFTIKKPMAMCHRRMGVRPAVPLLTQRGSGEGKDSGTPTHSRGIRKFKEVAQGCTAQKGHSWDADPARHHFPSLHTKAQLPSPHVLRHQGQVLRRQHSKLVGTKALSTTGKALRTLPTAKVFISLPPNLDFKVAPSILKPRKVGLDL

SEQ ID NO: 93479 - protein, 116 aa, Homo sapiens
  Payload ID: 18662
  Gene Name: tubulin tyrosine ligase-like family member 3
  ENSP ID: ENSP00000398996
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMASCAWTTWRRC

SEQ ID NO: 93480 - protein, 193 aa, Homo sapiens
  Payload ID: 18662
  Gene Name: tubulin tyrosine ligase-like family member 3
  ENSP ID: ENSP00000399191
  MOD_RES (1)..(1): Any amino acid
XKFDDLDGTHALMSRMVQNEIPYFIWTTRRDVLDCRFLSKDQMINHYARAGSFTTKVGLCLNLRNLPWFDEVDANSFFPRCYCLGAEDDKKAFIGDKQPKKQEKNPVLVSPEFVDEALCACEEYLSNLAHMDIDKDLEAPLYLTPEGWSLFLQRYYQVVHEGAELRHLDTQVQRCEDILQQLQAVVPQIDMEG

SEQ ID NO: 93481 - protein, 140 aa, Homo sapiens
  Payload ID: 18662
  Gene Name: tubulin tyrosine ligase-like family member 3
  ENSP ID: ENSP00000399782
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMSRMVQNEIPYFIWTTRRDVLDCRFLSKDQMINHYA

SEQ ID NO: 93482 - protein, 112 aa, Homo sapiens
  Payload ID: 18662
  Gene Name: tubulin tyrosine ligase-like family member 3
  ENSP ID: ENSP00000399930
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMSRMVQNE

SEQ ID NO: 93483 - protein, 122 aa, Homo sapiens
  Payload ID: 18662
  Gene Name: tubulin tyrosine ligase-like family member 3
  ENSP ID: ENSP00000400462
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMSRMVQNEIPYFIWTTRR

SEQ ID NO: 93484 - protein, 109 aa, Homo sapiens
  Payload ID: 18662
  Gene Name: tubulin tyrosine ligase-like family member 3
  ENSP ID: ENSP00000401686
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMVGLC

SEQ ID NO: 93485 - protein, 148 aa, Homo sapiens
  Payload ID: 18662
  Gene Name: tubulin tyrosine ligase-like family member 3
  ENSP ID: ENSP00000402197
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMSRMVQNEIPYFIWTTRRDVLDCRFLSKDQMINHYARAGSFTTK

SEQ ID NO: 93486 - protein, 434 aa, Homo sapiens
  Payload ID: 18662
  Gene Name: tubulin tyrosine ligase-like family member 3
  Uniprot ID: Q9Y4R7
  ENSP ID: ENSP00000403874
MDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPAVEVPQYVGIRLLVEGFTIKKPMAMCHRRMGVRPAVPLLTQRGSGEARHHFPSLHTKAQLPSPHVLRHQGQVLRRQHSKLVGTKALSTTGKALRTLPTAKVFISLPPNLDFKVAPSILKPRKVGLDL

SEQ ID NO: 93487 - protein, 160 aa, Homo sapiens
  Payload ID: 18662
  Gene Name: tubulin tyrosine ligase-like family member 3
  ENSP ID: ENSP00000408128
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMVGLCLNLRNLPWFDEVDANSFFPRCYCLGAEDDKKAFIEDFWLTAARNVLKLVVK

SEQ ID NO: 93488 - protein, 352 aa, Homo sapiens; identical to SEQ ID NO: 93472
  Payload ID: 18662
  Gene Name: tubulin tyrosine ligase-like family member 3
  Uniprot ID: Q9Y4R7
  ENSP ID: ENSP00000409246

SEQ ID NO: 93489 - protein, 326 aa, Homo sapiens
  Payload ID: 18662
  Gene Name: tubulin tyrosine ligase-like family member 3
  ENSP ID: ENSP00000409632
MDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQGPAPNMQVSPERNAPLCPAP

SEQ ID NO: 93490 - protein, 161 aa, Homo sapiens
  Payload ID: 18662
  Gene Name: tubulin tyrosine ligase-like family member 3
  ENSP ID: ENSP00000412915
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMVDANSFFPRCYCLGAEDDKKAFIEDFWLTAARNVLKLVVKSEWKSYPIQAVEEEAS

SEQ ID NO: 93491 - protein, 151 aa, Homo sapiens
  Payload ID: 18662
  Gene Name: tubulin tyrosine ligase-like family member 3
  ENSP ID: ENSP00000414965
MNRLRNAKIYVERAVKKKIFTIQGCYPVIRCLLRRRGWVEKKMVHRSGPTLLPPQKDLDSSAMGDSDTTEDEDEDEDEEFQPSQLFDFDDLLKFDDLDGTHALMSRMVQNEIPYFIWTTRRDVLDCRFLSKDQMINHYARAGSFTTKVGLC

SEQ ID NO: 93492 - protein, 108 aa, Homo sapiens
  Payload ID: 18662
  Gene Name: tubulin tyrosine ligase-like family member 3
  ENSP ID: ENSP00000430051
MDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGNPSP

SEQ ID NO: 93493 - protein, 181 aa, Homo sapiens
  Payload ID: 18662
  Gene Name: tubulin tyrosine ligase-like family member 3
  ENSP ID: ENSP00000473314
  MOD_RES (1)..(1): Any amino acid
XTVQCRKASFELYGADFVFGEDFQPWLIEINASPTMAPSTAVTARLCAGVQADTLRVVIDRMLDRNCDTGAFELIYKQAPALLCLRGPQLEVPCCLCPLKSEQFLAPVGRSRPKANSRPDCDKPRAEACPMKRLSPLKPLPLVGTFQRRRGLGDMKLGKPLLRFPTALVLDPTPNKKKQVK

SEQ ID NO: 93494 - protein, 70 aa, Homo sapiens
  Payload ID: 18662
  Gene Name: tubulin tyrosine ligase-like family member 3
  ENSP ID: ENSP00000473376
  MOD_RES (1)..(1): Any amino acid
XKFDDLDGTHALMSRMVQNEIPYFIWTTRRDVLDCRFLSKDQMINHYARAGSFTTKRRGFTVLARMVSIS

SEQ ID NO: 93495 - protein, 27 aa, Homo sapiens
  Payload ID: 18662
  Gene Name: tubulin tyrosine ligase-like family member 3
  ENSP ID: ENSP00000473440
LKFDDLDGTHALMRRGFTVLARMVSIS

SEQ ID NO: 93496 - protein, 1199 aa, Homo sapiens
  Payload ID: 18663
  Gene Name: tubulin tyrosine ligase-like family member 4
  Uniprot ID: Q14679
  ENSP ID: ENSP00000258398
MASAGTQHYSIGLRQKNSFKQSGPSGTVPATPPEKPSEGRVWPQAHQQVKPIWKLEKKQVETLSAGLGPGLLGVPPQPAYFFCPSTLCSSGTTAVIAGHSSSCYLHSLPDLFNSTLLYRRSSYRQKPYQQLESFCLRSSPSEKSPFSLPQKSLPVSLTANKATSSMVFSMAQPMASSSTEPYLCLAAAGENPSGKSLASAISGKIPSPLSSSYKPMLNNNSFMWPNSTPVPLLQTTQGLKPVSPPKIQPVSWHHSGGTGDCAPQPVDHKVPKSIGTVPADASAHIALSTASSHDTSTTSVASSWYNRNNLAMRAEPLSCALDDSSDSQDPTKEIRFTEAVRKLTARGFEKMPRQGCQLEQSSFLNPSFQWNVLNRSRRWKPPAVNQQFPQEDAGSVRRVLPGASDTLGLDNTVFCTKRISIHLLASHASGLNHNPACESVIDSSAFGEGKAPGPPFPQTLGIANVATRLSSIQLGQSEKERPEEARELDSSDRDISSATDLQPDQAETEDTEEELVDGLEDCCSRDENEEEEGDSECSSLSAVSPSESVAMISRSCMEILTKPLSNHEKVVRPALIYSLFPNVPPTIYFGTRDERVEKLPWEQRKLLRWKMSTVTPNIVKQTIGRSHFKISKRNDDWLGCWGHHMKSPSFRSIREHQKLNHFPGSFQIGRKDRLWRNLSRMQSRFGKKEFSFFPQSFILPQDAKLLRKAWESSSRQKWIVKPPASARGIGIQVIHKWSQLPKRRPLLVQRYLHKPYLISGSKFDLRIYVYVTSYDPLRIYLFSDGLVRFASCKYSPSMKSLGNKFMHLTNYSVNKKNAEYQANADEMACQGHKWALKALWNYLSQKGVNSDAIWEKIKDVVVKTIISSEPYVTSLLKMYVRRPYSCHELFGFDIMLDENLKPWVLEVNISPSLHSSSPLDISIKGQMIRDLLNLAGFVLPNAEDIISSPSSCSSSTTSLPTSPGDKCRMAPEHVTAQKMKKAYYLTQKIPDQDFYASVLDVLTPDDVRILVEMEDEFSRRGQFERIFPSHISSRYLRFFEQPRYFNILTTQWEQKYHGNKLKGVDLLRSWCYKGFHMGVVSDSAPVWSLPTSLLTISKDDVILNAFSKSETSKLGKQSSCEVSLLLSEDGTTPKSKKTQAGLSPYPQKPSSSKDSEDTSKEPSLSTQTLPVIKCSGQTSRLSASSTFQSISDSLLAVSP

SEQ ID NO: 93497 - protein, 1199 aa, Homo sapiens; identical to SEQ ID NO: 93496
  Payload ID: 18663
  Gene Name: tubulin tyrosine ligase-like family member 4
  Uniprot ID: Q14679
  ENSP ID: ENSP00000375951

SEQ ID NO: 93498 - protein, 174 aa, Homo sapiens
  Payload ID: 18663
  Gene Name: tubulin tyrosine ligase-like family member 4
  ENSP ID: ENSP00000391342
MASAGTQHYSIGLRQKNSFKQSGPSGTVPATPPEKPSEGRVWPQAHQQVKPIWKLEKKQVETLSAGLGPGLLGVPPQPAYFFCPSTLCSSGTTAVIAGHSSSCYLHSLPDLFNSTLLYRRSSYRQKPYQQLESFCLRSSPSEKSPFSLPQKSLPVSLTANKATSSMVFSMAQPM

SEQ ID NO: 93499 - protein, 194 aa, Homo sapiens
  Payload ID: 18663
  Gene Name: tubulin tyrosine ligase-like family member 4
  ENSP ID: ENSP00000392103
  MOD_RES (1)..(1): Any amino acid
XRKDRLWRNLSRMQSRFGKKEFSFFPQSFILPQDAKLLRKAWESSSRQKWIVKPPASARGIGIQVIHKWSQLPKRRPLLVQRYLHKPYLISGSKFDLRIYVYVTSYDPLRIYLFSDGLVRFASCKALKALWNYLSQKGVNSDAIWEKIKDVVVKTIISSEPYVTSLLKMYVRRPYSCHELFGFDIMLDENLKPW

SEQ ID NO: 93500 - protein, 973 aa, Homo sapiens
  Payload ID: 18663
  Gene Name: tubulin tyrosine ligase-like family member 4
  ENSP ID: ENSP00000393332
MVFSMAQPMASSSTEPYLCLAAAGENPSGKSLASAISGKIPSPLSSSYKPMLNNNSFMWPNSTPVPLLQTTQGLKPVSPPKIQPVSWHHSGGTGDCAPQPVDHKVPKSIGTVPADASAHIALSTASSHDTSTTSVASSWYNRNNLAMRAEPLSCALDDSSDSQDPTKEIRFTEAVRKLTARGFEKMPRQGCQLEQSSFLNPSFQWNVLNRSRRWKPPAVNQQFPQEDAGSVRRVLPGASDTLGLDNTVFCTKRISIHLLASHASGLNHNPACESVIDSSAFGEGKAPGPPFPQTLGIANVATRLSSIQLGQSEKERPEEARELDSSDRDISSATDLQPDQAETEDTEEELVDGLEDCCSRDENEEEEGDSECSSLSAVSPSESVAMISRSCMEILTKPLSNHEKVVRPALIYSLFPNVPPTIYFGTRDERVEKLPWEQRKLLRWKMSTVTPNIVKQTIGRSHFKISKRNDDWLGCWGHHMKSPSFRSIREHQKLNHFPGSFQIGRKDRLWRNLSRMQSRFGKKEFSFFPQSFILPQDAKLLRKAWESSSRQKWIVKPPASARGIGIQVIHKWSQLPKRRPLLVQRYLHKPYLISGSKFDLRIYVYVTSYDPLRIYLFSDGLVRFASCKYSPSMKSLGNKFMHLTNYSVNKKNAEYQANADEMACQGHKWALKALWNYLSQKGVNSDAIWEKIKDVVVKTIISSEPYVTSLLKMYVRRPYSCHELFGFDIMLDENLKPWVLEVNISPSLHSSSPLDISIKGQMIRDLLNLAGFVLPNAEDIISSPSSCSSSTTSLPTSPGDKCRMAPEHVTAQKMKKAYYLTQKIPDQDFYASVLDVLTPDDVRILVEMEDEFSRRGQFERIFPSHISSRYLRFFEQPRYFNILTTQWEQKYHGNKLKGVDLLRSWCYKGFHMGVVSDSAPVWSLPTSLLTISKDDVILNAFSKSETSKLGNPVPQRTVRTPAKSPAFLPRRYL

SEQ ID NO: 93501 - protein, 1135 aa, Homo sapiens
  Payload ID: 18663
  Gene Name: tubulin tyrosine ligase-like family member 4
  ENSP ID: ENSP00000396555
MASAGTQHYSIGLRQKNSFKQSGPSGTVPATPPEKPSEGRVWPQAHQQVKPIWKLEKKQVETLSAGLGPGLLGVPPQPAYFFCPSTLCSSGTTAVIAGHSSSCYLHSLPDLFNSTLLYRRSSYRQKPYQQLESFCLRSSPSEKSPFSLPQKSLPVSLTANKATSSMVFSMAQPMASSSTEPYLCLAAAGENPSGKSLASAISGKIPSPLSSSYKPMLNNNSFMWPNSTPVPLLQTTQGLKPVSPPKIQPVSWHHSGGTGDCAPQPVDHKVPKSIGTVPADASAHIALSTASSHDTSTTSVASSWYNRNNLAMRAEPLSCALDDSSDSQDPTKEIRFTEAVRKLTARGFEKMPRQGCQLEQSSFLNPSFQWNVLNRSRRWKPPAVNQQFPQEDAGSVRRVLPGASDTLGLDNTVFCTKRISIHLLASHASGLNHNPACESVIDSSAFGEGKAPGPPFPQTLGIANVATRLSSIQLGQSEKERPEEARELDSSDRDISSATDLQPDQAETEDTEEELVDGLEDCCSRDENEEEEGDSECSSLSAVSPSESVAMISRSCMEILTKPLSNHEKVVRPALIYSLFPNVPPTIYFGTRDERVEKLPWEQRKLLRWKMSTVTPNIVKQTIGRSHFKISKRNDDWLGCWGHHMKSPSFRSIREHQKPASARGIGIQVIHKWSQLPKRRPLLVQRYLHKPYLISGSKFDLRIYVYVTSYDPLRIYLFSDGLVRFASCKYSPSMKSLGNKFMHLTNYSVNKKNAEYQANADEMACQGHKWALKALWNYLSQKGVNSDAIWEKIKDVVVKTIISSEPYVTSLLKMYVRRPYSCHELFGFDIMLDENLKPWVLEVNISPSLHSSSPLDISIKGQMIRDLLNLAGFVLPNAEDIISSPSSCSSSTTSLPTSPGDKCRMAPEHVTAQKMKKAYYLTQKIPDQDFYASVLDVLTPDDVRILVEMEDEFSRRGQFERIFPSHISSRYLRFFEQPRYFNILTTQWEQKYHGNKLKGVDLLRSWCYKGFHMGVVSDSAPVWSLPTSLLTISKDDVILNAFSKSETSKLGKQSSCEVSLLLSEDGTTPKSKKTQAGLSPYPQKPSSSKDSEDTSKEPSLSTQTLPVIKCSGQTSRLSASSTFQSISDSLLAVSP

SEQ ID NO: 93502 - protein, 162 aa, Homo sapiens
  Payload ID: 18663
  Gene Name: tubulin tyrosine ligase-like family member 4
  ENSP ID: ENSP00000400068
  MOD_RES (1)..(1): Any amino acid
XAQKMKKAYYLTQKIPDQDFYASVLDVLTPDDVRILVEMEDEFSRRGQFERIFPSHISSRYLRFFEQPRYFNILTTQWEQKYHGNKLKDLLRSWCYKGFHMGVVSDSAPVWSLPTSLLTISKDDVILNAFSKSETSKLGNPVPQRTVRTPAKSPAFLPRRYL

SEQ ID NO: 93503 - protein, 100 aa, Homo sapiens
  Payload ID: 18663
  Gene Name: tubulin tyrosine ligase-like family member 4
  ENSP ID: ENSP00000405485
MASAGTQHYSIGLRQKNSFKQSGPSGTVPATPPEKPSEGRVWPQAHQQVKPIWKLEKKQVETLSAGLGPGLLGVPPQPAYFFCPSTLCSSGTTAVIAGHS

SEQ ID NO: 93504 - protein, 100 aa, Homo sapiens
  Payload ID: 18663
  Gene Name: tubulin tyrosine ligase-like family member 4
  ENSP ID: ENSP00000407434
  MOD_RES (1)..(1): Any amino acid
XNDDWLGCWGHHMKSPSFRSIREHQKLNHFPGSFQIGRKDRLWRNLSRMQSRFGKKEFSFFPQSFILPQDAKLLRKAWESSSRQKWIVKPVFAFHEEPWQ

SEQ ID NO: 93505 - protein, 101 aa, Homo sapiens
  Payload ID: 18663
  Gene Name: tubulin tyrosine ligase-like family member 4
  ENSP ID: ENSP00000411228
MASAGTQHYSIGLRQKNSFKQSGPSGTVPATPPEKPSEGRVWPQAHQQVKPIWKLEKKQVETLSAGLGPGLLGVPPQPAYFFCPSTLCSSGTTAVIAGHSS

SEQ ID NO: 93506 - protein, 179 aa, Homo sapiens
  Payload ID: 18663
  Gene Name: tubulin tyrosine ligase-like family member 4
  ENSP ID: ENSP00000415197
  MOD_RES (1)..(1): Any amino acid
XEILTKPLSNHEKVVRPALIYSLFPNVPPTIYFGTRDERVEKLPWEQRKLLRWKMSTVTPNIVKQTIGRSHFKISKRNDDWLGCWGHHMKSPSFRSIREHQKLNHFPGSFQIGRKDRLWRNLSRMQSRFGKKEFSFFPQSFILPQDAKLLRKAWESSSRQKWIVKPVSTQTLPHQRQQV

SEQ ID NO: 93507 - protein, 246 aa, Homo sapiens
  Payload ID: 18663
  Gene Name: tubulin tyrosine ligase-like family member 4
  ENSP ID: ENSP00000415845
  MOD_RES (1)..(1): Any amino acid
XIKDVVVKTIISSEPYVTSLLKMYVRRPYSCHELFGFDIMLDENLKPWVLEVNISPSLHSSSPLDISIKGQMIRDLLNLAGFVLPNAEDIISSPSSCSSSTTSLPTSPGDKCRMAPEHVTAQKMKKAYYLTQKIPDQDFYASVLDVLTPDDVRILVEMEDEFSRRGVDLLRSWCYKGFHMGVVSDSAPVWSLPTSLLTISKDDVILNAFSKSETSKLGKQSSCEVSLLLSEDGTTPKSKKTQAGLS

SEQ ID NO: 93508 - protein, 269 aa, Homo sapiens
  Payload ID: 18664
  Gene Name: tubulin tyrosine ligase-like family member 5
  Uniprot ID: Q6EMB2
  ENSP ID: ENSP00000286650
MPIVMARDLEETASSSEDEEVISQEDHPCIMWTGGCRRIPVLVFHADAILTKDNNIRVIGERYHLSYKIVRTDSRLVRSILTAHGFHEVHPSSTDYNLMWTGSHLKPFLLRTLSEAQKVNHFPRSYELTRKDRLYKNIIRMQHTHGFKAFHILPQTFLLPAEYAEFCNSYSKDRGPWIVKPVASSRGRGVYLINNPNQISLEENILVSRYINNPLLIDDFKFDVRLYVLVTSYDPLVIYLYEEGLARKCNWKMGNTMDKRRLPIYVQVL

SEQ ID NO: 93509 - protein, 1281 aa, Homo sapiens
  Payload ID: 18664
  Gene Name: tubulin tyrosine ligase-like family member 5
  Uniprot ID: Q6EMB2
  ENSP ID: ENSP00000298832
MPIVMARDLEETASSSEDEEVISQEDHPCIMWTGGCRRIPVLVFHADAILTKDNNIRVIGERYHLSYKIVRTDSRLVRSILTAHGFHEVHPSSTDYNLMWTGSHLKPFLLRTLSEAQKVNHFPRSYELTRKDRLYKNIIRMQHTHGFKAFHILPQTFLLPAEYAEFCNSYSKDRGPWIVKPVASSRGRGVYLINNPNQISLEENILVSRYINNPLLIDDFKFDVRLYVLVTSYDPLVIYLYEEGLARFATVRYDQGAKNIRNQFMHLTNYSVNKKSGDYVSCDDPEVEDYGNKWSMSAMLRYLKQEGRDTTALMAHVEDLIIKTIISAELAIATACKTFVPHRSSCFELYGFDVLIDSTLKPWLLEVNLSPSLACDAPLDLKIKASMISDMFTVVGFVCQDPAQRASTRPIYPTFESSRRNPFQKPQRCRPLSASDAEMKNLVGSAREKGPGKLGGSVLGLSMEEIKVLRRVKEENDRRGGFIRIFPTSETWEIYGSYLEHKTSMNYMLATRLFQDRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASKGSSAEGQLNGLQSSLNPAAFVPITSSTDPAHTKI

SEQ ID NO: 93510 - protein, 1281 aa, Homo sapiens
  Payload ID: 18664
  Gene Name: tubulin tyrosine ligase-like family member 5
  ENSP ID: ENSP00000450713
MPIVMARDLEETASSSEDEEVISQEDHPCIMWTGGCRRIPVLVFHADAILTKDNNIRVIGERYHLSYKIVRTDSRLVRSILTAHGFHEVHPSSTDYNLMWTGSHLKPFLLRTLSEAQKVNHFPRSYELTRKDRLYKNIIRMQHTHGFKAFHILPQTFLLPAEYAEFCNSYSKDRGPWIVKPVASSRGRGVYLINNPNQISLEENILVSRYINNPLLIDDFKFDVRLYVLVTSYDPLVIYLYEEGLARFATVRYDQGAKNIRNQFMHLTNYSVNKKSGDYVSCDDPEVEDYGNKWSMSAMLRYLKQEGRDTTALMAHVEDLIIKTIISAELAIATACKTFVPHRSSCFELYGFDVLIDSTLKPWLLEVNLSPSLACDAPLDLKIKASMISDMFTVVGFVCQDPAQRASTRPIYPTFESSRRNPFQKPQRPVSAQFQSSKAKQRCRPLSASDAEMKNLVGSAREKGPGKLGGSVLGLSMEEIKVLRRVKEENDRRGGFIRIFPTSETWEIYGSYLEHKTSMNYMLATRLFQDRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASNTRFRSSFQNYLWYFFQAVS

SEQ ID NO: 93511 - protein, 124 aa, Homo sapiens
  Payload ID: 18664
  Gene Name: tubulin tyrosine ligase-like family member 5
  ENSP ID: ENSP00000451917
MPIVMARDLEETASSSEDEEVISQEDHPCIMWTGGCRRIPVLVFHADAILTKDNNIRVIGERYHLSYKIVRTDSRLVRSILTAHGFHEVHPSSTDYNLMWTGSHLKPFLLRTLSEAQKVNHFPR

SEQ ID NO: 93512 - protein, 775 aa, Homo sapiens
  Payload ID: 18664
  Gene Name: tubulin tyrosine ligase-like family member 5
  ENSP ID: ENSP00000451946
MNYMLATRLFQDRGNPRRSLLTGRTRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASNTRFRSSFQNYLWYFFQAVS

SEQ ID NO: 93513 - protein, 817 aa, Homo sapiens
  Payload ID: 18664
  Gene Name: tubulin tyrosine ligase-like family member 5
  Uniprot ID: Q6EMB2
  ENSP ID: ENSP00000452524
MEEIKVLRRVKEENDRRGGFIRIFPTSETWEIYGSYLEHKTSMNYMLATRLFQDRGNPRRSLLTGRTRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASNTRFRSSFQNYLWYFFQAVS

SEQ ID NO: 93514 - protein, 60 aa, Homo sapiens
  Payload ID: 18664
  Gene Name: tubulin tyrosine ligase-like family member 5
  ENSP ID: ENSP00000478640
NLLTQQVTNLNLATGIINRSSASAPPTLRPIISPSGPTWSTQSDPQAPENHSSSPGSSFI

SEQ ID NO: 93515 - protein, 185 aa, Homo sapiens
  Payload ID: 18665
  Gene Name: tubulin tyrosine ligase-like family member 6
  ENSP ID: ENSP00000365871
  MOD_RES (1)..(1): Any amino acid
XPMGALLLHPSRRGPAGVVASWTSSPAGRDGGVGIAGAWYFPRASSQAREMPQCPTLESQEGENSEEKGDSSKEDPKETVALAFVRENPGAQNGLQNAQQQGKKKRKKKRMPLKNSRKRRFPCFKKALICPGNLVRLQYDSTILTYQDPTAACAFQFLFNISPCLAPFRLIDEGKLVHFLIHSFP

SEQ ID NO: 93516 - protein, 891 aa, Homo sapiens
  Payload ID: 18665
  Gene Name: tubulin tyrosine ligase-like family member 6
  Uniprot ID: Q8N841
  ENSP ID: ENSP00000377043
MGALLLHPSRRGPAGVVASWTSSPAGRDGGVGIAGAWYFPRASSQAREMPQCPTLESQEGENSEEKGDSSKEDPKETVALAFVRENPGAQNGLQNAQQQGKKKRKKKRLVINLSSCRYESVRRAAQQYGFREGGEDDDWTLYWTDYSVSLERVMEMKSYQKINHFPGMSEICRKDLLARNMSRMLKMFPKDFRFFPRTWCLPADWGDLQTYSRSRKNKTYICKPDSGCQGKGIFITRTVKEIKPGEDMICQLYISKPFIIDGFKFDLRIYVLVTSCDPLRIFVYNEGLARFATTSYSRPCTDNLDDICMHLTNYSINKHSSNFSRDAHSGSKRKLSTFSAYLEDHSYNVEQIWRDIEDVIIKTLISAHPIIRHNYHTCFPNHTLNSACFEILGFDILLDHKLKPWLLEVNHSPSFSTDSRLDKEVKDGLLYDTLVLINLESCDKKKVLEEERQRGQFLQQCCSREMRIEEAKGFRAVQLKKTETYEKENCGGFRLIYPSLNSEKYEKFFQDNNSLFQNTVASRAREEYARQLIQELRLKREKKPFQMKKKVEMQGESAGEQVRKKGMRGWQQKQQQKDKAATQASKQYIQPLTLVSYTPDLLLSVRGERKNETDSSLNQEAPTEEASSVFPKLTSAKPFSSLPDLRNINLSSSKLEPSKPNFSIKEAKSASAVNVFTGTVHLTSVETTPESTTQLSISPKSPPTLAVTASSEYSGPETDRVVSFKCKKQQTPPHLTQKKMLKSFLPTKSKSFWESPNTNWTLLKSDMNKPHLISELLTKLQLSGKLSFFPAHYNPKLGMNNLSQNPSLPGECHSRSDSSGEKRQLDVSSLLLQSPQSYNVTLRDLLVIATPAQLDPRPCRSHASAMRDPCMQDQEAYSHCLISGQKGCERS

SEQ ID NO: 93517 - protein, 584 aa, Homo sapiens
  Payload ID: 18665
  Gene Name: tubulin tyrosine ligase-like family member 6
  Uniprot ID: Q8N841
  ENSP ID: ENSP00000399211
MRIGTPTAGPGPSAVMEGCLGVAELRKLSTFSAYLEDHSYNVEQIWRDIEDVIIKTLISAHPIIRHNYHTCFPNHTLNSACFEILGFDILLDHKLKPWLLEVNHSPSFSTDSRLDKEVKDGLLYDTLVLINLESCDKKKVLEEERQRGQFLQQCCSREMRIEEAKGFRAVQLKKTETYEKENCGGFRLIYPSLNSEKYEKFFQDNNSLFQNTVASRAREEYARQLIQELRLKREKKPFQMKKKVEMQGESAGEQVRKKGMRGWQQKQQQKDKAATQASKQYIQPLTLVSYTPDLLLSVRGERKNETDSSLNQEAPTEEASSVFPKLTSAKPFSSLPDLRNINLSSSKLEPSKPNFSIKEAKSASAVNVFTGTVHLTSVETTPESTTQLSISPKSPPTLAVTASSEYSGPETDRVVSFKCKKQQTPPHLTQKKMLKSFLPTKSKSFWESPNTNWTLLKSDMNKPHLISELLTKLQLSGKLSFFPAHYNPKLGMNNLSQNPSLPGECHSRSDSSGEKRQLDVSSLLLQSPQSYNVTLRDLLVIATPAQLDPRPCRSHASAMRDPCMQDQEAYSHCLISGQKGCERS

SEQ ID NO: 93518 - protein, 27 aa, Homo sapiens
  Payload ID: 18665
  Gene Name: tubulin tyrosine ligase-like family member 6
  ENSP ID: ENSP00000400624
MEGCLGVAELRSTTLQASPPTLGWIKR

SEQ ID NO: 93519 - protein, 48 aa, Homo sapiens
  Payload ID: 18665
  Gene Name: tubulin tyrosine ligase-like family member 6
  ENSP ID: ENSP00000414290
MGALLLHPSRRGPAGVVASWTSSPAGRDGGVGIAEPLEAFRGMLPVGK

SEQ ID NO: 93520 - protein, 208 aa, Homo sapiens
  Payload ID: 18665
  Gene Name: tubulin tyrosine ligase-like family member 6
  ENSP ID: ENSP00000415138
MEGCLGVAELRKLSTFSAYLEDHSYNVEQIWRDIEDVIIKTLISAHPIIRHNYHTCFPNHTLNSACFEILGFDILLDHKLKPWLLEVNHSPSFSTDSRLDKEVKDGLLYDTLVLINLESCDKKKVLEEERQRGQFLQQCCSREMRIEEAKGFRAVQLKKTETYEKENCGGFRLIYPSLNSEKYEKFFQDNNSLFQNTVASRAREEYAR

SEQ ID NO: 93521 - protein, 887 aa, Homo sapiens
  Payload ID: 18666
  Gene Name: tubulin tyrosine ligase-like family member 7
  Uniprot ID: Q6ZT98
  ENSP ID: ENSP00000260505
MPSLPQEGVIQGPSPLDLNTELPYQSTMKRKVRKKKKKGTITANVAGTKFEIVRLVIDEMGFMKTPDEDETSNLIWCDSAVQQEKISELQNYQRINHFPGMGEICRKDFLARNMTKMIKSRPLDYTFVPRTWIFPAEYTQFQNYVKELKKKRKQKTFIVKPANGAMGHGISLIRNGDKLPSQDHLIVQEYIEKPFLMEGYKFDLRIYILVTSCDPLKIFLYHDGLVRMGTEKYIPPNESNLTQLYMHLTNYSVNKHNEHFERDETENKGSKRSIKWFTEFLQANQHDVAKFWSDISELVVKTLIVAEPHVLHAYRMCRPGQPPGSESVCFEVLGFDILLDRKLKPWLLEINRAPSFGTDQKIDYDVKRGVLLNALKLLNIRTSDKRRNLAKQKAEAQRRLYGQNSIKRLLPGSSDWEQQRHQLERRKEELKERLAQVRKQISREEHENRHMGNYRRIYPPEDKALLEKYENLLAVAFQTFLSGRAASFQRELNNPLKRMKEEDILDLLEQCEIDDEKLMGKTTKTRGPKPLCSMPESTEIMKRPKYCSSDSSYDSSSSSSESDENEKEEYQNKKREKQVTYNLKPSNHYKLIQQPSSIRRSVSCPRSISAQSPSSGDTRPFSAQQMISVSRPTSASRSHSLNRASSYMRHLPHSNDACSTNSQVSESLRQLKTKEQEDDLTSQTLFVLKDMKIRFPGKSDAESELLIEDIIDNWKYHKTKVASYWLIKLDSVKQRKVLDIVKTSIRTVLPRIWKVPDVEEVNLYRIFNRVFNRLLWSRGQGLWNCFCDSGSSWESIFNKSPEVVTPLQLQCCQRLVELCKQCLLVVYKYATDKRGSLSGIGPDWGNSRYLLPGSTQFFLRTPTYNLKYNSPGMTRSNVLFTSRYGHL

SEQ ID NO: 93522 - protein, 553 aa, Homo sapiens
  Payload ID: 18666
  Gene Name: tubulin tyrosine ligase-like family member 7
  ENSP ID: ENSP00000432921
MIKSRPLDYTFVPRTWIFPAEYTQFQNYVKELKKKRKQKTFIVKPANGAMGHGISLIRNGDKLPSQDHLIVQEYIEKPFLMEGYKFDLRIYILVTSCDPLKIFLYHDGLVRMGTEKYIPPNESNLTQLYMHLTNYSVNKHNEHFERDETENKGSKRSIKWFTEFLQANQHDVAKFWSDISELVVKTLIVAEPHVLHAYRMCRPGQPPGSESVCFEVLGFDILLDRKLKPWLLEINRAPSFGTDQKIDYDVKRGVLLNALKLLNIRTSDKRRNLAKQKAEAQRRLYGQNSIKRLLPGSSDWEQQRHQLERRKEELKERLAQVRKQISREEHENRHMGNYRRIYPPEDKALLEKYENLLAVAFQTFLSGRAASFQRELNNPLKRMKEEDILDLLEQCEIDDEKLMGKTTKTRGPKPLCSMPESTEIMKRPKYCSSDSSYDSSSSSSESDENEKEEYQNKKREKQVTYNLKPSNHYKLIQQPSSIRRSVSCPRSISAQSPSSGDTRPFSAQQMISVSRPTSASRSHSLNRASSYMRHLPHSNDACSTNSQVIILAQ

SEQ ID NO: 93523 - protein, 477 aa, Homo sapiens
  Payload ID: 18666
  Gene Name: tubulin tyrosine ligase-like family member 7
  ENSP ID: ENSP00000434146
MCRPGQPPGSESVCFEVLGFDILLDRKLKPWLLEINRAPSFGTDQKIDYDVKRGVLLNALKLLNIRTSDKRRNLAKQKAEAQRRLYGQNSIKRLLPGSSDWEQQRHQLERRKEELKERLAQVRKQISREEHENRHMGNYRRIYPPEDKALLEKYENLLAVAFQTFLSGRAASFQRELNNPLKRMKEEDILDLLEQCEIDDEKLMGKTTKTRGPKPLCSMPESTEIMKRPKYCSSDSSYDSSSSSSESDENEKEEYQNKKREKQVTYNLKPSNHYKLIQQPSSIRRSVSCPRSISAQSPSSGDTRPFSAQQMISVSRPTSASRSHSLNRASSYMRHLPHSNDACSTNSQVSESLRQLKTKEQEDDLTSQTLFVLKDMKIRFPGKSDAESELLIEDIIDNWKYHKTKVASYWLIKLDSVKQRKVLDIVKTSIRTVLPRIWKVPDVEEVNLYRIFNRVFNRLLWSRGQGLWNCFCDSGYV

SEQ ID NO: 93524 - protein, 669 aa, Homo sapiens
  Payload ID: 18666
  Gene Name: tubulin tyrosine ligase-like family member 7
  Uniprot ID: Q6ZT98
  ENSP ID: ENSP00000435334
MPSLPQEGVIQGPSPLDLNTELPYQSTMKRKVRKKKKKGTITANVAGTKFEIVRLVIDEMGFMKTPDEDETSNLIWCDSAVQQEKISELQNYQRINHFPGMGEICRKDFLARNMTKMIKSRPLDYTFVPRTWIFPAEYTQFQNYVKELKKKRKQKTFIVKPANGAMGHGISLIRNGDKLPSQDHLIVQEYIEKPFLMEGYKFDLRIYILVTSCDPLKIFLYHDGLVRMGTEKYIPPNESNLTQLYMHLTNYSVNKHNEHFERDETENKGSKRSIKWFTEFLQANQHDVAKFWSDISELVVKTLIVAEPHVLHAYRMCRPGQPPGSESVCFEVLGFDILLDRKLKPWLLEINRAPSFGTDQKIDYDVKRGVLLNALKLLNIRTSDKRRNLAKQKAEAQRRLYGQNSIKRLLPGSSDWEQQRHQLERRKEELKERLAQVRKQISREEHENRHMGNYRRIYPPEDKALLEKYENLLAVAFQTFLSGRAASFQRELNNPLKRMKEEDILDLLEQCEIDDEKLMGKTTKTRGPKPLCSMPESTEIMKRPKYCSSDSSYDSSSSSSESDENEKEEYQNKKREKQVTYNLKPSNHYKLIQQPSSIRRSVSCPRSISAQSPSSGDTRPFSAQQMISVSRPTSASRSHSLNRASSYMRHLPHSNDACSTNSQVIILAQ

SEQ ID NO: 93525 - protein, 543 aa, Homo sapiens
  Payload ID: 18666
  Gene Name: tubulin tyrosine ligase-like family member 7
  ENSP ID: ENSP00000484660
MPSLPQEGVIQGPSPLDLNTELPYQSTMKRKVRKKKKKGTITANVAGTKFEIVRLVIDEMGFMKTPDEDETSNLIWCDSAVQQEKISELQNYQRINHFPGMGEICRKDFLARNMTKMIKSRPLDYTFVPRTWIFPAEYTQFQNYVKELKKKRKQKTFIVKPANGAMGHGISLIRNGDKLPSQDHLIVQEYIEKPFLMEGYKFDLRIYILVTSCDPLKIFLYHDGLVRMGTEKYIPPNESNLTQLYMHLTNYSVNKHNEHFERDETENKGSKRSIKWFTEFLQANQHDVAKFWSDISELVVKTLIVAEPHVLHAYRMCRPGQPPGSESVCFEVLGFDILLDRKLKPWLLEINRAPSFGTDQKIDYDVKRGVLLNALKLLNIRTSDKRRNLAKQKAEAQRRLYGQNSIKRLLPGSSDWEQQRHQLERRKEELKERLAQVRKQISREEHENRHMGNYRRIYPPEDKALLEKYENLLAVAFQTFLSGRAASFQRELNNPLKRMKEEDILDLLEQCEIDDEKLMGKTTKTRGPKGRITHYVVKLFKNT

SEQ ID NO: 93526 - protein, 834 aa, Homo sapiens
  Payload ID: 18667
  Gene Name: tubulin tyrosine ligase-like family member 8
  Uniprot ID: A6PVC2
  ENSP ID: ENSP00000266182
MRLLDGKQTSRYSENACEKKIFSIYGHYPVVRAALRRKGWVEKKFHFLPKVIPDVEDEGARVNDDTCAKVKENQEMALEKTDNIHDVMSRLVKNEMPYLLWTIKRDIIDYHSLTYDQMLNHYAKTASFTTKIGLCVNMRSLPWYVPANPDSFFPRCYSLCTESEQQEFLEDFRRTMASSILKWVVSHQSCSRSSRSKPRDQREEAGSSDLSSRQDAENAEAKLRGLPGQLVDIACKVCQAYLGQLEHEDIDTSADAVEDLTEAEWEDLTQQYYSLVQVPLGSSIVLCIFKIQKVMMSFEPPTARDRQCQALLNRITSVNPQTDIDGLRNIWIIKPAAKSRGRGESPDIVCMDRVEEILELAAADHPLSRDNKWVVQKYIETPLLICDTKFDIRQWFLVTDWNPLTIWFYKESYLRFSTQRFSLDKLDSAIHLCNNAVQKYLKNDVGRSPLLPAHNMWTSTRFQEYLQRQGRGAVWGSVIYPSMKKAIAHAMKVAQDHVEPRKNSFELYGADFVLGRDFRPWLIEINSSPTMHPSTPVTAQLCAQVQEDTIKVAVDRSCDIGNFELLWRQPVVEPPPFSGSDLCVAGVSVRRARRQVLPVCNLKASASLLDAQPLKARGPSAMPDPAQGPPSPALQRDLGLKEEKGLPLALLAPLRGAAESGGAAQPTRTKAAGKVELPACPCRHVDSQAPNTGVPVAQPAKSWDPNQLNAHPLEPVLRGLKTAEGALRPPPGGKGEGTVCSRLPHHGHHVAACQTTGTTWDGGPGVCFLRQLLASELPMGPGLPRDPRAPPCLVCRGLLPPAGPCKRCRSFCAAVLQGASFVRLGGRSCSPRTP

SEQ ID NO: 93527 - protein, 849 aa, Homo sapiens
  Payload ID: 18667
  Gene Name: tubulin tyrosine ligase-like family member 8
  ENSP ID: ENSP00000392252
MEPERKGLSLASSSDGDGREENKLKQGISQDLASSSRLDRYKIARQLTEKAIKEKKIFSIYGHYPVVRAALRRKGWVEKKFHFLPKVIPDVEDEGARVNDDTCAKVKENQEMALEKTDNIHDVMSRLVKNEMPYLLWTIKRDIIDYHSLTYDQMLNHYAKTASFTTKIGLCVNMRSLPWYVPANPDSFFPRCYSLCTESEQQEFLEDFRRTMASSILKWVVSHQSCSRSSRSKPRDQREEAGSSDLSSRQDAENAEAKLRGLPGQLVDIACKVCQAYLGQLEHEDIDTSADAVEDLTEAEWEDLTQQYYSLVHGDAFISNSRNYFSQCQALLNRITSVNPQTDIDGLRNIWIIKPAAKSRGRDIVCMDRVEEILELAAADHPLSRDNKWVVQKYIETPLLICDTKFDIRQWFLVTDWNPLTIWFYKESYLRFSTQRFSLDKLDSAIHLCNNAVQKYLKNDVGRSPLLPAHNMWTSTRFQEYLQRQGRGAVWGSVIYPSMKKAIAHAMKVAQDHVEPRKNSFELYGADFVLGRDFRPWLIEINSSPTMHPSTPVTAQLCAQVQEDTIKVAVDRSCDIGNFELLWRQPVVEPPPFSGSDLCVAGVSVRRARRQVLPVCNLKASASLLDAQPLKARGPSAMPDPAQGPPSPALQRDLGLKEEKGLPLALLAPLRGAAESGGAAQPTRTKAAGKVELPACPCRHVDSQAPNTGVPVAQPAKSWDPNQLNAHPLEPVLRGLKTAEGALRPPPGGKGEGTVCSRLPHHGHHVAACQTTGTTWDGGPGVCFLRQLLASELPMGPGLPRDPRAPPCLVCRGLLPPAGPCKRCRSFCAAVLQGASFVRLGGRSCSPRT

SEQ ID NO: 93528 - protein, 105 aa, Homo sapiens
  Payload ID: 18668
  Gene Name: tubulin tyrosine ligase-like family member 9
  ENSP ID: ENSP00000308980
MVPSREALLGPGTTAIRCPKKLQMTSLYPEKTQRIYKLPELIIQQGHQIQEPKLQGPWIVKGKRARAESIDPVQDHPHEHTHGRPSPQARMGGSEGRRGVGFLLV

SEQ ID NO: 93529 - protein, 105 aa, Homo sapiens; identical to SEQ ID NO: 93528
  Payload ID: 18668
  Gene Name: tubulin tyrosine ligase-like family member 9
  ENSP ID: ENSP00000365086

SEQ ID NO: 93530 - protein, 279 aa, Homo sapiens
  Payload ID: 18668
  Gene Name: tubulin tyrosine ligase-like family member 9
  ENSP ID: ENSP00000365100
MSRPKNQNYKGHGLSKGKEREQRASIRFKTTLMNTLMDVLRHRPGWVEVKDEGEWDFYWCDVSWLRENFDHTYMDEHVRISHFRNHYELTRKNYMVKNLKRFRKQLEREAGKLEAAKCDFFPKTFEMPCEYHLFVEEFRKNPGITWIMKPVARSQGKGIFLFRRLKDIVDWRKDTRSSDDQKDDIPVENYVAQRYIENPYLIGGRKFDLRVYVLVMSMFTSPTWLCKKHLPTTTQRRAASGRCSASGSTWRPNTGPRQWRHSSGTSTTSLSKACRVCRR

SEQ ID NO: 93531 - protein, 439 aa, Homo sapiens
  Payload ID: 18668
  Gene Name: tubulin tyrosine ligase-like family member 9
  Uniprot ID: Q3SXZ7
  ENSP ID: ENSP00000365105
MVPSREALLGPGTTAIRCPKKLQNQNYKGHGLSKGKEREQRASIRFKTTLMNTLMDVLRHRPGWVEVKDEGEWDFYWCDVSWLRENFDHTYMDEHVRISHFRNHYELTRKNYMVKNLKRFRKQLEREAGKLEAAKCDFFPKTFEMPCEYHLFVEEFRKNPGITWIMKPVARSQGKGIFLFRRLKDIVDWRKDTRSSDDQKDDIPVENYVAQRYIENPYLIGGRKFDLRVYVLVMSVFAECLLWSGHRRQDVHLTNVAVQKTSPDYHPKKGCKWTLQRFRQYLASKHGPEAVETLFRDIDNIFVKSLQSVQKVIISDKHCFELYGYDILIDQDLKPWLLEVNASPSLTASSQEDYELKTCLLEDTLHVVDMEARLTGREKRVGGFDLMWNDGPVSREEGAPDLSGMGNFVTNTHLGCVNDRKKQLRQLFCSLQVQKKASS

SEQ ID NO: 93532 - protein, 439 aa, Homo sapiens; identical to SEQ ID NO: 93531
  Payload ID: 18668
  Gene Name: tubulin tyrosine ligase-like family member 9
  Uniprot ID: Q3SXZ7
  ENSP ID: ENSP00000442515

SEQ ID NO: 93533 - protein, 184 aa, Homo sapiens
  Payload ID: 18668
  Gene Name: tubulin tyrosine ligase-like family member 9
  ENSP ID: ENSP00000480102
  MOD_RES (1)..(1): Any amino acid
XLEDTLHVVDMEARLRQRSEETTEAALLLPSSSEESFQLIPSCQEEISLSRCHPGLPPTPRSQHSTSQHSPPHLQPGTSFAGLAAAAYYLNWAPWIPPAHPQASLHQETANHWDWGRFNLDKLTWQLGPKRTNTASSATPRRSYLINEHRPYLESLGTRPGSGDTVGCSQVLLALTLGYLPSQC

SEQ ID NO: 93534 - protein, 225 aa, Homo sapiens
  Payload ID: 18668
  Gene Name: tubulin tyrosine ligase-like family member 9
  ENSP ID: ENSP00000480981
MSRPKNQNYKGHGLSKGKEREQRASIRFKTTLMNTLMDVLRHRPGWVEVKDEGEWDFYWCDVSWLRENFDHTYMDEHVRISHFRNHYELTRKNYMVKNLKRFRKQLEREAGKLEAAKCDFFPKTFEMPCEYHLFVEEFRKNPGITWIMKPVARSQGKGIFLFRRLKDIVDWRKGTTGKSSAAWRPSLPGARSVPLAATTQEALTTRKMIFPWRTMWLSVTLKILT

SEQ ID NO: 93535 - protein, 39 aa, Homo sapiens
  Payload ID: 18668
  Gene Name: tubulin tyrosine ligase-like family member 9
  ENSP ID: ENSP00000481910
  MOD_RES (1)..(1): Any amino acid
XVHLTNVAVQKTSPDYHPKKVAPGGQCVPITDSQQPGRL

SEQ ID NO: 93536 - protein, 341 aa, Homo sapiens
  Payload ID: 18668
  Gene Name: tubulin tyrosine ligase-like family member 9
  ENSP ID: ENSP00000483865
MSRPKMTSLYPEKTQRIYKLPELIIQQGHQIQEPKLQGPWIVKGKRARAESIDPVQDHPHEHTHGRPSPQARMGGSEGDTRSSDDQKDDIPVENYVAQRYIENPYLIGGRKFDLRVYVLVMSYIPLRAWLYRDGFARFSNTRFTLNSIDDQYVHLTNVAVQKTSPDYHPKKGCKWTLQRFRQYLASKHGPEAVETLFRDIDNIFVKSLQSVQKVIISDKHCFELYGYDILIDQDLKPWLLEVNASPSLTASSQEDYELKTCLLEDTLHVVDMEARLTGREKRVGGFDLMWNDGPVSREEGAPDLSGMGNFVTNTHLGCVNDRKKQLRQLFCSLQVQKKASS

SEQ ID NO: 93537 - protein, 225 aa, Homo sapiens; identical to SEQ ID NO: 93534
  Payload ID: 18668
  Gene Name: tubulin tyrosine ligase-like family member 9
  ENSP ID: ENSP00000484993

SEQ ID NO: 93538 - protein, 451 aa, Homo sapiens
  Payload ID: 18669
  Gene Name: tubulin, alpha 1a
  Uniprot ID: Q71U36
  ENSP ID: ENSP00000301071
MRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGVDSVEGEGEEEGEEY

SEQ ID NO: 93539 - protein, 451 aa, Homo sapiens; identical to SEQ ID NO: 93538
  Payload ID: 18669
  Gene Name: tubulin, alpha 1a
  Uniprot ID: Q71U36
  ENSP ID: ENSP00000439020

SEQ ID NO: 93540 - protein, 231 aa, Homo sapiens
  Payload ID: 18669
  Gene Name: tubulin, alpha 1a
  ENSP ID: ENSP00000446613
MRECISIHVGQAGVQIGNACWELYCLEHGIQPDGQMPSDKTIGGGDDSFNTFFSETGAGKHVPRAVFVDLEPTVIGELTSVTQVRSQGAGTGGLSWGAPLVTHPLSLPAPRPSSSSPLLLPHHVLQMKFALAPTASSSTLSNLSQAKKMLPITMPEGTTPLARRSLTSCWTEFASWPTSARVSRASWFSTALVGELVLGSPRCSWNVSQLIMARSPSWSSLFTRRPRFPQL

SEQ ID NO: 93541 - protein, 416 aa, Homo sapiens
  Payload ID: 18669
  Gene Name: tubulin, alpha 1a
  Uniprot ID: Q71U36
  ENSP ID: ENSP00000446637
MPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGVDSVEGEGEEEGEEY

SEQ ID NO: 93542 - protein, 112 aa, Homo sapiens
  Payload ID: 18669
  Gene Name: tubulin, alpha 1a
  ENSP ID: ENSP00000448725
MPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSFGGGTGS

SEQ ID NO: 93543 - protein, 26 aa, Homo sapiens
  Payload ID: 18669
  Gene Name: tubulin, alpha 1a
  ENSP ID: ENSP00000449016
MPSDKTIGGGDDSFNTFFSETGAGKH

SEQ ID NO: 93544 - protein, 219 aa, Homo sapiens
  Payload ID: 18669
  Gene Name: tubulin, alpha 1a
  ENSP ID: ENSP00000450268
MPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLIGQIVSSITASLRFDGALNVDLTE

SEQ ID NO: 93545 - protein, 451 aa, Homo sapiens [sequence omitted]

SEQ ID NO: 93546 - protein, 49 aa, Homo sapiens
  Payload ID: 18670
  Gene Name: tubulin, alpha 1b
  ENSP ID: ENSP00000448045
MHRRGAQERAPGIAHSSCAAEPRPLSLRTDISSALVWPRASCARSCPEM

SEQ ID NO: 93547 - protein, 49 aa, Homo sapiens
  Payload ID: 18670
  Gene Name: tubulin, alpha 1b
  ENSP ID: ENSP00000448648
MPSDKTIGGGDDSFNTFFSETGAGKHVPRAVFVDLEPTVIDEVRTGTYR

SEQ ID NO: 93548 - protein, 246 aa, Homo sapiens
  Payload ID: 18670
  Gene Name: tubulin, alpha 1b
  ENSP ID: ENSP00000449325
MRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQL

SEQ ID NO: 93549 - protein, 81 aa, Homo sapiens
  Payload ID: 18670
  Gene Name: tubulin, alpha 1b
  ENSP ID: ENSP00000449460
MPSDKTIGGGDDSFNTFFSETGAGKHVPRAVFVDLEPTVIDEVRTGTYRQLFHPEQLITGKEDAANNYARGHYTIGKEIID

SEQ ID NO: 93550 - protein, 75 aa, Homo sapiens
  Payload ID: 18670
  Gene Name: tubulin, alpha 1b
  ENSP ID: ENSP00000449748
MPSDKTIGGGDDSFNTFFSETGAGKHVPRAVFVDLEPTVIDEVRTGTYRQLFHPEQLITGKEDAANNYARGHYTI

SEQ ID NO: 93551 - protein, 449 aa, Homo sapiens
  Payload ID: 18671
  Gene Name: tubulin, alpha 1c
  Uniprot ID: Q9BQE3
  ENSP ID: ENSP00000301072
MRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLTVAEITNACFEPANQMVKCDPRHGKYMACCLLYRGDVVPKDVNAAIATIKTKRTIQFVDWCPTGFKVGINYQPPTVVPGGDLAKVQRAVCMLSNTTAVAEAWARLDHKFDLMYAKRAFVHWYVGEGMEEGEFSEAREDMAALEKDYEEVGADSADGEDEGEEY

SEQ ID NO: 93552 - protein, 519 aa, Homo sapiens
  Payload ID: 18671
  Gene Name: tubulin, alpha 1c
  ENSP ID: ENSP00000443475
MTAWFNGVEELGRDECFVCLELDPSNGSFLNAKLYISNWILIYFTRTLQLPAPFNTCTSSKSRGEPGCDSKRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLTVAEITNACFEPANQMVKCDPRHGKYMACCLLYRGDVVPKDVNAAIATIKTKRTIQFVDWCPTGFKVGINYQPPTVVPGGDLAKVQRAVCMLSNTTAVAEAWARLDHKFDLMYAKRAFVHWYVGEGMEEGEFSEAREDMAALEKDYEEVGADSADGEDEGEEY

SEQ ID NO: 93553 - protein, 88 aa, Homo sapiens
  Payload ID: 18671
  Gene Name: tubulin, alpha 1c
  ENSP ID: ENSP00000447669
MTAWFNGVEELGRDECFVCLELDPSNGSFLNAKLYISNWILIYFTRTLQLPAPFNTCTSSKSRGEPGCDSKCVNPALSLGFRTYKWSS

SEQ ID NO: 93554 - protein, 82 aa, Homo sapiens
  Payload ID: 18671
  Gene Name: tubulin, alpha 1c
  ENSP ID: ENSP00000447910
  MOD_RES (1)..(1): Any amino acid
XNAKLYISNWILIYFTRTLQLPAPFNTCTSSKSRGEPGCDSKSLTLLPRLECSGTILAHCSLRLPGSSDPPASASQVAEITA

SEQ ID NO: 93555 - protein, 130 aa, Homo sapiens
  Payload ID: 18671
  Gene Name: tubulin, alpha 1c
  ENSP ID: ENSP00000448211
MRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLVSIVL

SEQ ID NO: 93556 - protein, 88 aa, Homo sapiens; identical to SEQ ID NO: 93553
  Payload ID: 18671
  Gene Name: tubulin, alpha 1c
  ENSP ID: ENSP00000448646

SEQ ID NO: 93557 - protein, 450 aa, Homo sapiens
  Payload ID: 18672
  Gene Name: tubulin, alpha 3c
  Uniprot ID: Q13748
  ENSP ID: ENSP00000382982
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAANNYARGHYTIGKEIVDLVLDRIRKLADLCTGLQGFLIFHSFGGGTGSGFASLLMERLSVDYGKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGVDSVEAEAEEGEEY

SEQ ID NO: 93558 - protein, 418 aa, Homo sapiens
  Payload ID: 18672
  Gene Name: tubulin, alpha 3c
  Uniprot ID: Q13748
  ENSP ID: ENSP00000482878
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAANNYARGHYTIGKEIVDLVLDRIRKLADLCTGLQGFLIFHSFGGGTGSGFASLLMERLSVDYGKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLDLAALEKDYEEVGVDSVEAEAEEGEEY

SEQ ID NO: 93559 - protein, 450 aa, Homo sapiens; identical to SEQ ID NO: 93557
  Payload ID: 18673
  Gene Name: tubulin, alpha 3d
  Uniprot ID: Q13748
  ENSP ID: ENSP00000326042

SEQ ID NO: 93560 - protein, 450 aa, Homo sapiens
  Payload ID: 18674
  Gene Name: tubulin, alpha 3e
  Uniprot ID: Q6PEY2
  ENSP ID: ENSP00000318197
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAASNYARGHYTIGKEIVDLVLDRIRKLADLCTGLQGFLIFHSFGGGTGSGFASLLMERLSVDYSKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLVHKFDLMYAKWAFVHWYVGEGMEEGEFSEAREDLAALEKDCEEVGVDSVEAEAEEGEAY

SEQ ID NO: 93561 - protein, 448 aa, Homo sapiens
  Payload ID: 18675
  Gene Name: tubulin, alpha 4a
  Uniprot ID: P68366
  ENSP ID: ENSP00000248437
MRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 93562 - protein, 433 aa, Homo sapiens
  Payload ID: 18675
  Gene Name: tubulin, alpha 4a
  Uniprot ID: P68366
  ENSP ID: ENSP00000375938
MGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 93563 - protein, 153 aa, Homo sapiens
  Payload ID: 18675
  Gene Name: tubulin, alpha 4a
  ENSP ID: ENSP00000396061
MGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLE

SEQ ID NO: 93564 - protein, 156 aa, Homo sapiens
  Payload ID: 18675
  Gene Name: tubulin, alpha 4a
  ENSP ID: ENSP00000396212
MERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRH

SEQ ID NO: 93565 - protein, 119 aa, Homo sapiens
  Payload ID: 18675
  Gene Name: tubulin, alpha 4a
  ENSP ID: ENSP00000404740
MKVRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDP

SEQ ID NO: 93566 - protein, 180 aa, Homo sapiens
  Payload ID: 18675
  Gene Name: tubulin, alpha 4a
  ENSP ID: ENSP00000408194
MGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTL

SEQ ID NO: 93567 - protein, 198 aa, Homo sapiens
  Payload ID: 18675
  Gene Name: tubulin, alpha 4a
  ENSP ID: ENSP00000416992
MAPILPGTRRVTSGASPQVPLPFWRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAP

SEQ ID NO: 93568 - protein, 241 aa, Homo sapiens
  Payload ID: 18676
  Gene Name: tubulin, alpha 4b
  Uniprot ID: Q9H853
  ENSP ID: ENSP00000487719
MRHQQTERQDPSQPLSRQHGTYRQIFHPEQLITGKEDAANNYAWGHYTIGKEFIDLLLDRIRKLADQCTGLQGFLVFHSLGRGTGSDVTSFLMEWLSVNYGKKSKLGFSIYPAPQVSTAMVQPYNSILTTHTTLEHSDCAFMVDNKAIYDICHCNLDIERPTYTNLNRLISQIVSSITASLRFDGALNVDLTEFQTNLVSYLTSTSPWPPMHQSSLQKRYTTSSCWWQRLPMPALSLPTRW

SEQ ID NO: 93569 - protein, 383 aa, Homo sapiens
  Payload ID: 18677
  Gene Name: tubulin, alpha 8
  Uniprot ID: Q9NY65
  ENSP ID: ENSP00000318575
MIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGTDSFEEENEGEEF

SEQ ID NO: 93570 - protein, 449 aa, Homo sapiens
  Payload ID: 18677
  Gene Name: tubulin, alpha 8
  Uniprot ID: Q9NY65
  ENSP ID: ENSP00000333326
MRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGTDSFEEENEGEEF

SEQ ID NO: 93571 - protein, 47 aa, Homo sapiens
  Payload ID: 18677
  Gene Name: tubulin, alpha 8
  ENSP ID: ENSP00000407624
MIDLEPTVVDEVRAGTYRQLFHPEQLITGKEDAANNYARGHYTVGKE

SEQ ID NO: 93572 - protein, 467 aa, Homo sapiens
  Payload ID: 18677
  Gene Name: tubulin, alpha 8
  ENSP ID: ENSP00000412646
MLWGCRAKACWGPRLSDLVASLSPQRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGTDSFEEE

SEQ ID NO: 93573 - protein, 275 aa, Homo sapiens
  Payload ID: 18677
  Gene Name: tubulin, alpha 8
  ENSP ID: ENSP00000477306
  MOD_RES (1)..(1): Any amino acid
XFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKVGINYQPPTVVPGGDLAKVQRAVCMLSNTTAIAEAWARLDHKFDLMYAKRAFVHCQRIQLGISCSSMTSLVSASLEPFLKAVFDFHESFEDGRPADLQNAPRFGLARTRVLAKGFRLLTFDGNSTEVIPRWLHSVLWWHAIPVFPALMTFLYRIFTLITFFIVIM

SEQ ID NO: 93574 - protein, 446 aa, Homo sapiens
  Payload ID: 18678
  Gene Name: tubulin, alpha-like 3
  Uniprot ID: A6NHL2
  ENSP ID: ENSP00000369784
MRECLSIHIGQAGIQIGDACWELYCLEHGIQPNGVVLDTQQDQLENAKMEHTNASFDTFFCETRAGKHVPRALFVDLEPTVIDGIRTGQHRSLFHPEQLLSGKEDAANNYARGRYSVGSEVIDLVLERTRKLAEQCGGLQGFLIFRSFGGGTGSGFTSLLMERLTGEYSRKTKLEFSVYPAPRISTAVVEPYNSVLTTHSTTEHTDCTFMVDNEAVYDICHRKLGVECPSHASINRLVVQVVSSITASLRFEGPLNVDLIEFQTNLVPYPRIHFPMTAFAPIVSADKAYHEQFSVSDITTACFESSNQLVKCDPRLGKYMACCLLYRGDVVPKEVNAAIAATKSRHSVQFVDWCPTGFKVGINNRPPTVMPGGDLAKVHRSICMLSNTTAIVEAWARLDHKFDLMYAKRAFLHWYLREGMEEAEFLEAREDLAALERDYEEVAQSF

SEQ ID NO: 93575 - protein, 406 aa, Homo sapiens
  Payload ID: 18678
  Gene Name: tubulin, alpha-like 3
  Uniprot ID: A6NHL2
  ENSP ID: ENSP00000418799
MDQLENAKMEHTNASFDTFFCETRAGKHVPRALFVDLEPTVIDGIRTGQHRSLFHPEQLLSGKEDAANNYARGRYSVGSEVIDLVLERTRKLAEQCGGLQGFLIFRSFGGGTGSGFTSLLMERLTGEYSRKTKLEFSVYPAPRISTAVVEPYNSVLTTHSTTEHTDCTFMVDNEAVYDICHRKLGVECPSHASINRLVVQVVSSITASLRFEGPLNVDLIEFQTNLVPYPRIHFPMTAFAPIVSADKAYHEQFSVSDITTACFESSNQLVKCDPRLGKYMACCLLYRGDVVPKEVNAAIAATKSRHSVQFVDWCPTGFKVGINNRPPTVMPGGDLAKVHRSICMLSNTTAIVEAWARLDHKFDLMYAKRAFLHWYLREGMEEAEFLEAREDLAALERDYEEVAQSF

SEQ ID NO: 93576 - protein, 451 aa, Homo sapiens
  Payload ID: 18679
  Gene Name: tubulin, beta 1 class VI
  Uniprot ID: Q9H4B7
  ENSP ID: ENSP00000217133
MREIVHIQIGQCGNQIGAKFWEMIGEEHGIDLAGSDRGASALQLERISVYYNEAYGRKYVPRAVLVDLEPGTMDSIRSSKLGALFQPDSFVHGNSGAGNNWAKGHYTEGAELIENVLEVVRHESESCDCLQGFQIVHSLGGGTGSGMGTLLMNKIREEYPDRIMNSFSVMPSPKVSDTVVEPYNAVLSIHQLIENADACFCIDNEALYDICFRTLKLTTPTYGDLNHLVSLTMSGITTSLRFPGQLNADLRKLAVNMVPFPRLHFFMPGFAPLTAQGSQQYRALSVAELTQQMFDARNTMAACDLRRGRYLTVACIFRGKMSTKEVDQQLLSVQTRNSSCFVEWIPNNVKVAVCDIPPRGLSMAATFIGNNTAIQEIFNRVSEHFSAMFKRKAFVHWYTSEGMDINEFGEAENNIHDLVSEYQQFQDAKAVLEEDEEVTEEAEMEPEDKGH

SEQ ID NO: 93577 - protein, 445 aa, Homo sapiens
  Payload ID: 18680
  Gene Name: tubulin, beta 2A class IIa
  Uniprot ID: Q13885
  ENSP ID: ENSP00000369703
MREIVHIQAGQCGNQIGAKFWEVISDEHGIDPTGSYHGDSDLQLERINVYYNEAAGNKYVPRAILVDLEPGTMDSVRSGPFGQIFRPDNFVFGQSGAGNNWAKGHYTEGAELVDSVLDVVRKESESCDCLQGFQLTHSLGGGTGSGMGTLLISKIREEYPDRIMNTFSVMPSPKVSDTVVEPYNATLSVHQLVENTDETYSIDNEALYDICFRTLKLTTPTYGDLNHLVSATMSGVTTCLRFPGQLNADLRKLAVNMVPFPRLHFFMPGFAPLTSRGSQQYRALTVPELTQQMFDSKNMMAACDPRHGRYLTVAAIFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATADEQGEFEEEEGEDEA

SEQ ID NO: 93578 - protein, 445 aa, Homo sapiens [sequence omitted]

SEQ ID NO: 93579 - protein, 450 aa, Homo sapiens
  Payload ID: 18682
  Gene Name: tubulin, beta 3 class III
  Uniprot ID: Q13509
  ENSP ID: ENSP00000320295
MREIVHIQAGQCGNQIGAKFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLAVNMVPFPRLHFFMPGFAPLTARGSQQYRALTVPELTQQMFDAKNMMAACDPRHGRYLTVATVFRGRMSMKEVDEQMLAIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 93580 - protein, 189 aa, Homo sapiens
  Payload ID: 18682
  Gene Name: tubulin, beta 3 class III
  ENSP ID: ENSP00000450538
MDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLAVNMVPFP

SEQ ID NO: 93581 - protein, 164 aa, Homo sapiens
  Payload ID: 18682
  Gene Name: tubulin, beta 3 class III
  ENSP ID: ENSP00000450765
MREIVHIQAGQCGNQIGAKFWEVISDEHGIDPSGNYVGDSDLQLERISVYYNEASSHKYVPRAILVDLEPGTMDSVRSGAFGHLFRPDNFIFGKFPLLQALMADPITGKPRSVDGDGCEKQGMVSSSHDPEWWELISPFYSWALEAQRKGSVGRTETTHAFQVE

SEQ ID NO: 93582 - protein, 118 aa, Homo sapiens
  Payload ID: 18682
  Gene Name: tubulin, beta 3 class III
  ENSP ID: ENSP00000450822
MREIVHIQAGQCGNQIGAKFWEVISDEHGIDPSGNYVGDSDLQLERISVYYNEASSHKYVPRAILVDLEPGTMDSVRSGAFGHLFRPDNFIFAGHWRPRERVLWGEQKPLMHFKWNEV

SEQ ID NO: 93583 - protein, 55 aa, Homo sapiens
  Payload ID: 18682
  Gene Name: tubulin, beta 3 class III
  ENSP ID: ENSP00000451276
MREIVHIQAGQCGNQIGAKFWEVISDEHGIDPSGNYVGDSDLQLERISVYYNEAS

SEQ ID NO: 93584 - protein, 148 aa, Homo sapiens
  Payload ID: 18682
  Gene Name: tubulin, beta 3 class III
  ENSP ID: ENSP00000451378
MREIVHIQAGQCGNQIGAKFWEVISDEHGIDPSGNYVGDSDLQLERISVYYNEASSHKYVPRAILVDLEPGTMDSVRSGAFGHLFRPDNFIFAHPAGRCQLASSPQLPGILGWLFGLLALPVGRKVCWSRRADPFTQDPLRRQSLALL

SEQ ID NO: 93585 - protein, 87 aa, Homo sapiens
  Payload ID: 18682
  Gene Name: tubulin, beta 3 class III
  ENSP ID: ENSP00000451465
MREIVHIQAGQCGNQIGAKFWEVISDEHGIDPSGNYVGDSDLQLERISVYYNEASCWSRTPGLKRSTCLGLPKCWECRHEPLHLVDV

SEQ ID NO: 93586 - protein, 378 aa, Homo sapiens
  Payload ID: 18682
  Gene Name: tubulin, beta 3 class III
  Uniprot ID: Q13509
  ENSP ID: ENSP00000451617
MDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLAVNMVPFPRLHFFMPGFAPLTARGSQQYRALTVPELTQQMFDAKNMMAACDPRHGRYLTVATVFRGRMSMKEVDEQMLAIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 93587 - protein, 51 aa, Homo sapiens
  Payload ID: 18682
  Gene Name: tubulin, beta 3 class III
  ENSP ID: ENSP00000451985
MREIVHIQAGQCGNQIGAKLSWEQSPRSTAGTCSRGREVEVAGRERTTPGS

SEQ ID NO: 93588 - protein, 51 aa, Homo sapiens; identical to SEQ ID NO: 93587
  Payload ID: 18682
  Gene Name: tubulin, beta 3 class III
  ENSP ID: ENSP00000452001

SEQ ID NO: 93589 - protein, 46 aa, Homo sapiens
  Payload ID: 18682
  Gene Name: tubulin, beta 3 class III
  ENSP ID: ENSP00000452166
MDSVRSGAFGHLFRPDNFIFGQSGAGNNWAKGHYTEGAELVDSVLD

SEQ ID NO: 93590 - protein, 97 aa, Homo sapiens
  Payload ID: 18682
  Gene Name: tubulin, beta 3 class III
  ENSP ID: ENSP00000452554
MREIVHIQAGQCGNQIGAKFWEVISDEHGIDPSGNYVGDSDLQLERISVYYNEASSHKYVPRAILVDLEPGTMDSVRSGAFGHLFRPDNFIFGPHLL

SEQ ID NO: 93591 - protein, 148 aa, Homo sapiens; identical to SEQ ID NO: 93584
  Payload ID: 18682
  Gene Name: tubulin, beta 3 class III
  ENSP ID: ENSP00000485859

SEQ ID NO: 93592 - protein, 444 aa, Homo sapiens
  Payload ID: 18683
  Gene Name: tubulin, beta 4A class IVa
  Uniprot ID: P04350
  ENSP ID: ENSP00000264071
MREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYTEGAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLSVQSKNSSYFVEWIPNNVKTAVCDIPPRGLKMAATFIGNSTAIQELFKRISEQFTAMFRRKAFLHWYTGEGMDEMEFTEAESNMNDLVSEYQQYQDATAEEGEFEEEAEEEVA

SEQ ID NO: 93593 - protein, 444 aa, Homo sapiens; identical to SEQ ID NO: 93592
  Payload ID: 18683
  Gene Name: tubulin, beta 4A class IVa
  Uniprot ID: P04350
  ENSP ID: ENSP00000443590

SEQ ID NO: 93594 - protein, 110 aa, Homo sapiens
  Payload ID: 18683
  Gene Name: tubulin, beta 4A class IVa
  ENSP ID: ENSP00000468843
MREIVHLQAGQCGNQIGAKFWEVISDEHGIDPTGTYHGDSDLQLERINVYYNEATGGNYVPRAVLVDLEPGTMDSVRSGPFGQIFRPDNFVFVETGFHRVSQDGLDLLTS

SEQ ID NO: 93595 - protein, 109 aa, Homo sapiens
  Payload ID: 18683
  Gene Name: tubulin, beta 4A class IVa
  ENSP ID: ENSP00000469560
MREIVHLQAGQCGNQIGAKFWEVISDEHGIDPTGTYHGDSDLQLERINVYYNEATGGNYVPRAVLVDLEPGTMDSVRSGPFGQIFRPDNFVFGESPSREPEAGKPPYSC

SEQ ID NO: 93596 - protein, 107 aa, Homo sapiens
  Payload ID: 18683
  Gene Name: tubulin, beta 4A class IVa
  ENSP ID: ENSP00000469660
MREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYT

SEQ ID NO: 93597 - protein, 160 aa, Homo sapiens
  Payload ID: 18683
  Gene Name: tubulin, beta 4A class IVa
  ENSP ID: ENSP00000469936
MREIVHLQAGQCGNQIGAKFWEVISDEHGIDPTGTYHGDSDLQLERINVYYNEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVS

SEQ ID NO: 93598 - protein, 157 aa, Homo sapiens
  Payload ID: 18683
  Gene Name: tubulin, beta 4A class IVa
  ENSP ID: ENSP00000470627
MRRGAADRETERLPGAQGPCSAVSAASSTLAAAAAPRARATAAASTLSATAMREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHY

SEQ ID NO: 93599 - protein, 144 aa, Homo sapiens
  Payload ID: 18683
  Gene Name: tubulin, beta 4A class IVa
  ENSP ID: ENSP00000470983
MREIVHLQAGQCGNQIGAKFWEGAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVS

SEQ ID NO: 93600 - protein, 93 aa, Homo sapiens
  Payload ID: 18683
  Gene Name: tubulin, beta 4A class IVa
  ENSP ID: ENSP00000471320
MREIVHLQAHTMGTVTCNWRGSTCTTTRPQEEIMSPERCWWTWNPAPWTLSVLAPSVRSFGRTTSCLANPEPATTGQRGTTRRAQSWWTLSWT

SEQ ID NO: 93601 - protein, 103 aa, Homo sapiens
  Payload ID: 18683
  Gene Name: tubulin, beta 4A class IVa
  ENSP ID: ENSP00000471503
MREIVHLQAGQCGNQIGAKFWEVISDEHGIDPTGTYHGDSDLQLERINVYYNEATGGNYVPRAVLVDLEPGTMDSVRSGPFGQIFRPDNFVFDRVCLSCCHPG

SEQ ID NO: 93602 - protein, 74 aa, Homo sapiens
  Payload ID: 18683
  Gene Name: tubulin, beta 4A class IVa
  ENSP ID: ENSP00000471880
MDSVRSGPFGQIFRPDNFVFGQSGAGNNWAKGHYTEGAELVDAVLDVVRKEAESCDCLQGFQLTHSLGGGTGSG

SEQ ID NO: 93603 - protein, 167 aa, Homo sapiens
  Payload ID: 18683
  Gene Name: tubulin, beta 4A class IVa
  ENSP ID: ENSP00000472375
MRRGAADRETEGPCSAVSAASSTLAAAAAPRARATAAASTLSATAMREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYTEGAELVDAVLDVVRK

SEQ ID NO: 93604 - protein, 155 aa, Homo sapiens
  Payload ID: 18683
  Gene Name: tubulin, beta 4A class IVa
  ENSP ID: ENSP00000472481
MREIVHLQAGQCGNQIGAKFWEVISDEHGIDPTGTYHGDSDLQLERINVYYNEEFPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVP

SEQ ID NO: 93605 - protein, 104 aa, Homo sapiens
  Payload ID: 18683
  Gene Name: tubulin, beta 4A class IVa
  ENSP ID: ENSP00000472795
MREIVHLQAGQCGNQIGAKAHTMGTVTCNWRGSTCTTTRPQEEIMSPERCWWTWNPAPWTLSVLAPSVRSFGRTTSCLANPEPATTGQRGTTRRAQSWWTLSWT

SEQ ID NO: 93606 - protein, 445 aa, Homo sapiens
  Payload ID: 18684
  Gene Name: tubulin, beta 4B class IVb
  Uniprot ID: P68371
  ENSP ID: ENSP00000341289
MREIVHLQAGQCGNQIGAKFWEVISDEHGIDPTGTYHGDSDLQLERINVYYNEATGGKYVPRAVLVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATAEEEGEFEEEAEEEVA

SEQ ID NO: 93607 - protein, 446 aa, Homo sapiens
  Payload ID: 18685
  Gene Name: tubulin, beta 6 class V
  Uniprot ID: Q9BUF5
  ENSP ID: ENSP00000318697
MREIVHIQAGQCGNQIGTKFWEVISDEHGIDPAGGYVGDSALQLERINVYYNESSSQKYVPRAALVDLEPGTMDSVRSGPFGQLFRPDNFIFGQTGAGNNWAKGHYTEGAELVDAVLDVVRKECEHCDCLQGFQLTHSLGGGTGSGMGTLLISKIREEFPDRIMNTFSVMPSPKVSDTVVEPYNATLSVHQLVENTDETYCIDNEALYDICFRTLKLTTPTYGDLNHLVSATMSGVTTSLRFPGQLNADLRKLAVNMVPFPRLHFFMPGFAPLTSRGSQQYRALTVPELTQQMFDARNMMAACDPRHGRYLTVATVFRGPMSMKEVDEQMLAIQSKNSSYFVEWIPNNVKVAVCDIPPRGLKMASTFIGNSTAIQELFKRISEQFSAMFRRKAFLHWFTGEGMDEMEFTEAESNMNDLVSEYQQYQDATANDGEEAFEDEEEEIDG

SEQ ID NO: 93608 - protein, 104 aa, Homo sapiens
  Payload ID: 18685
  Gene Name: tubulin, beta 6 class V
  ENSP ID: ENSP00000465040
MREIVHIQAGQCGNQIGTKFWEVISDEHGIDPAGGYVGDSALQLERINVYYNESSSQKYVPRAALVDLEPGTMDSVRSGPFGQLFRPDNFIFAHLHRGTEEKQE

SEQ ID NO: 93609 - protein, 115 aa, Homo sapiens
  Payload ID: 18685
  Gene Name: tubulin, beta 6 class V
  ENSP ID: ENSP00000465386
MREIVHIQAGQCGNQIGTKFWEVISDEHGIDPAGGYVGDSALQLERINVYYNESSSQKYVPRAALVDLEPGTMDSVRSGPFGQLFRPDNFIFVTFLRATGAGTVSTSAHHIATPA

SEQ ID NO: 93610 - protein, 31 aa, Homo sapiens
  Payload ID: 18685
  Gene Name: tubulin, beta 6 class V
  ENSP ID: ENSP00000465448
  MOD_RES (1)..(1): Any amino acid
XLVDLEPGTMDSVRSGPFGQLFRPDNFIFGV

SEQ ID NO: 93611 - protein, 130 aa, Homo sapiens
  Payload ID: 18685
  Gene Name: tubulin, beta 6 class V
  ENSP ID: ENSP00000465891
MREIVHIQAGQCGNQIGTKFWEVISDEHGIDPAGGYVGDSALQLERINVYYNESSSQKYVPRAALVDLEPGTMDSVRSGPFGQLFRPDNFIFGQTGAGNNWAKGHYTEGAELVDAVLDVVRKECEHCDCL

SEQ ID NO: 93612 - protein, 136 aa, Homo sapiens
  Payload ID: 18685
  Gene Name: tubulin, beta 6 class V
  ENSP ID: ENSP00000466849
MREIVHIQAGQCGNQIGTKFWEVISDEHGIDPAGGYVGDSALQLERINVYYNESSSQKYVPRAALVDLEPGTMDSVRSGPFGQLFRPDNFIFGQTGAGNNWAKGASSSRTRWAAARAQAWARCSSARSVRSSRTAS

SEQ ID NO: 93613 - protein, 141 aa, Homo sapiens
  Payload ID: 18685
  Gene Name: tubulin, beta 6 class V
  ENSP ID: ENSP00000467348
MREIVHIQAGQCGNQIGTKFWEVISDEHGIDPAGGYVGDSALQLERINVYYNESSSQKYVPRAALVDLEPGTMDSVRSGPFGQLFRPDNFIFGMFRQTHIFTHIQWSQLYTLFSTLVFLPGSPATYFEDLSISQVWLPHSC

SEQ ID NO: 93614 - protein, 104 aa, Homo sapiens
  Payload ID: 18685
  Gene Name: tubulin, beta 6 class V
  ENSP ID: ENSP00000467969
MREIVHIQAGQCGNQIGTKFWEVISDEHGIDPAGGYVGDSALQLERINVYYNESSSQKYVPRAALVDLEPGTMDSVRSGPFGQLFRPDNFIFAHHGITSHPPCR

SEQ ID NO: 93615 - protein, 110 aa, Homo sapiens
  Payload ID: 18685
  Gene Name: tubulin, beta 6 class V
  ENSP ID: ENSP00000468179
MREIVHIQAGQCGNQIGTKFWEVISDEHGIDPAGGYVGDSALQLERINVYYNESSSQKYVPRAALVDLEPGTMDSVRSGPFGQLFRPDNFIFATYFEDLSISQVWLPHSC

SEQ ID NO: 93616 - protein, 116 aa, Homo sapiens
  Payload ID: 18685
  Gene Name: tubulin, beta 6 class V
  ENSP ID: ENSP00000468571
MDSVRSGPFGQLFRPDNFIFGQTGAGNNWAKGHYTEGAELVDAVLDVVRKECEHCDCLQGFQLTHSLGGGTGSGMGTLLISKIREEFPDRIMNTFSVMPSPKVSDTVVEPYNATLS

SEQ ID NO: 93617 - protein, 338 aa, Homo sapiens
  Payload ID: 18685
  Gene Name: tubulin, beta 6 class V
  ENSP ID: ENSP00000468777
MREIVHIQAGQCGNQIGTKFWEVISDEHGIDPAGGYVGDSALQLERINVYYNESSCQTGAGNNWAKGHYTEGAELVDAVLDVVRKECEHCDCLQGFQLTHSLGGGTGSGMGTLLISKIREEFPDRIMNTFSVMPSPKVSDTVVEPYNATLSVHQLVENTDETYCIDNEALYDICFRTLKLTTPTYGDLNHLVSATMSGVTTSLRFPGQLNADLRKLAVNMVPFPRLHFFMPGFAPLTSRGSQQYRALTVPELTQQMFDARNMMAACDPRHGRYLTVATVFRGPMSMKEVDEQMLAIQSKNSSYFVEWIPNNVKVAVCDIPPRGLKMASTFIGNSTAIQ

SEQ ID NO: 93618 - protein, 96 aa, Homo sapiens
  Payload ID: 18685
  Gene Name: tubulin, beta 6 class V
  ENSP ID: ENSP00000468820
MREIVHIQAGQCGNQIGTKFWEVISDEHGIDPAGGYVGDSALQLERINVYYNESSSQKYVPRAALVDLEPGTMDSVRSGPFGQLFRPDNFIFELPL

SEQ ID NO: 93619 - protein, 119 aa, Homo sapiens
  Payload ID: 18686
  Gene Name: tubulin, beta 8 class VIII
  ENSP ID: ENSP00000454878
MREIVLTQIGQCGNQIGAKFWEVISDEHAIDSAGTYHGDSHLQLERINVYYNEASGGRYVPRAVLVDLEPGTMDSVRSGPFGQVFRPDNFIFVTGCAVLQVSVGPETTGPRDTTPKARS

SEQ ID NO: 93620 - protein, 89 aa, Homo sapiens
  Payload ID: 18686
  Gene Name: tubulin, beta 8 class VIII
  ENSP ID: ENSP00000454914
MNMPSTPLAPTTGTATCSWSASTCTTTRPAVAGTCPALCSWIWSRAPWTLCARGPSGRSSGQTTSSSVSCGRGLGCGSLARAAQNPGVC

SEQ ID NO: 93621 - protein, 444 aa, Homo sapiens
  Payload ID: 18686
  Gene Name: tubulin, beta 8 class VIII
  Uniprot ID: Q3ZCM7
  ENSP ID: ENSP00000456206
MREIVLTQIGQCGNQIGAKFWEVISDEHAIDSAGTYHGDSHLQLERINVYYNEASGGRYVPRAVLVDLEPGTMDSVRSGPFGQVFRPDNFIFGQCGAGNNWAKGHYTEGAELMESVMDVVRKEAESCDCLQGFQLTHSLGGGTGSGMGTLLLSKIREEYPDRIINTFSILPSPKVSDTVVEPYNATLSVHQLIENADETFCIDNEALYDICSKTLKLPTPTYGDLNHLVSATMSGVTTCLRFPGQLNADLRKLAVNMVPFPRLHFFMPGFAPLTSRGSQQYRALTVAELTQQMFDAKNMMAACDPRHGRYLTAAAIFRGRMPMREVDEQMFNIQDKNSSYFADWLPNNVKTAVCDIPPRGLKMSATFIGNNTAIQELFKRVSEQFTAMFRRKAFLHWYTGEGMDEMEFTEAESNMNDLVSEYQQYQDATAEEEEDEEYAEEEVA

SEQ ID NO: 93622 - protein, 75 aa, Homo sapiens
  Payload ID: 18686
  Gene Name: tubulin, beta 8 class VIII
  ENSP ID: ENSP00000456899
MREIVLTQIGQCGNQIGAKVAGTCPALCSWIWSRAPWTLCARGPSGRSSGQTTSSSVSVGPETTGPRDTTPKARS

SEQ ID NO: 93623 - protein, 407 aa, Homo sapiens
  Payload ID: 18686
  Gene Name: tubulin, beta 8 class VIII
  ENSP ID: ENSP00000457062
MREIVLTQIGQCGNQIGAKFWEVISDEHAIDSAGTYHGDSHLQLERINVYYNEASGQCGAGNNWAKGHYTEGAELMESVMDVVRKEAESCDCLQGFQLTHSLGGGTGSGMGTLLLSKIREEYPDRIINTFSILPSPKVSDTVVEPYNATLSVHQLIENADETFCIDNEALYDICSKTLKLPTPTYGDLNHLVSATMSGVTTCLRFPGQLNADLRKLAVNMVPFPRLHFFMPGFAPLTSRGSQQYRALTVAELTQQMFDAKNMMAACDPRHGRYLTAAAIFRGRMPMREVDEQMFNIQDKNSSYFADWLPNNVKTAVCDIPPRGLKMSATFIGNNTAIQELFKRVSEQFTAMFRRKAFLHWYTGEGMDEMEFTEAESNMNDLVSEYQQYQDATAEEEEDEEYAEEEVA

SEQ ID NO: 93624 - protein, 410 aa, Homo sapiens
  Payload ID: 18686
  Gene Name: tubulin, beta 8 class VIII
  ENSP ID: ENSP00000457610
MNMPSTPLAPTTGTATCSWSASTCTTTRPAVRPPSFPHRPPGNAALPSLMPSRPTQVAGQCGAGNNWAKGHYTEGAELMESVMDVVRKEAESCDCLQGFQLTHSLGGGTGSGMGTLLLSKIREEYPDRIINTFSILPSPKVSDTVVEPYNATLSVHQLIENADETFCIDNEALYDICSKTLKLPTPTYGDLNHLVSATMSGVTTCLRFPGQLNADLRKLAVNMVPFPRLHFFMPGFAPLTSRGSQQYRALTVAELTQQMFDAKNMMAACDPRHGRYLTAAAIFRGRMPMREVDEQMFNIQDKNSSYFADWLPNNVKTAVCDIPPRGLKMSATFIGNNTAIQELFKRVSEQFTAMFRRKAFLHWYTGEGMDEMEFTEAESNMNDLVSEYQQYQDATAEEEEDEEYAEEEVA

SEQ ID NO: 93625 - protein, 444 aa, Homo sapiens
  Payload ID: 18687
  Gene Name: tubulin, beta class I
  Uniprot ID: P07437
  ENSP ID: ENSP00000339001
MREIVHIQAGQCGNQIGAKFWEVISDEHGIDPTGTYHGDSDLQLDRISVYYNEATGGKYVPRAILVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 93626 - protein, 372 aa, Homo sapiens
  Payload ID: 18687
  Gene Name: tubulin, beta class I
  ENSP ID: ENSP00000365578
MDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 93627 - protein, 444 aa, Homo sapiens; identical to SEQ ID NO: 93625
  Payload ID: 18687
  Gene Name: tubulin, beta class I
  Uniprot ID: P07437
  ENSP ID: ENSP00000373058

SEQ ID NO: 93628 - protein, 372 aa, Homo sapiens; identical to SEQ ID NO: 93626
  Payload ID: 18687
  Gene Name: tubulin, beta class I
  ENSP ID: ENSP00000379668

SEQ ID NO: 93629 - protein, 426 aa, Homo sapiens
  Payload ID: 18687
  Gene Name: tubulin, beta class I
  ENSP ID: ENSP00000379672
MFWEVISDEHGIDPTGTYHGDSDLQLDRISVYYNEATGGKYVPRAILVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 93630 - protein, 372 aa, Homo sapiens; identical to SEQ ID NO: 93626
  Payload ID: 18687
  Gene Name: tubulin, beta class I
  ENSP ID: ENSP00000383374

SEQ ID NO: 93631 - protein, 372 aa, Homo sapiens; identical to SEQ ID NO: 93626
  Payload ID: 18687
  Gene Name: tubulin, beta class I
  ENSP ID: ENSP00000383375

SEQ ID NO: 93632 - protein, 426 aa, Homo sapiens; identical to SEQ ID NO: 93629
  Payload ID: 18687
  Gene Name: tubulin, beta class I
  ENSP ID: ENSP00000383378

SEQ ID NO: 93633 - protein, 372 aa, Homo sapiens; identical to SEQ ID NO: 93626
  Payload ID: 18687
  Gene Name: tubulin, beta class I
  ENSP ID: ENSP00000391515

SEQ ID NO: 93634 - protein, 372 aa, Homo sapiens; identical to SEQ ID NO: 93626
  Payload ID: 18687
  Gene Name: tubulin, beta class I
  ENSP ID: ENSP00000392914

SEQ ID NO: 93635 - protein, 372 aa, Homo sapiens; identical to SEQ ID NO: 93626
  Payload ID: 18687
  Gene Name: tubulin, beta class I
  ENSP ID: ENSP00000393340

SEQ ID NO: 93636 - protein, 372 aa, Homo sapiens; identical to SEQ ID NO: 93626
  Payload ID: 18687
  Gene Name: tubulin, beta class I
  ENSP ID: ENSP00000394124

SEQ ID NO: 93637 - protein, 372 aa, Homo sapiens; identical to SEQ ID NO: 93626
  Payload ID: 18687
  Gene Name: tubulin, beta class I
  ENSP ID: ENSP00000394841

SEQ ID NO: 93638 - protein, 372 aa, Homo sapiens; identical to SEQ ID NO: 93626
  Payload ID: 18687
  Gene Name: tubulin, beta class I
  ENSP ID: ENSP00000395838

SEQ ID NO: 93639 - protein, 372 aa, Homo sapiens; identical to SEQ ID NO: 93626
  Payload ID: 18687
  Gene Name: tubulin, beta class I
  ENSP ID: ENSP00000399046

SEQ ID NO: 93640 - protein, 444 aa, Homo sapiens; identical to SEQ ID NO: 93625
  Payload ID: 18687
  Gene Name: tubulin, beta class I
  Uniprot ID: P07437
  ENSP ID: ENSP00000399155

SEQ ID NO: 93641 - protein, 426 aa, Homo sapiens; identical to SEQ ID NO: 93629
  Payload ID: 18687
  Gene Name: tubulin, beta class I
  ENSP ID: ENSP00000399280

SEQ ID NO: 93642 - protein, 426 aa, Homo sapiens; identical to SEQ ID NO: 93629
  Payload ID: 18687
  Gene Name: tubulin, beta class I
  ENSP ID: ENSP00000400108

SEQ ID NO: 93643 - protein, 444 aa, Homo sapiens; identical to SEQ ID NO: 93625
  Payload ID: 18687
  Gene Name: tubulin, beta class I
  Uniprot ID: P07437
  ENSP ID: ENSP00000400663

SEQ ID NO: 93644 - protein, 444 aa, Homo sapiens; identical to SEQ ID NO: 93625
  Payload ID: 18687
  Gene Name: tubulin, beta class I
  Uniprot ID: P07437
  ENSP ID: ENSP00000401317

SEQ ID NO: 93645 - protein, 426 aa, Homo sapiens; identical to SEQ ID NO: 93629
  Payload ID: 18687
  Gene Name: tubulin, beta class I
  ENSP ID: ENSP00000401546

SEQ ID NO: 93646 - protein, 372 aa, Homo sapiens; identical to SEQ ID NO: 93626
  Payload ID: 18687
  Gene Name: tubulin, beta class I
  ENSP ID: ENSP00000403213

SEQ ID NO: 93647 - protein, 426 aa, Homo sapiens; identical to SEQ ID NO: 93629
  Payload ID: 18687
  Gene Name: tubulin, beta class I
  ENSP ID: ENSP00000403868

SEQ ID NO: 93648 - protein, 444 aa, Homo sapiens; identical to SEQ ID NO: 93625
  Payload ID: 18687
  Gene Name: tubulin, beta class I
  Uniprot ID: P07437
  ENSP ID: ENSP00000406811

SEQ ID NO: 93649 - protein, 372 aa, Homo sapiens; identical to SEQ ID NO: 93626
  Payload ID: 18687
  Gene Name: tubulin, beta class I
  ENSP ID: ENSP00000406981

SEQ ID NO: 93650 - protein, 372 aa, Homo sapiens; identical to SEQ ID NO: 93626
  Payload ID: 18687
  Gene Name: tubulin, beta class I
  ENSP ID: ENSP00000407673

SEQ ID NO: 93651 - protein, 426 aa, Homo sapiens; identical to SEQ ID NO: 93629
  Payload ID: 18687
  Gene Name: tubulin, beta class I
  ENSP ID: ENSP00000409249

SEQ ID NO: 93652 - protein, 444 aa, Homo sapiens; identical to SEQ ID NO: 93625
  Payload ID: 18687
  Gene Name: tubulin, beta class I
  Uniprot ID: P07437
  ENSP ID: ENSP00000410071

SEQ ID NO: 93653 - protein, 444 aa, Homo sapiens; identical to SEQ ID NO: 93625
  Payload ID: 18687
  Gene Name: tubulin, beta class I
  Uniprot ID: P07437
  ENSP ID: ENSP00000410829

SEQ ID NO: 93654 - protein, 426 aa, Homo sapiens; identical to SEQ ID NO: 93629
  Payload ID: 18687
  Gene Name: tubulin, beta class I
  ENSP ID: ENSP00000413589

SEQ ID NO: 93655 - protein, 372 aa, Homo sapiens; identical to SEQ ID NO: 93626
  Payload ID: 18687
  Gene Name: tubulin, beta class I
  ENSP ID: ENSP00000414479

SEQ ID NO: 93656 - protein, 372 aa, Homo sapiens; identical to SEQ ID NO: 93626
  Payload ID: 18687
  Gene Name: tubulin, beta class I
  ENSP ID: ENSP00000416480

SEQ ID NO: 93657 - protein, 453 aa, Homo sapiens
  Payload ID: 18688
  Gene Name: tubulin, delta 1
  Uniprot ID: Q9UJT1
  ENSP ID: ENSP00000320797
MSIVTVQLGQCGNQIGFEVFDALLSDSHSSQGLCSMRENEAYQASCKERFFSEEENGVPIARAVLVDMEPKVINQMLSKAAQSGQWKYGQHACFCQKQGSGNNWAYGYSVHGPRHEESIMNIIRKEVEKCDSFSGFFIIMSMAGGTGSGLGAFVTQNLEDQYSNSLKMNQIIWPYGTGEVIVQNYNSILTLSHLYRSSDALLLHENDAIHKICAKLMNIKQISFSDINQVLAHQLGSVFQPTYSAESSFHYRRNPLGDLMEHLVPHPEFKMLSVRNIPHMSENSLAYTTFTWAGLLKHLRQMLISNAKMEEGIDRHVWPPLSGLPPLSKMSLNKDLHFNTSIANLVILRGKDVQSADVEGFKDPALYTSWLKPVNAFNVWKTQRAFSKYEKSAVLVSNSQFLVKPLDMIVGKAWNMFASKAYIHQYTKFGIEEEDFLDSFTSLEQVVASYCNL

SEQ ID NO: 93658 - protein, 398 aa, Homo sapiens
  Payload ID: 18688
  Gene Name: tubulin, delta 1
  Uniprot ID: Q9UJT1
  ENSP ID: ENSP00000342399
MSIVTVQLGQCGNQIGFEVFDALLSDSHSSQGLCSMRENEAYQASCKERFFSEEENGVPIARAVLVDMEPKVINQMLSKAAQSGQWKYGQHACFCQKQGSGNNWAYGYSVHGPRHEESIMNIIRKEVEKCDSFSGFFIIMSMAGGTGSGLGAFVTQNLEDQYSNSLKMNQIIWPYGTGEVIVQNYNSILTLSHLYRSSDALLLHENDAIHKICAKLMNIKQISFSDINQVLAHQLGSVFQPTYSAESSFHYRRNPLGIDRHVWPPLSGLPPLSKMSLNKDLHFNTSIANLVILRGKDVQSADVEGFKDPALYTSWLKPVNAFNVWKTQRAFSKYEKSAVLVSNSQFLVKPLDMIVGKAWNMFASKAYIHQYTKFGIEEEDFLDSFTSLEQVVASYCNL

SEQ ID NO: 93659 - protein, 199 aa, Homo sapiens
  Payload ID: 18688
  Gene Name: tubulin, delta 1
  Uniprot ID: Q9UJT1
  ENSP ID: ENSP00000342561
MSIVTVQLGQCGNQIGFEVFDALLSDSHSSQGLCSMRENEAYQASCKERFFSEEENGGIDRHVWPPLSGLPPLSKMSLNKDLHFNTSIANLVILRGKDVQSADVEGFKDPALYTSWLKPVNAFNVWKTQRAFSKYEKSAVLVSNSQFLVKPLDMIVGKAWNMFASKAYIHQYTKFGIEEEDFLDSFTSLEQVVASYCNL

SEQ ID NO: 93660 - protein, 351 aa, Homo sapiens
  Payload ID: 18688
  Gene Name: tubulin, delta 1
  Uniprot ID: Q9UJT1
  ENSP ID: ENSP00000365262
MSIVTVQLGQCGNQIGFEVFDALLSDSHSSQGLCSMRENEAYQASCKERFFSEEENGVPIARAVLVDMEPKVINQMLSKAAQSGQWKYGQHACFCQKQGSGNNWAYGYSVHGPRHEESIMNIIRKEVEKCDSFSGFFIIMSMAGGTGSGLGAFVTQNLEDQYSNSLKMNQIIWPYGTGEVIVQNYNSILTLSHLYRSSDALLLHENDAIHKICAKLMNIKQISFSDINQVLAHQLGSVFQPTYSAESSFHYRRNPLEGFKDPALYTSWLKPVNAFNVWKTQRAFSKYEKSAVLVSNSQFLVKPLDMIVGKAWNMFASKAYIHQYTKFGIEEEDFLDSFTSLEQVVASYCNL

SEQ ID NO: 93661 - protein, 396 aa, Homo sapiens
  Payload ID: 18688
  Gene Name: tubulin, delta 1
  Uniprot ID: Q9UJT1
  ENSP ID: ENSP00000377785
MSIVTVQLGQCGNQIGFEVFDALLSDSHSSQGLCSMRENEAYQASCKERFFSEEENGVPIARAVLVDMEPKVINQMLSKAAQSGQWKYGQHACFCQKQGSGNNWAYGYSVHGPRHEESIMNIIRKEVEKCDSFSGFFIIMSMAGGTGSGLGAFVTQNLEDQYSNSLKMNQIIWPYGTGEVIVQNYNSILTLSHLYRSSDALLLHENDAIHKICAKLMNIKQISFSDINQVLAHQLGSVFQPTYSAESSFHYRRNPLGDLMEHLVPHPEFKMLSVRNIPHMSENSLAYTTFTWAGLLKHLRQMLISNAKMEEGIDRHVWPPLSGLPPLSKMSLNKDLHFNTSIANLVILRGKDVQSADVGKKFRAYIHQYTKFGIEEEDFLDSFTSLEQVVASYCNL

SEQ ID NO: 93662 - protein, 237 aa, Homo sapiens
  Payload ID: 18688
  Gene Name: tubulin, delta 1
  Uniprot ID: Q9UJT1
  ENSP ID: ENSP00000441757
MNIKQISFSDINQVLAHQLGSVFQPTYSAESSFHYRRNPLGDLMEHLVPHPEFKMLSVRNIPHMSENSLAYTTFTWAGLLKHLRQMLISNAKMEEGIDRHVWPPLSGLPPLSKMSLNKDLHFNTSIANLVILRGKDVQSADVEGFKDPALYTSWLKPVNAFNVWKTQRAFSKYEKSAVLVSNSQFLVKPLDMIVGKAWNMFASKAYIHQYTKFGIEEEDFLDSFTSLEQVVASYCNL

SEQ ID NO: 93663 - protein, 97 aa, Homo sapiens
  Payload ID: 18688
  Gene Name: tubulin, delta 1
  ENSP ID: ENSP00000465579
MEPKVINQMLSKAAQSGQWKYGQHACFCQKQGSGNNWAYGYSVHGPRHEESIMNIIRKEVEKCDSFSGFFIIMSMAGGTGSGLGAFVTQNLEDQYSN

SEQ ID NO: 93664 - protein, 41 aa, Homo sapiens
  Payload ID: 18688
  Gene Name: tubulin, delta 1
  ENSP ID: ENSP00000466681
MEPKVINQMLSKAAQSGQWKYGQHACFCQKQGSGNNWAYGY

SEQ ID NO: 93665 - protein, 53 aa, Homo sapiens
  Payload ID: 18688
  Gene Name: tubulin, delta 1
  ENSP ID: ENSP00000467480
MVVFRGNTPSLWLSMSIVTVQLGQCGNQIGFEVFDALLSDSHSSQGLCSMREN

SEQ ID NO: 93666 - protein, 125 aa, Homo sapiens
  Payload ID: 18688
  Gene Name: tubulin, delta 1
  ENSP ID: ENSP00000467915
MSIVTVQLGQCGNQIGFEVFDALLSDSHSSQGLCSMRENEAYQASCKERFFSEEENGVPIARAVLVDMEPKVINQMLSKAAQSGQWKYGQHACFCQKQGSGNNWAYGRDKDSACYPDWSGTPGLQ

SEQ ID NO: 93667 - protein, 453 aa, Homo sapiens; identical to SEQ ID NO: 93657
  Payload ID: 18688
  Gene Name: tubulin, delta 1
  Uniprot ID: Q9UJT1
  ENSP ID: ENSP00000468518

SEQ ID NO: 93668 - protein, 351 aa, Homo sapiens; identical to SEQ ID NO: 93660
  Payload ID: 18688
  Gene Name: tubulin, delta 1
  Uniprot ID: Q9UJT1
  ENSP ID: ENSP00000480387

SEQ ID NO: 93669 - protein, 475 aa, Homo sapiens
  Payload ID: 18689
  Gene Name: tubulin, epsilon 1
  Uniprot ID: Q9UJT0
  ENSP ID: ENSP00000357651
MTQSVVVQVGQCGNQIGCCFWDLALREHAAVNQKGIYDEAISSFFRNVDTRVVGDGGSISKGKICSLKARAVLIDMEEGVVNEILQGPLRDVFDTKQLITDISGSGNNWAVGHKVFGSLYQDQILEKFRKSAEHCDCLQCFFIIHSMGGGTGSGLGTFLLKVLEDEFPEVYRFVTSIYPSGEDDVITSPYNSILAMKELNEHADCVLPIDNQSLFDIISKIDLMVNSGKLGTTVKPKSLVTSSSGALKKQHKKPFDAMNNIVANLLLNLTSSARFEGSLNMDLNEISMNLVPFPQLHYLVSSLTPLYTLTDVNIPPRRLDQMFSDAFSKDHQLLRADPKHSLYLACALMVRGNVQISDLRRNIERLKPSLQFVSWNQEGWKTSLCSVPPVGHSHSLLALANNTCVKPTFMELKERFMRLYKKKAHLHHYLQVEGMEESCFTEAVSSLSALIQEYDQLDATKNMPVQDLPRLSIAM

SEQ ID NO: 93670 - protein, 220 aa, Homo sapiens
  Payload ID: 18689
  Gene Name: tubulin, epsilon 1
  ENSP ID: ENSP00000474458
MTQSVVVQVGQCGNQIGCCFWDLALREHAAVNQKGIYDEAISSFFRNVDTRVVGDGGSISKGKICSLKARAVLIDMEEGVVNEILQGPLRDVFDTKQLITDISGSGNNWAVGHKVFGSLYQDQILEKFRKSAEHCDCLQCFFIIHSMGGGTGSGLGTFLLKVLEDEFPEVYRFVTSIYPSGEDDVITSPYNSILAMKELNEHADCVLPIDNQNIIYIHSS

SEQ ID NO: 93671 - protein, 54 aa, Homo sapiens
  Payload ID: 18689
  Gene Name: tubulin, epsilon 1
  ENSP ID: ENSP00000474989
MTQSVVVQVGQCGNQIGCCFWDLALREHAAVNQKGIYDEAISSFFRNVDTRKSN

SEQ ID NO: 93672 - protein, 53 aa, Homo sapiens
  Payload ID: 18689
  Gene Name: tubulin, epsilon 1
  ENSP ID: ENSP00000475087
MTQSVVVQVGQCGNQIGCCFWDLALREHAAVNQKGIYDEAISSFFRNVDTRQS

SEQ ID NO: 93673 - protein, 451 aa, Homo sapiens
  Payload ID: 18690
  Gene Name: tubulin, gamma 1
  Uniprot ID: P23258
  ENSP ID: ENSP00000251413
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPNQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFERTCRQYDKLRKREAFLEQFRKEDMFKDNFDEMDTSREIVQQLIDEYHAATRPDYISWGTQEQ

SEQ ID NO: 93674 - protein, 265 aa, Homo sapiens
  Payload ID: 18690
  Gene Name: tubulin, gamma 1
  ENSP ID: ENSP00000464867
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQVVSYSLAGPTTRWGEKIHEDIFDIIDREADGSDSLEGFVLCHSIAGGTGSGLGSYLLERLNDRYPKKLVQTYSVFPNQDEMSDVVVQPYNSLLTLKRLTQNADCVVVLDNTALNRIATDRLHIQNPSFSQINQLVSTIMSASTTTLRYPGYMNND

SEQ ID NO: 93675 - protein, 135 aa, Homo sapiens
  Payload ID: 18690
  Gene Name: tubulin, gamma 1
  ENSP ID: ENSP00000465582
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEVS

SEQ ID NO: 93676 - protein, 451 aa, Homo sapiens
  Payload ID: 18691
  Gene Name: tubulin, gamma 2
  Uniprot ID: Q9NRH3
  ENSP ID: ENSP00000251412
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPYQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFESSCQQFDKLRKRDAFLEQFRKEDMFKDNFDEMDRSREVVQELIDEYHAATQPDYISWGTQEQ

SEQ ID NO: 93677 - protein, 902 aa, Homo sapiens
  Payload ID: 18692
  Gene Name: tubulin, gamma complex associated protein 2
  Uniprot ID: Q9BSJ2
  ENSP ID: ENSP00000252936
MSEFRIHHDVNELLSLLRVHGGDGAEVYIDLLQKNRTPYVTTTVSAHSAKVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRLDFNGFYTERLERLSAERSQKATPQVPVLRGPPAPAPRVAVTAQ

SEQ ID NO: 93678 - protein, 495 aa, Homo sapiens
  Payload ID: 18692
  Gene Name: tubulin, gamma complex associated protein 2
  ENSP ID: ENSP00000357550
MVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRLDFNGFYTERLERLSAERSQKATPQVPVLRGPPAPAPRVAVTAQ

SEQ ID NO: 93679 - protein, 902 aa, Homo sapiens; identical to SEQ ID NO: 93677
  Payload ID: 18692
  Gene Name: tubulin, gamma complex associated protein 2
  Uniprot ID: Q9BSJ2
  ENSP ID: ENSP00000357551

SEQ ID NO: 93680 - protein, 772 aa, Homo sapiens
  Payload ID: 18692
  Gene Name: tubulin, gamma complex associated protein 2
  Uniprot ID: Q9BSJ2
  ENSP ID: ENSP00000395666
MQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRLDFNGFYTERLERLSAERSQKATPQVPVLRGPPAPAPRVAVTAQ

SEQ ID NO: 93681 - protein, 721 aa, Homo sapiens
  Payload ID: 18692
  Gene Name: tubulin, gamma complex associated protein 2
  ENSP ID: ENSP00000436438
MSEFRIHHDVNELLSLLRVHGGDGAEVYIDLLQKNRTPYVTTTVSAHSAKVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASWTPA

SEQ ID NO: 93682 - protein, 930 aa, Homo sapiens
  Payload ID: 18692
  Gene Name: tubulin, gamma complex associated protein 2
  Uniprot ID: Q9BSJ2
  ENSP ID: ENSP00000446093
MSEFRIHHDVNELLSLLRVHGGDGAEVYIDLLQKNRTPYVTTTVSAHSAKVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIVLLRWNLALSPRLKCSGVISAHCNLHLPGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRLDFNGFYTERLERLSAERSQKATPQVPVLRGPPAPAPRVAVTAQ

SEQ ID NO: 93683 - protein, 78 aa, Homo sapiens
  Payload ID: 18692
  Gene Name: tubulin, gamma complex associated protein 2
  ENSP ID: ENSP00000473262
MSEFRIHHDVNELLSLLRVHGGDGAEVYIDLLQKNRTPYVTTTVSAHSAKAGMHVARSCLTAVSTSQADVILPSQLPK

SEQ ID NO: 93684 - protein, 907 aa, Homo sapiens
  Payload ID: 18693
  Gene Name: tubulin, gamma complex associated protein 3
  Uniprot ID: Q96CW5
  ENSP ID: ENSP00000261965
MATPDQKSPNVLLQNLCCRILGRSEADVAQQFQYAVRVIGSNFAPTVERDEFLVAEKIKKELIRQRREADAALFSELHRKLHSQGVLKNKWSILYLLLSLSEDPRRQPSKVSSYATLFAQALPRDAHSTPYYYARPQTLPLSYQDRSAQSAQSSGSVGSSGISSIGLCALSGPAPAPQSLLPGQSNQAPGVGDCLRQQLGSRLAWTLTANQPSSQATTSKGVPSAVSRNMTRSRREGDTGGTMEITEAALVRDILYVFQGIDGKNIKMNNTENCYKVEGKANLSRSLRDTAVRLSELGWLHNKIRRYTDQRSLDRSFGLVGQSFCAALHQELREYYRLLSVLHSQLQLEDDQGVNLGLESSLTLRRLLVWTYDPKIRLKTLAALVDHCQGRKGGELASAVHAYTKTGDPYMRSLVQHILSLVSHPVLSFLYRWIYDGELEDTYHEFFVASDPTVKTDRLWHDKYTLRKSMIPSFMTMDQSRKVLLIGKSINFLHQVCHDQTPTTKMIAVTKSAESPQDAADLFTDLENAFQGKIDAAYFETSKYLLDVLNKKYSLLDHMQAMRRYLLLGQGDFIRHLMDLLKPELVRPATTLYQHNLTGILETAVRATNAQFDSPEILRRLDVRLLEVSPGDTGWDVFSLDYHVDGPIATVFTRECMSHYLRVFNFLWRAKRMEYILTDIRKGHMCNAKLLRNMPEFSGVLHQCHILASEMVHFIHQMQYYITFEVLECSWDELWNKVQQAQDLDHIIAAHEVFLDTIISRCLLDSDSRALLNQLRAVFDQIIELQNAQDAIYRAALEELQRRLQFEEKKKQREIEGQWGVTAAEEEEENKRIGEFKESIPKMCSQLRILTHFYQGIVQQFLVLLTTSSDESLRFLSFRLDFNEHYKAREPRLRVSLGTRGRRSSHT

SEQ ID NO: 93685 - protein, 824 aa, Homo sapiens
  Payload ID: 18693
  Gene Name: tubulin, gamma complex associated protein 3
  Uniprot ID: Q96CW5
  ENSP ID: ENSP00000364821
MATPDQKSPNVLLQNLCCRILGRSEADVAQQFQYAVRVIGSNFAPTVERDEFLVAEKIKKELIRQRREADAALFSELHRKLHSQGVLKNKWSILYLLLSLSEDPRRQPSKVSSYATLFAQALPRDAHSTPYYYARPQTLPLSYQDRSAQSAQSSGSVGSSGISSIGLCALSGPAPAPQSLLPGQSNQAPGVGDCLRQQLGSRLAWTLTANQPSSQATTSKGVPSAVSRNMTRSRREGDTGGTMEITEAALVRDILYVFQGIDGKNIKMNNTENCYKVEGKANLSRSLRDTAVRLSELGWLHNKIRRYTDQRSLDRSFGLVGQSFCAALHQELREYYRLLSVLHSQLQLEDDQGVNLGLESSLTLRRLLVWTYDPKIRLKTLAALVDHCQGRKGGELASAVHAYTKTGDPYMRSLVQHILSLVSHPVLSFLYRWIYDGELEDTYHEFFVASDPTVKTDRLWHDKYTLRKSMIPSFMTMDQSRKVLLIGKSINFLHQVCHDQTPTTKMIAVTKSAESPQDAADLFTDLENAFQGKIDAAYFETSKYLLDVLNKKYSLLDHMQAMRRYLLLGQGDFIRHLMDLLKPELVRPATTLYQHNLTGILETAVRATNAQFDSPEILRRLDVRLLEVSPGDTGWDVFSLDYHVDGPIATVFTRECMSHYLRVFNFLWRAKRMEYILTDIRKGHMCNAKLLRNMPEFSGVLHQCHILASEMVHFIHQMQYYITFEVLECSWDELWNKVQQAQDLDHIIAAHEVFLDTIISRCLLDSDSRALLNQLRAVFDQIIELQNAQDAIYRAALEELQRRLQFEEKKKQREIEVEMCLYCV

SEQ ID NO: 93686 - protein, 439 aa, Homo sapiens
  Payload ID: 18693
  Gene Name: tubulin, gamma complex associated protein 3
  ENSP ID: ENSP00000478276
MATPDQKSPNVLLQNLCCRILGRSEADVAQQFQYAVRVIGSNFAPTVERDEFLVAEKIKKELIRQRREADAALFSELHRKLHSQGVLKNKWSILYLLLSLSEDPRRQPSKVSSYATLFAQALPRDAHSTPYYYARPQTLPLSYQDRSAQSAQSSGSVGSSGISSIGLCALSGPAPAPQSLLPGQSNQAPGVGDCLRQQLGSRLAWTLTANQPSSQATTSKGVPSAVSRNMTRSRREGDTGGTMEITEAALVRDILYVFQGIDGKNIKMNNTENCYKVEGKANLSRSLRDTAVRLSELGWLHNKIRRYTDQRSLDRSFGLVGQSFCAALHQELREYYRLLSVLHSQLQLEDDQGVNLGLESSLTLRRLLVWTYDPKIRLKTLAALVDHCQGPTRVFPTHVFPTRDFPTRDFPTRDFPMHVFPTRVFPTRVWHSLCFRTRL

SEQ ID NO: 93687 - protein, 437 aa, Homo sapiens
  Payload ID: 18693
  Gene Name: tubulin, gamma complex associated protein 3
  ENSP ID: ENSP00000480096
MATPDQKSPNVLLQNLCCRILGRSEADVAQQFQYAVRVIGSNFAPTVERDEFLVAEKIKKELIRQRREADAALFSELHRKLHSQGVLKNKWSILYLLLSLSEDPRRQPSKVSSYATLFAQALPRDAHSTPYYYARPQTLPLSYQDRSAQSAQSSGSVGSSGISSIGLCALSGPAPAPQSLLPGQSNQAPGVGDCLRQQLGSRLAWTLTANQPSSQATTSKGVPSAVSRNMTRSRREGDTGGTMEITEAALVRDILYVFQGIDGKNIKMNNTENCYKVEGKANLSRSLRDTAVRLSELGWLHNKIRRYTDQRSLDRSFGLVGQSFCAALHQELREYYRLLSVLHSQLQLEDDQGVNLGLESSLTLRRLLVWTYDPKIRLKTLAALVDHCQGPTRVFPTHVFPTRDFPTRDFPTRDFPTSFPRVFPTRVWHSLCFRTRL

SEQ ID NO: 93688 - protein, 129 aa, Homo sapiens
  Payload ID: 18693
  Gene Name: tubulin, gamma complex associated protein 3
  ENSP ID: ENSP00000482912
  MOD_RES (1)..(1): Any amino acid
XCAALHQELREYYRLLSVLHSQLQLEDDQGVNLGLESSLTLRRLLVWTYDPKIRLKTLAALVDHCQGRKGGELASAVHAYTKTGDPYMRSLVQHILSLVSHPVLSFLYRWIYDGELEDTYHEVRIGVRF

SEQ ID NO: 93689 - protein, 129 aa, Homo sapiens
  Payload ID: 18693
  Gene Name: tubulin, gamma complex associated protein 3
  ENSP ID: ENSP00000488256
  MOD_RES (1)..(1): Any amino acid
XFSGVLHQCHILASEMVHFIHQMQYYITFEVLECSWDELWNKVQQAQDLDHIIAAHEVFLDTIISRCLLDSDSRALLNQLRAVFDQIIELQNAQDAIYRAALEELQRRLQFEEKKKQREIEVEMCLYCV

SEQ ID NO: 93690 - protein, 212 aa, Homo sapiens
  Payload ID: 18693
  Gene Name: tubulin, gamma complex associated protein 3
  ENSP ID: ENSP00000488264
  MOD_RES (1)..(1): Any amino acid
XFSGVLHQCHILASEMVHFIHQMQYYITFEVLECSWDELWNKVQQAQDLDHIIAAHEVFLDTIISRCLLDSDSRALLNQLRAVFDQIIELQNAQDAIYRAALEELQRRLQFEEKKKQREIEGQWGVTAAEEEEENKRIGEFKESIPKMCSQLRILTHFYQGIVQQFLVLLTTSSDESLRFLSFRLDFNEHYKAREPRLRVSLGTRGRRSSHT

SEQ ID NO: 93691 - protein, 667 aa, Homo sapiens
  Payload ID: 18694
  Gene Name: tubulin, gamma complex associated protein 4
  Uniprot ID: Q9UGJ1
  ENSP ID: ENSP00000260383
MIHELLLALSGYPGSIFTWNKRSGLQVSQDFPFLHPSETSVLNRLCRLGTDYIRFTEFIEQYTGHVQQQDHHPSQQGQGGLHGIYLRAFCTGLDSVLQPYRQALLDLEQEFLGDPHLSISHVNYFLDQFQLLFPSVMVVVEQIKSQKIHGCQILETVYKHSCGGLPPVRSALEKILAVCHGVMYKQLSAWMLHGLLLDQHEEFFIKQGPSSGNVSAQPEEDEEDLGIGGLTGKQLRELQDLRLIEEENMLAPSLKQFSLRVEILPSYIPVRVAEKILFVGESVQMFENQNVNLTRKGSILKNQEDTFAAELHRLKQQPLFSLVDFEQVVDRIRSTVAEHLWKLMVEESDLLGQLKIIKDFYLLGRGELFQAFIDTAQHMLKTPPTAVTEHDVNVAFQQSAHKVLLDDDNLLPLLHLTIEYHGKEHKADATQAREGPSRETSPREAPASGWAALGLSYKVQWPLHILFTPAVLEKYNVVFKYLLSVRRVQAELQHCWALQMQRKHLKSNQTDAIKWRLRNHMAFLVDNLQYYLQVDVLESQFSQLLHQINSTRDFESIRLAHDHFLSNLLAQSFILLKPVFHCLNEILDLCHSFCSLVSQNLGPLDERGAAQLSILVKGFSRQSSLLFKILSSVRNHQINSDLAQLLLRLDYNKYYTQAGGTLGSFGM

SEQ ID NO: 93692 - protein, 82 aa, Homo sapiens
  Payload ID: 18694
  Gene Name: tubulin, gamma complex associated protein 4
  ENSP ID: ENSP00000454696
MIHELLLALSGYPGSIFTWNKRSGLQVSQDFPFLHPSETSVLNRLCRLGTDYIRFTEFIEQYTGHVQQQVSGPELRSWLLFV

SEQ ID NO: 93693 - protein, 171 aa, Homo sapiens
  Payload ID: 18694
  Gene Name: tubulin, gamma complex associated protein 4
  ENSP ID: ENSP00000454915
KVQWPLHILFTPAVLEKYNVVFKYLLSVRRVQAELQHCWALQMQRKHLKSNQTDAIKWRLRNHMAFLVDNLQYYLQVDVLESQFSQLLHQINSTRDFESIRLAHDHFLSNLLAQSFILLKPGFSRQSSLLFKILSSVRNHQINSDLAQLLLRLDYNKYYTQAGGTLGSFGM

SEQ ID NO: 93694 - protein, 397 aa, Homo sapiens
  Payload ID: 18694
  Gene Name: tubulin, gamma complex associated protein 4
  ENSP ID: ENSP00000455474
  MOD_RES (1)..(1): Any amino acid
XGIYLRAFCTGLDSVLQPYRQALLDLEQEFLGDPHLSISHVNYFLDQFQLLFPSVMVVVEQIKSQKIHGCQILETVYKHSCGGLPPVRSALEKILAVCHGVMYKQLSAWMLHGLLLDQHEEFFIKQGPSSGNVSAQPEEDEEDLGIGGLTGKQLRELQDLRLIEEENMLAPSLKQFSLRVEILPSYIPVRVAEKILFVGESVQMFENQNVNLTRKGSILKNQEDTFAAELHRLKQQPLFSLVDFEQVVDRIRSTVAEHLWKLMVEESDLLGQLKIIKDFYLLGRGELFQAFIDTAQHMLKTPPTAVTEHDVNVAFQQSAHKVLLDDDNLLPLLHLTIEYHGKEHKADATQAREGPSRETSPREAPASGWAALGLSYKVQWPLHILFTPAVLEKNRQF

SEQ ID NO: 93695 - protein, 66 aa, Homo sapiens
  Payload ID: 18694
  Gene Name: tubulin, gamma complex associated protein 4
  ENSP ID: ENSP00000455555
LLAQSFILLKPVFHCLNEILDLCHSFCSLVSQNLGPLDERGAAQLSILVKVRLPGSMQPCRKDRGL

SEQ ID NO: 93696 - protein, 103 aa, Homo sapiens
  Payload ID: 18694
  Gene Name: tubulin, gamma complex associated protein 4
  ENSP ID: ENSP00000455993
KSQKIHGCQILETVYKHSCGGLPPVRSALEKILAVCHGVMYKQLSAWMLHGLLLDQHEEFFIKQGPSSGNVSAQPEEDEEDLGIGGLTGKQLRELQDLSQKTM

SEQ ID NO: 93697 - protein, 105 aa, Homo sapiens
  Payload ID: 18694
  Gene Name: tubulin, gamma complex associated protein 4
  ENSP ID: ENSP00000456550
FLSNLLAQSFILLKPVFHCLNEILDLCHSFCSLVSQNLGPLDERGAAQLSILVKGFSRQSSLLFKILSSVRNHQINSDLAQLLLRLDYNKYYTQAGGTLGRKKPC

SEQ ID NO: 93698 - protein, 666 aa, Homo sapiens
  Payload ID: 18694
  Gene Name: tubulin, gamma complex associated protein 4
  Uniprot ID: Q9UGJ1
  ENSP ID: ENSP00000456648
MIHELLLALSGYPGSIFTWNKRSGLQVSQDFPFLHPSETSVLNRLCRLGTDYIRFTEFIEQYTGHVQQQDHHPSQQGQGGLHGIYLRAFCTGLDSVLQPYRQALLDLEQEFLGDPHLSISHVNYFLDQFQLLFPSVMVVVEQIKSQKIHGCQILETVYKHSCGGLPPVRSALEKILAVCHGVMYKQLSAWMLHGLLLDQHEEFFIKQGPSSGNVSAQPEEDEEDLGIGGLTGKQLRELQDLRLIEEENMLAPSLKQFSLRVEILPSYIPVRVAEKILFVGESVQMFENQNVNLTRKGSILKNQEDTFAAELHRLKQQPLFSLVDFEQVVDRIRSTVAEHLWKLMVEESDLLGQLKIIKDFYLLGRGELFQAFIDTAQHMLKTPPTAVTEHDVNVAFQQSAHKVLLDDDNLLPLLHLTIEYHGKEHKDATQAREGPSRETSPREAPASGWAALGLSYKVQWPLHILFTPAVLEKYNVVFKYLLSVRRVQAELQHCWALQMQRKHLKSNQTDAIKWRLRNHMAFLVDNLQYYLQVDVLESQFSQLLHQINSTRDFESIRLAHDHFLSNLLAQSFILLKPVFHCLNEILDLCHSFCSLVSQNLGPLDERGAAQLSILVKGFSRQSSLLFKILSSVRNHQINSDLAQLLLRLDYNKYYTQAGGTLGSFGM

SEQ ID NO: 93699 - protein, 194 aa, Homo sapiens
  Payload ID: 18695
  Gene Name: tubulin, gamma complex associated protein 5
  ENSP ID: ENSP00000479530
  MOD_RES (1)..(1): Any amino acid
XASWKRLTEEFLNAPLPSIKEIKTDAHYSILSLLLCLSDSPSNSSYVETPRNKEVEKKDDFDWGKYLMEDEEMDIGPYMDTPNWSEESEEENDQQPLSREDSGIQVDRTPLEEQDQNRKLDPCISWKADEPDDRSWLEHHVVHQYWTARPSQFPHSLHLHSNLAAVWDQHLYSSDPLYVPDDRVLVTETQVIRE

SEQ ID NO: 93700 - protein, 167 aa, Homo sapiens
  Payload ID: 18695
  Gene Name: tubulin, gamma complex associated protein 5
  ENSP ID: ENSP00000479810
  MOD_RES (1)..(1): Any amino acid
XLTEEFLNAPLPSIKEIKTDAHYSILSLLLCLSDSPSNSSYVETPRNKEVEKKDDFDWGKYLMEDEEMDIGPYMDTPNWSEESEEENDQQPLSREDSGIQVDRTPLEEQDQNRKLDPCISWKDDRSWLEHHVVHQYWTARPSQFPHSLHLHSNLAAVWDQHLYSSDP

SEQ ID NO: 93701 - protein, 1024 aa, Homo sapiens
  Payload ID: 18695
  Gene Name: tubulin, gamma complex associated protein 5
  Uniprot ID: Q96RT8
  ENSP ID: ENSP00000480316
MARHGPPWSRLDAQQERDVRELVRGVAGLQDEADPNFQLALNFAWSNFRFHRFLDVNSHKIEKTIEGIYEKFVIHSDLSKAASWKRLTEEFLNAPLPSIKEIKTDAHYSILSLLLCLSDSPSNSSYVETPRNKEVEKKDDFDWGKYLMEDEEMDIGPYMDTPNWSEESEEENDQQPLSREDSGIQVDRTPLEEQDQNRKLDPCISWKDEPDDRSWLEHHVVHQYWTARPSQFPHSLHLHSNLAAVWDQHLYSSDPLYVPDDRVLVTETQVIRETLWLLSGVKKLFIFQLIDGKVTVRNNIIVTHLTHSCLRSVLEQIAAYGQVVFRLQEFIDEVMGHSSESMLPGSGSVPKKSTEAPFRTYQAFMWALYKYFISFKEELAEIEKCIINNDTTITLAIVVDKLAPRLSQLKVLHKVFSTGVAEVPPDTRNVVRASHLLNTLYKAILEYDNVGEASEQTVSLLFSLWVETVRPYLQTVDEWIVHGHLWDGAREFIIQRNKNVPVNHRDFWYATYTLYSVSEKTENEEKMSDNASASSGSDQGPSSRQHTMVSFLKPVLKQIIMAGKSMQLLKNLQCAESTTCQAGARDAERKSLYTLFLESVQSRLRHGEDSTPQVLTEQQATKENLMKMQSIAESHLELDDVHDPLLAINFARMYLEQSDFHEKFAGGDVCVDRSSESVTCQTFELTLRSCLYPHIDKQYLDCCGNLMQTLKKDYRLVEYLQAMRNFFLMEGGDTMYDFYTSIFDKIREKETWQNVSFLNVQLQEAVGQRYPEDSSRLSISFENVDTAKKKLPVHILDGLTLSYKVPWPVDIVISLECQKIYNQVFLLLLQIKWAKYSLDVLLFGELVSTAEKPRLKEGLIHEQDTVAQFGPQKEPVRQQIHRMFLLRVKLMHFVNSLHNYIMTRILHSTGLEFQHQVEEAKDLDQLIKIHYRYLSTIHDRCLLREKVSFVKEAIMKVLNLALMFADGWQAGLGTWRMESIEKMESDFKNCHMFLVTILNKAVCRGSFPHLESLALSLMAGMEQS

SEQ ID NO: 93702 - protein, 1024 aa, Homo sapiens
  Payload ID: 18695
  Gene Name: tubulin, gamma complex associated protein 5
  Uniprot ID: Q96RT8
  ENSP ID: ENSP00000481853
MARHGPPWSRLDAQQERDVRELVRGVAGLQDEADPNFQLALNFAWSNFRFHRFLDVNSHKIEKTIEGIYEKFVIHSDLSKAASWKRLTEEFLNAPLPSIKEIKTDAHYSILSLLLCLSDSPSNSSYVETPRNKEVEKKDDFDWGKYLMEDEEMDIGPYMDTPNWSEESEEENDQQPLSREDSGIQVDRTPLEEQDQNRKLDPCISWKDEPDDRSWLEHHVVHQYWTARPSQFPHSLHLHSNLAAVWDQHLYSSDPLYVPDDRVLVTETQVIRETLWLLSGVKKLFIFQLIDGKVTVRNNIIVTHLTHSCLRSVLEQIAAYGQVVFRLQEFIDEVMGHSSESMLPGSGSVPKKSTEAPFRTYQAFMWALYKYFISFKEELAEIEKCIINNDTTITLAIVVDKLAPRLSQLKVLHKVFSTGVAEVPPDTRNVVRASHLLNTLYKAILEYDNVGEASEQTVSLLFSLWVETVRPYLQTVDEWIVHGHLWDGAREFIIQRNKNVPVNHRDFWYATYTLYSVSEKTENEEKMSDNASASSGSDQGPSSRQHTMVSFLKPVLKQIIMAGKSMQLLKNLQCAESTTCQAGARDAERKSLYTLFLESVQSRLRHGEDSTPQVLTEQQATKENLMKMQSIAESHLELDDVHDPLLAINFARMYLEQSDFHEKFAGGDVCVDRSSESVTCQTFELTLRSCLYPHIDKQYLDCCGNLMQTLKKDYRLVEYLQAMRNFFLMEGGDTMYDFYTSIFDKIREKETWQNVSFLNVQLQEAVGQRYPEDSSRLSISFENVDTAKKKLPVHILDGLTLSYKVPWPVDIVISLECQKIYNQVFLLLLQIKWAKYSLDVLLFGELVSTAEKPRLKEGLIHEQDTVAQFGPQKEPVRQQIHRMFLLRVKLMHFVNSLHNYIMTRILHSTGLEFQHQVEEAKDLDQLIKIHYRYLSTIHDRCLLREKVSFVKEAIMKVLNLALMFADGWQAGLGTWRMESIEKMESDFKNCHMFLVTILNKAVCRGSFPHCEYIMLKYFYLCISL

SEQ ID NO: 93703 - protein, 226 aa, Homo sapiens
  Payload ID: 18695
  Gene Name: tubulin, gamma complex associated protein 5
  ENSP ID: ENSP00000483015
  MOD_RES (1)..(1): Any amino acid
XLVEYLQAMRNFFLMEGGDTMYDFYTSIFDKIREKETWQNVSFLNVQLQEAVGQRYPEDSSRKWRPGTVAHTCNASTLGGRGGGSPEVRSSRPAWPTCLSISFENVDTAKKKLPVHILDGLTLSYKVPWPVDIVISLECQKIYNQVFLLLLQIKWAKYSLDVLLFGELVSTAEKPRLKEGLIHEQDTVAQFGPQKEPVRQQIHRMFLLRVKLMHFVNSLHNYIMTR

SEQ ID NO: 93704 - protein, 1024 aa, Homo sapiens
  Payload ID: 18695
  Gene Name: tubulin, gamma complex associated protein 5
  ENSP ID: ENSP00000484428
MARHGPPWSRLDAQQERDVRELVRGVAGLQDEADPNFQLALNFAWSNFRFHRFLDVNSHKIEKTIEGIYEKFVIHSDLSKAASWKRLTEEFLNAPLPSIKEIKTDAHYSILSLLLCLSDSPSNSSYVETPRNKEVEKKDDFDWGKYLMEDEEMDIGPYMDTPNWSEESEEENDQQPLSREDSGIQVDRTPLEEQDQNRKLDPCISWKDEPDDRSWLEHHVVHQYWTARPSHFPHSLHLHSNLAAVWDQHLYSSDPLYVPDDRVLVTETQVIRETLWLLSGVKKLFIFQLIDGKVTVRNNIIVTHLTHSCLRSVLEQIAAYGQVVFRLQEFIDEVMGHSSESMLPGSGSVPKKSTEAPFRTYQAFMWALYKYFISFKEELAEIEKCIINNDTTITLAIVVDKLAPRLSQLKVLHKVFSTGVAEVPPDTRNVVRASHLLNTLYKAILEYDNVGEASEQTVSLLFSLWVETVRPYLQTVDEWIVHGHLWDGAREFIIQRNKNVPVNHRDFWYATYTLYSVSEKTENEEKMSDNASASSGSDQGPSSRQHTMVSFLKPVLKQIIMAGKSMQLLKNLQCAESTTCQAGARDAERKSLYTLFLESVQSRLRHGEDSTPQVLTEQQATKENLMKMQSIAESHLELDDVHDPLLAINFARMYLEQSDFHEKFAGGDVCVDRSSESVTCQTFELTLRSCLYPHIDKQYLDCCGNLMQTLKKDYRLVEYLQAMRNFFLMEGGDTMYDFYTSIFDKIREKETWQNVSFLNVQLQEAVGQRYPEDSSRLSISFENVDTAKKKLPVHILDGLTLSYKVPWPVDIVISLECQKIYNQVFLLLLQIKWAKYSLDVLLFGELVSTAEKPRLKEGLIHEQDTVAQFGPQKEPVRQQIHRMFLLRVKLMHFVNSLHNYIMTRILHSTGLEFQHQVEEAKDLDQLIKIHYRYLSTIHDRCLLREKVSFVKEAIMKVLNLALMFADGWQAGLGTWRMESIEKMESDFKNCHMFLVTILNKAVCRGSFPHLESLALSLMAGMEQS

SEQ ID NO: 93705 - protein, 1026 aa, Homo sapiens
  Payload ID: 18695
  Gene Name: tubulin, gamma complex associated protein 5
  ENSP ID: ENSP00000484566
MARHGPPWSRLDAQQERDVRELVRGVAGLQDEADPNFQLALNFAWSNFRFHRFLDVNSHKIEKTIEGIYEKFVIHSDLSKAASWKRLTEEFLNAPLPSIKEIKTDAHYSILSLLLCLSDSPSNSSYVETPRNKEVEKKDDFDWGKYLMEDEEMDIGPYMDTPNWSEESEEENDQQPLSREDSGIQVDRTPLEEQDQNRKLDPCISWKDEPDDRSWLEHHVVHQYWTARPSQFPHSLHLHSNLAAVWDQHLYSSDPLYVPDDRVLVTETQVIRETLWLLSGVKKLFIFQLIDGKVTVRNNIIVTHLTHSCLRSVLEQIAAYGQVVFRLQEFIDEVMGHSSESMLPGSGSVPKKSTEAPFRTYQAFMWALYKYFISFKEELAEIEKCIINNDTTITLAIVVDKLAPRLSQLKVLHKVFSTGVAEVPPDTRNVVRASHLLNTLYKAILEYDNVGEASEQTVSLLFSLWVETVRPYLQTVDEWIVHGHLWDGAREFIIQRNKNVPVNHRDFWYATYTLYSVSEKTENEEKMSDNASASSGSDQGPSSRQHTMVSFLKPVLKQIIMAGKSMQLLKNLQCAESTTCQAGARDAERKSLYTLFLESVQSRLRHGEDSTPQVLTEQQATKENLMKMQSIAESHLELDDVHDPLLAINFARMYLEQSDFHEKFAGGDVCVDRSSESVTCQTFELTLRSCLYPHIDKQYLDCCGNLMQTLKKDYRLVEYLQAMRNFFLMEGGDTMYDFYTSIFDKIREKETWQNVSFLNVQLQEAVGQRYPEDSSRLSISFENVDTAKKKLPVHILDGLTLSYKVPWPVDIVISLECQKIYNQVFLLLLQIKWAKYSLDVLLFGELVSTAEKPRLKEGLIHEQDTVAQFGPQKEPVRQQIHRMFLLRVKLMHFVNSLHNYIMTRILHSTGLEFQHQVEEAKDLDQLIKIHYRYLSTIHDRCLLREKVSFVKEAIMKVLNLALMFADGWQAGLGTWRMESIEKMESDFKNCHMFLVTILNKAVCRGSFPHCLALLPMLERIGTVLAH

SEQ ID NO: 93706 - protein, 226 aa, Homo sapiens; identical to SEQ ID NO: 93703
  Payload ID: 18695
  Gene Name: tubulin, gamma complex associated protein 5
  ENSP ID: ENSP00000485682
  MOD_RES (1)..(1): Any amino acid

SEQ ID NO: 93707 - protein, 148 aa, Homo sapiens
  Payload ID: 18695
  Gene Name: tubulin, gamma complex associated protein 5
  ENSP ID: ENSP00000485856
  MOD_RES (1)..(1): Any amino acid
XRVKLMHFVNSLHNYIMTRILHSTGLEFQHQVEEAKDLDQLIKIHYRYLSTIHDRCLLREKVSFVKEAIMKVLNLALMFADGWQAGLGTWRMESIEKMESDFKNCHMFLVTILNKAVCRGSFPHFSIGLPVVCIRRWSLLSTGGLGGT

SEQ ID NO: 93708 - protein, 194 aa, Homo sapiens
  Payload ID: 18695
  Gene Name: tubulin, gamma complex associated protein 5
  ENSP ID: ENSP00000485928
  MOD_RES (1)..(1): Any amino acid
XASWKRLTEEFLNAPLPSIKEIKTDAHYSILSLLLCLSDSPSNSSYVETPRNKEVEKKDDFDWGKYLMEDEEMDIGPYMDTPNWSEESEEENDQQPLSREDSGIQVDRTPLEEQDQNRKLDPCISWKADEPDDRSWLEHHVVHQYWTARPSHFPHSLHLHSNLAAVWDQHLYSSDPLYVPDDRVLVTETQVIRE

SEQ ID NO: 93709 - protein, 23 aa, Homo sapiens
  Payload ID: 18695
  Gene Name: tubulin, gamma complex associated protein 5
  ENSP ID: ENSP00000485940
  MOD_RES (1)..(1): Any amino acid
XASWKRLTEEFLNAPLPSIKEIK

SEQ ID NO: 93710 - protein, 18 aa, Homo sapiens
  Payload ID: 18695
  Gene Name: tubulin, gamma complex associated protein 5
  ENSP ID: ENSP00000486220
  MOD_RES (1)..(1): Any amino acid
XLTEEFLNAPLPSIKEIK

SEQ ID NO: 93711 - protein, 1024 aa, Homo sapiens
  Payload ID: 18695
  Gene Name: tubulin, gamma complex associated protein 5
  ENSP ID: ENSP00000486245
MARHGPPWSRLDAQQERDVRELVRGVAGLQDEADPNFQLALNFAWSNFRFHRFLDVNSHKIEKTIEGIYEKFVIHSDLSKAASWKRLTEEFLNAPLPSIKEIKTDAHYSILSLLLCLSDSPSNSSYVETPRNKEVEKKDDFDWGKYLMEDEEMDIGPYMDTPNWSEESEEENDQQPLSREDSGIQVDRTPLEEQDQNRKLDPCISWKDEPDDRSWLEHHVVHQYWTARPSHFPHSLHLHSNLAAVWDQHLYSSDPLYVPDDRVLVTETQVIRETLWLLSGVKKLFIFQLIDGKVTVRNNIIVTHLTHSCLRSVLEQIAAYGQVVFRLQEFIDEVMGHSSESMLPGSGSVPKKSTEAPFRTYQAFMWALYKYFISFKEELAEIEKCIINNDTTITLAIVVDKLAPRLSQLKVLHKVFSTGVAEVPPDTRNVVRASHLLNTLYKAILEYDNVGEASEQTVSLLFSLWVETVRPYLQTVDEWIVHGHLWDGAREFIIQRNKNVPVNHRDFWYATYTLYSVSEKTENEEKMSDNASASSGSDQGPSSRQHTMVSFLKPVLKQIIMAGKSMQLLKNLQCAESTTCQAGARDAERKSLYTLFLESVQSRLRHGEDSTPQVLTEQQATKENLMKMQSIAESHLELDDVHDPLLAINFARMYLEQSDFHEKFAGGDVCVDRSSESVTCQTFELTLRSCLYPHIDKQYLDCCGNLMQTLKKDYRLVEYLQAMRNFFLMEGGDTMYDFYTSIFDKIREKETWQNVSFLNVQLQEAVGQRYPEDSSRLSISFENVDTAKKKLPVHILDGLTLSYKVPWPVDIVISLECQKIYNQVFLLLLQIKWAKYSLDVLLFGELVSTAEKPRLKEGLIHEQDTVAQFGPQKEPVRQQIHRMFLLRVKLMHFVNSLHNYIMTRILHSTGLEFQHQVEEAKDLDQLIKIHYRYLSTIHDRCLLREKVSFVKEAIMKVLNLALMFADGWQAGLGTWRMESIEKMESDFKNCHMFLVTILNKAVCRGSFPHCEYIMLKYFYLCISL

SEQ ID NO: 93712 - protein, 103 aa, Homo sapiens
  Payload ID: 18695
  Gene Name: tubulin, gamma complex associated protein 5
  ENSP ID: ENSP00000486427
MARHGPPWSRLDAQQERDVRELVRGVAGLQDEADPNFQLALNFAWSNFRFHRFLDVNSHKIEKTIEGIYEKFVIHSDLSKAASWKRLTEEFLNAPLPSIKEIK

SEQ ID NO: 93713 - protein, 103 aa, Homo sapiens; identical to SEQ ID NO: 93712
  Payload ID: 18695
  Gene Name: tubulin, gamma complex associated protein 5
  ENSP ID: ENSP00000486628

SEQ ID NO: 93714 - protein, 145 aa, Homo sapiens
  Payload ID: 18695
  Gene Name: tubulin, gamma complex associated protein 5
  ENSP ID: ENSP00000486735
MARHGPPWSRLDAQQERDVRELVRGVAGLQDEADPNFQLALNFAWSNFRFHRFLDVNSHKIEKTIEGIYEKFVIHSDLSKAASWKRLTEEFLNAPLPSIKEIKMHIIPYCHFFCVCQTLLQTAVMWRHQEIKKWKRKMISTGENT

SEQ ID NO: 93715 - protein, 103 aa, Homo sapiens; identical to SEQ ID NO: 93712
  Payload ID: 18695
  Gene Name: tubulin, gamma complex associated protein 5
  ENSP ID: ENSP00000487038

SEQ ID NO: 93716 - protein, 167 aa, Homo sapiens
  Payload ID: 18695
  Gene Name: tubulin, gamma complex associated protein 5
  ENSP ID: ENSP00000487344
  MOD_RES (1)..(1): Any amino acid
XLTEEFLNAPLPSIKEIKTDAHYSILSLLLCLSDSPSNSSYVETPRNKEVEKKDDFDWGKYLMEDEEMDIGPYMDTPNWSEESEEENDQQPLSREDSGIQVDRTPLEEQDQNRKLDPCISWKDDRSWLEHHVVHQYWTARPSHFPHSLHLHSNLAAVWDQHLYSSDP

SEQ ID NO: 93717 - protein, 1026 aa, Homo sapiens
  Payload ID: 18695
  Gene Name: tubulin, gamma complex associated protein 5
  ENSP ID: ENSP00000487481
MARHGPPWSRLDAQQERDVRELVRGVAGLQDEADPNFQLALNFAWSNFRFHRFLDVNSHKIEKTIEGIYEKFVIHSDLSKAASWKRLTEEFLNAPLPSIKEIKTDAHYSILSLLLCLSDSPSNSSYVETPRNKEVEKKDDFDWGKYLMEDEEMDIGPYMDTPNWSEESEEENDQQPLSREDSGIQVDRTPLEEQDQNRKLDPCISWKDEPDDRSWLEHHVVHQYWTARPSHFPHSLHLHSNLAAVWDQHLYSSDPLYVPDDRVLVTETQVIRETLWLLSGVKKLFIFQLIDGKVTVRNNIIVTHLTHSCLRSVLEQIAAYGQVVFRLQEFIDEVMGHSSESMLPGSGSVPKKSTEAPFRTYQAFMWALYKYFISFKEELAEIEKCIINNDTTITLAIVVDKLAPRLSQLKVLHKVFSTGVAEVPPDTRNVVRASHLLNTLYKAILEYDNVGEASEQTVSLLFSLWVETVRPYLQTVDEWIVHGHLWDGAREFIIQRNKNVPVNHRDFWYATYTLYSVSEKTENEEKMSDNASASSGSDQGPSSRQHTMVSFLKPVLKQIIMAGKSMQLLKNLQCAESTTCQAGARDAERKSLYTLFLESVQSRLRHGEDSTPQVLTEQQATKENLMKMQSIAESHLELDDVHDPLLAINFARMYLEQSDFHEKFAGGDVCVDRSSESVTCQTFELTLRSCLYPHIDKQYLDCCGNLMQTLKKDYRLVEYLQAMRNFFLMEGGDTMYDFYTSIFDKIREKETWQNVSFLNVQLQEAVGQRYPEDSSRLSISFENVDTAKKKLPVHILDGLTLSYKVPWPVDIVISLECQKIYNQVFLLLLQIKWAKYSLDVLLFGELVSTAEKPRLKEGLIHEQDTVAQFGPQKEPVRQQIHRMFLLRVKLMHFVNSLHNYIMTRILHSTGLEFQHQVEEAKDLDQLIKIHYRYLSTIHDRCLLREKVSFVKEAIMKVLNLALMFADGWQAGLGTWRMESIEKMESDFKNCHMFLVTILNKAVCRGSFPHCLALLPMLERIGTVLAH

SEQ ID NO: 93718 - protein, 1819 aa, Homo sapiens
  Payload ID: 18696
  Gene Name: tubulin, gamma complex associated protein 6
  Uniprot ID: Q96RT7
  ENSP ID: ENSP00000248846
MASITQLFDDLCEALLPAAKTHLGQRSVNRKRAKRSLKKVAYNALFTNLFQDETQQLQPDMSKLPARNKILMLSFDLRVGGLGPKADRLEELVEELEAAPCCPLLEVGSVLDLLVQLAGSGPPQVLPRKRDYFLNNKHVGRNVPYSGYDCDDLSVFEMDVQSLISREECLCHSMIQETLQVMEAAPGTGLPTVGLFSFGDPCGDRFERDTRVSLFGALVHSRTYDMDVRLGLPPVPDNADLSGLAIKVPPSVDQWEDEGFQSASNLTPDSQSEPSVTPDVDLWEAALTYEASKRRCWERVGCPPGHREEPYLTEAGRDAFDKFCRLHQGELQLLAGGVLQAPQPVLVKECELVKDVLNVLIGVVSATFSLCQPAQAFVVKRGVHVSGASPESISSLLSEVAEYGTCYTRLSHFSLQPVLDSLYSKGLVFQAFTSGLRRYLQYYRACVLSTPPTLSLLTIGFLFKKLGRQLRYLAELCGVGAVLPGTCGGGPRAAFPTGVKLLSYLYQEALHNCSNEHYPVLLSLLKTSCEPYTRFIHDWVYSGVFRDAYGEFMIQVNHEYLSFRDKLYWTHGYVLISKEVEDCVPVFLKHIAHDIYVCGKTINLLKLCCPRHYLCWSDVPVPRISVIFSLEELKEIEKDCAVYVGRMERVARHSSVSKEEKELRMEIAKQELIAHAREAASRVLSALSDRQMSERMALDARKREQFQRLKEQFVKDQERRQAARQEELDDDFSYARELRDRERRLKSLEEELERKARQALVDHYSKLSAEAARREQKALWRIQRHRLESARLRFLLEDEKHIQEMLKAVSEAHQPQEPPDVLLSVHPQVTSPGPEHPEGGQGCDSGSAEQHSPAWDGWNRPGLLTPQPLKPLAVGAGGRGLQQAEGARPFSDSLSIGDFLPVGPGAEPSVQTGMVPLLEVALQTINLDLPPSAPGEAPAAASTQPSRPQEYDFSTVLRPAVATSPAPGPLQAAECSLGSSGLQLWEDSCGKMDACGSASRETLLPSHPPRRAALEEGSSQPTERLFGQVSGGGLPTGDYASEIAPTRPRWNTHGHVSDASIRVGENVSDVAPTQPRWNTHGHVSNASISLGESVSDVAPTRPRWNIHGHVSNASIRVGENVSDVAPTRPRWNTHGHVSNASIRVGENVSDVAPTRPRWNTHGHVSDASISLGESVSDMAPARPRWNTHGHVSDASISLGESVSDMAPTRPRWNTHGHVSDTSIRVGENVSDVAPIRSRCNTHGHVSDASISLGEPVSDVVSTRPRWNTHVPIPPPHMVLGALSPEAEPNTPRPQQSPPGHTSQSALSLGAQSTVLDCGPRLPVEVGPSLSSPSSGCGEGSISVGENVSDVAPTQPWWPNTPGDSVSEELGPGRSGDTEDLSPNWPLNSQEDTAAQSSPGRGEEAEASAAEAQGGEQAYLAGLAGQYHLERYPDSYESMSEPPIAHLLRPVLPRAFAFPVDPQVQSAADETAVQLSELLTLPVLMKRSITAPLAAHISLVNKAAVDYFFVELHLEAHYEALRHFLLMEDGEFAQSLSDLLFEKLGAGQTPGELLNPLVLNSVLSKALQCSLHGDTPHASNLSLALKYLPEVFAPNAPDVLSCLELRYKVDWPLNIVITEGCVSKYSGVFSFLLQLKLMMWALKDVCFHLKRTALLSHMAGSVQFRQLQLFKHEMQHFVKVIQGYIANQILHVTWCEFRARLATVGDLEEIQRAHAEYLHKAVFRGLLTEKAAPVMNVIHSIFSLVLKFRSQLISQAWGPPGGPRGAEHPNFALMQQSYNTFKYYSHFLFKVVTKLVNRGYQPHLEDFLLRINFNNYYQDA

SEQ ID NO: 93719 - protein, 1493 aa, Homo sapiens
  Payload ID: 18696
  Gene Name: tubulin, gamma complex associated protein 6
  ENSP ID: ENSP00000397387
MASITQLFDDLCEALLPAAKTHLGQRSVNRKRAKRSLKKVAYNALFTNLFQDETQQLQPDMSKLPARNKILMLSFDLRVGGLGPKADRLEELVEELEAAPCCPLLEVGSVLDLLVQLAGSGPPQVLPRKRDYFLNNKHVGRNVPYSGYDCDDLSVFEMDVQSLISREECLCHSMIQETLQVMEAAPGTGLPTVGLFSFGDPCGDRFERDTRVSLFGALVHSRTYDMDVRLGLPPVPDNADLSGLAIKVPPSVDQWEDEGFQSASNLTPDSQSEPSVTPDVDLWEAALTYEASKRRCWERVGCPPGHREEPYLTEAGRDAFDKFCRLHQGELQLLAGGVLQAPQPVLVKECELVKDVLNVLIGVVSATFSLCQPAQAFVVKRGVHVSGASPESISSLLSEVAEYGTCYTRLSHFSLQPVLDSLYSKGLVFQAFTSGLRRYLQYYRACVLSTPPTLSLLTIGFLFKKLGRQLRYLAELCGVGAVLPGTCGGGPRAAFPTGVKLLSYLYQEALHNCSNEHYPVLLSLLKTSCEPYTRFIHDWVYSGVFRDAYGEFMIQVNHEYLSFRDKLYWTHGYVLISKEVEDCVPVFLKHIAHDIYVCGKTINLLKLCCPRHYLCWSDVPVPRISVIFSLEELKEIEKDCAVYVGRMERVARHSSVSKEEKELRMEIAKQELIAHAREAASRVLSALSDRQMSERMALDARKREQFQRLKEQFVKDQERRQAARQEELDDDFSYARELRDRERRLKSLEEELERKARQALVDHYSKLSAEAARREQKALWRIQRHRLESARLRFLLEDEKHIQEMLKAVSEAHQPQEPPDVLLSVHPQVTSPGPEHPEGGQGCDSGSAEQHSPAWDGWNRPGLLTPQPLKPLAVGAGGRGLQQAEGARPFSDSLSIGDFLPVGPGAEPSVQTGMVPLLEVALQTINLDLPPSAPGEAPAAASTQPSRPQEYDFSTVLRPAVATSPAPGPLQAAECSLGSSGLQLWEDSCGKMDACGSASRETLLPSHPPRRAALEEGSSQPTERLFGQVSGGGLPTGDYASEIAPTRPRWNTHGHVSDASIRVGENVSDVAPTQPRWNTHGHVSNASISLGESVSDVAPTRPRWNIHGHVSNASIRVGENVSDVAPTRPRWNTHGHVSNASIRVGENVSDVAPTRPRWNTHGHVSDASISLGESVSDMAPARPRWNTHGHVSDASISLGESVSDMAPTRPRWNTHGHVSDTSIRVGENVSDVAPIRSRCNTHGHVSDASISLGEPVSDVVSTRPRWNTHVPIPPPHMVLGALSPEAEPNTPRPQQSPPGHTSQSALSLGAQSTVLDCGPRLPVEVGPSLSSPSSGCGEGSISVGENVSDVAPTQPWWPNTPGDSVSEELGQSRVAGGQEWDCGTHRAWEALGGAGTLRTSLQIGLSTHRKTQLPRAAQAVVRRRRHRRRRLRVGSRPTWQAWQGSTTWSGTRTVTSPCPSRPLLIFCAPCFPGPSPSPWTPRSSLPLMRLLCS

SEQ ID NO: 93720 - protein, 488 aa, Homo sapiens
  Payload ID: 18696
  Gene Name: tubulin, gamma complex associated protein 6
  ENSP ID: ENSP00000405979
LDCGPRLPVEVGPSLSSPSSGCGEGSISVGENVSDVAPTQPWWPNTPGDSVSEELGPGRSGDTEDLSPNWPLNSQEDTAAQSSPGRGEEAEASAAEAQGGEQAYLAGLAGQYHLERYPDSYESMSEPPIAHLLRPVLPRAFAFPVDPQVQSAADETAVQLSELLTLPVLMKRSITAPLAAHISLVNKAAVDYFFVELHLEAHYEALRHFLLMEDGEFAQSLSDLLFEKLGAGQTPGELLNPLVLNSVLSKALQCSLHGDTPHASNLSLALKYLPEVFAPNAPDVLSCLELRYKVDWPLNIVITEGCVSKYSGVFSFLLQLKLMMWALKDVCFHLKRTVPSAAAVQARDAAFREGHPGLHRQPDPARHLVRVQGQVGHRGRPGGDPACARRVPAQGRLQAAPVMNVIHSIFSLVLKFRSQLISQAWGPPGGPRGAEHPNFALMQQSYNTFKYYSHFLFKVVTKLVNRGYQPHLEDFLLRINFNNYYQDA

SEQ ID NO: 93721 - protein, 277 aa, Homo sapiens
  Payload ID: 18696
  Gene Name: tubulin, gamma complex associated protein 6
  ENSP ID: ENSP00000409650
  MOD_RES (1)..(1): Any amino acid
XSVDQWEDEGFQSASNLTPDSQSEPSVTPDVDLWEAALTYEASKRSPPGHREEPYLTEAGRDAFDKFCRLHQGELQLLAGGVLQAPQPVLVKECELVKDVLNVLIGVVSATFSLCQPAQAFVVKRGVHVSGASPESISSLLSEVAEYGTCYTRLSHFSLQPVLDSLYSKGLVFQAFTSGLRRYLQYYRACVLSTPPTLSLLTIGFLFKKLGRQLRYLAELCGVGAVLPGTCGGGPRAAFPTGVKLLSYLYQEALHNCSNEHYPVLLSLLKTSCEPYT

SEQ ID NO: 93722 - protein, 476 aa, Homo sapiens
  Payload ID: 18697
  Gene Name: tubulointerstitial nephritis antigen
  Uniprot ID: Q9UJW2
  ENSP ID: ENSP00000259782
MWTGYKILIFSYLTTEIWMEKQYLSQREVDLEAYFTRNHTVLQGTRFKRAIFQGQYCRNFGCCEDRDDGCVTEFYAANALCYCDKFCDRENSDCCPDYKSFCREEKEWPPHTQPWYPEGCFKDGQHYEEGSVIKENCNSCTCSGQQWKCSQHVCLVRSELIEQVNKGDYGWTAQNYSQFWGMTLEDGFKFRLGTLPPSPMLLSMNEMTASLPATTDLPEFFVASYKWPGWTHGPLDQKNCAASWAFSTASVAADRIAIQSKGRYTANLSPQNLISCCAKNRHGCNSGSIDRAWWYLRKRGLVSHACYPLFKDQNATNNGCAMASRSDGRGKRHATKPCPNNVEKSNRIYQCSPPYRVSSNETEIMKEIMQNGPVQAIMQVREDFFHYKTGIYRHVTSTNKESEKYRKLQTHAVKLTGWGTLRGAQGQKEKFWIAANSWGKSWGENGYFRILRGVNESDIEKLIIAAWGQLTSSDEP

SEQ ID NO: 93723 - protein, 203 aa, Homo sapiens
  Payload ID: 18697
  Gene Name: tubulointerstitial nephritis antigen
  ENSP ID: ENSP00000359901
MEKQYLSQREVDLEAYFTRNHTVLQGTRFKRAIFQGQYCRNFGCCEDRDDGCVTEFYAANALCYCDKFCDRENSDCCPDYKSFCREEKEWPPHTQPWYPEGCFKDGQHYEEGSVIKENCNSCTCSGQQWKCSQHVCLVRSELIEQVNKGDYGWTAQNYSQFWGMTLEDGFKFRLGTLPPSPMLLSMNEMTVSVPSDSRMCMYL

SEQ ID NO: 93724 - protein, 205 aa, Homo sapiens
  Payload ID: 18697
  Gene Name: tubulointerstitial nephritis antigen
  ENSP ID: ENSP00000359906
MRAWMFVSMQAEIWMEKQYLSQREVDLEAYFTRNHTVLQGTRFKRAIFQGQYCRNFGCCEDRDDGCVTEFYAANALCYCDKFCDRENSDCCPDYKSFCREEKEWPPHTQPWYPEGCFKDGQHYEEGSVIKENCNSCTCSGQQWKCSQHVCLVRSELIEQVNKGDYGWTAQNYSQFWGMTLEDGFKFRLGTLPPSPMLLSMNEMTE

SEQ ID NO: 93725 - protein, 467 aa, Homo sapiens
  Payload ID: 18698
  Gene Name: tubulointerstitial nephritis antigen-like 1
  Uniprot ID: Q9GZM7
  ENSP ID: ENSP00000271064
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRCTCQENRQWQCDQEPCLVDPDMIKAINQGNYGWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 93726 - protein, 436 aa, Homo sapiens
  Payload ID: 18698
  Gene Name: tubulointerstitial nephritis antigen-like 1
  Uniprot ID: Q9GZM7
  ENSP ID: ENSP00000395137
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRCWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 93727 - protein, 362 aa, Homo sapiens
  Payload ID: 18698
  Gene Name: tubulointerstitial nephritis antigen-like 1
  ENSP ID: ENSP00000445392
MHGGRIYPVLGTYWDNCNRCTCQENRQWQCDQEPCLVDPDMIKAINQGNYGWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 93728 - protein, 561 aa, Homo sapiens
  Payload ID: 18699
  Gene Name: tudor and KH domain containing
  Uniprot ID: Q9Y2W6
  ENSP ID: ENSP00000357812
MSTERTSWTSLSTIQKIALGLGIPASATVAYILYRRYRESREERLTFVGEDDIEIEMRVPQEAVKLIIGRQGANIKQLRKQTGARIDVDTEDVGDERVLLISGFPVQVCKAKAAIHQILTENTPVSEQLSVPQRSVGRIIGRGGETIRSICKASGAKITCDKESEGTLLLSRLIKISGTQKEVAAAKHLILEKVSEDEELRKRIAHSAETRVPRKQPISVRREDMTEPGGAGEPALWKNTSSSMEPTAPLVTPPPKGGGDMAVVVSKEGSWEKPSDDSFQKSEAQAIPEMPMFEIPSPDFSFHADEYLEVYVSASEHPNHFWIQIVGSRSLQLDKLVNEMTQHYENSVPEDLTVHVGDIVAAPLPTNGSWYRARVLGTLENGNLDLYFVDFGDNGDCPLKDLRALRSDFLSLPFQAIECSLARIAPSGDQWEEEALDEFDRLTHCADWKPLVAKISSYVQTGISTWPKIYLYDTSNGKKLDIGLELVHKGYAIELPEDIEENRAVPDMLKDMATETDASLSTLLTETKKSSGEITHTLSCLSLSEAASMSGDDNLEDDYLL

SEQ ID NO: 93729 - protein, 557 aa, Homo sapiens
  Payload ID: 18699
  Gene Name: tudor and KH domain containing
  ENSP ID: ENSP00000357813
MSTERTSWTSLSTIQKIALGLGIPASATVAYILYRRYRESREERLTFVGEDDIEIEMRVPQEAVKLIIGRQGANIKQTGARIDVDTEDVGDERVLLISGFPVQVCKAKAAIHQILTENTPVSEQLSVPQRSVGRIIGRGGETIRSICKASGAKITCDKESEGTLLLSRLIKISGTQKEVAAAKHLILEKVSEDEELRKRIAHSAETRVPRKQPISVRREDMTEPGGAGEPALWKNTSSSMEPTAPLVTPPPKGGGDMAVVVSKEGSWEKPSDDSFQKSEAQAIPEMPMFEIPSPDFSFHADEYLEVYVSASEHPNHFWIQIVGSRSLQLDKLVNEMTQHYENSVPEDLTVHVGDIVAAPLPTNGSWYRARVLGTLENGNLDLYFVDFGDNGDCPLKDLRALRSDFLSLPFQAIECSLARIAPSGDQWEEEALDEFDRLTHCADWKPLVAKISSYVQTGISTWPKIYLYDTSNGKKLDIGLELVHKGYAIELPEDIEENRAVPDMLKDMATETDASLSTLLTETKKSSGEITHTLSCLSLSEAASMSGDDNLEDDYLL

SEQ ID NO: 93730 - protein, 561 aa, Homo sapiens; identical to SEQ ID NO: 93728
  Payload ID: 18699
  Gene Name: tudor and KH domain containing
  Uniprot ID: Q9Y2W6
  ENSP ID: ENSP00000357815

SEQ ID NO: 93731 - protein, 516 aa, Homo sapiens
  Payload ID: 18699
  Gene Name: tudor and KH domain containing
  Uniprot ID: Q9Y2W6
  ENSP ID: ENSP00000357817
MSTERTSWTSLSTIQKIALGLGIPASATVAYILYRRYRESREERLTFVGEDDIEIEMRVPQEAVKLIIGRQGANIKQLRKQTGARIDVDTEDVGDERVLLISGFPVQASGAKITCDKESEGTLLLSRLIKISGTQKEVAAAKHLILEKVSEDEELRKRIAHSAETRVPRKQPISVRREDMTEPGGAGEPALWKNTSSSMEPTAPLVTPPPKGGGDMAVVVSKEGSWEKPSDDSFQKSEAQAIPEMPMFEIPSPDFSFHADEYLEVYVSASEHPNHFWIQIVGSRSLQLDKLVNEMTQHYENSVPEDLTVHVGDIVAAPLPTNGSWYRARVLGTLENGNLDLYFVDFGDNGDCPLKDLRALRSDFLSLPFQAIECSLARIAPSGDQWEEEALDEFDRLTHCADWKPLVAKISSYVQTGISTWPKIYLYDTSNGKKLDIGLELVHKGYAIELPEDIEENRAVPDMLKDMATETDASLSTLLTETKKSSGEITHTLSCLSLSEAASMSGDDNLEDDYLL

SEQ ID NO: 93732 - protein, 561 aa, Homo sapiens; identical to SEQ ID NO: 93728
  Payload ID: 18699
  Gene Name: tudor and KH domain containing
  Uniprot ID: Q9Y2W6
  ENSP ID: ENSP00000357819

SEQ ID NO: 93733 - protein, 561 aa, Homo sapiens; identical to SEQ ID NO: 93728
  Payload ID: 18699
  Gene Name: tudor and KH domain containing
  Uniprot ID: Q9Y2W6
  ENSP ID: ENSP00000395718

SEQ ID NO: 93734 - protein, 605 aa, Homo sapiens
  Payload ID: 18699
  Gene Name: tudor and KH domain containing
  ENSP ID: ENSP00000416645
MSTERTSWTSLSTIQKIALGLGIPASATVAYILYRRYRESREERLTFVGEDDIEIEMRVPQEAVKLIIGRQGANIKQLRKQTGARIDVDTEDVGDERVLLISGFPVQVCKAKAAIHQILTENTPVSEQLSVPQRSVGRIIGRGGETIRSICKASGAKITCDKESEGTLLLSRLIKISGTQKEVAAAKHLILEKVSEDEELRKRIAHSAETRVPRKQPISVRREDMTEPGGAGEPALWKNTSSSMEPTAPLVTPPPKGGGDMAVVVSKEGSWEKPSDDSFQKSEAQAIPEMPMFEIPSPDFSFHADEYLEVYVSASEHPNHFWIQIVGSRSLQLDKLVNEMTQHYENSVPEDLTVHVGDIVAAPLPTNGSWYRARVLGTLENGNLDLYFVDFGDNGDCPLKDLRALRSDFLSLPFQAIECSLARIAPSGDQWEEEALDEFDRLTHCADWKPLVAKISSYVQTGISTWPKIYLYDTSNGKKLDIGLELVHKGYAIELPEDIEENRAVPDMLKDMATETDASLSTLLTETKKSSGEITHTLSCLSLSEAASMSGDDNLEDDYLLSLGFSLLSHLLCCMLPAMNSLKHAQPWNWCYQSSVGNLYSLEVP

SEQ ID NO: 93735 - protein, 131 aa, Homo sapiens
  Payload ID: 18699
  Gene Name: tudor and KH domain containing
  ENSP ID: ENSP00000431557
MSTERTSWTSLSTIQKIALGLGIPASATVAYILYRRYRESREERLTFVGEDDIEIEMRVPQEAVKLIIGRQGANIKQLRKQTGARIDVDTEDVGDERVLLISGFPVQVCKAKAAIHQILTENTPVSEQLSV

SEQ ID NO: 93736 - protein, 58 aa, Homo sapiens
  Payload ID: 18699
  Gene Name: tudor and KH domain containing
  ENSP ID: ENSP00000432452
MSTERTSWTSLSTIQKIALGLGIPASATVAYILYRRYRESRVVSRRHLPQRLDLENRT

SEQ ID NO: 93737 - protein, 140 aa, Homo sapiens
  Payload ID: 18699
  Gene Name: tudor and KH domain containing
  ENSP ID: ENSP00000433678
MSTERTSWTSLSTIQKIALGLGIPASATVAYILYRRYRESREERLTFVGEDDIEIEMRVPQEAVKLIIGRQGANIKQLRKQTGARIDVDTEDVGDERVLLISGFPVQGEAARQFVLSVRHLEPKLPVTKNQKGHYYYQDL

SEQ ID NO: 93738 - protein, 140 aa, Homo sapiens; identical to SEQ ID NO: 93737
  Payload ID: 18699
  Gene Name: tudor and KH domain containing
  ENSP ID: ENSP00000437147

SEQ ID NO: 93739 - protein, 1189 aa, Homo sapiens
  Payload ID: 18700
  Gene Name: tudor domain containing 1
  Uniprot ID: Q9BXT4
  ENSP ID: ENSP00000251864
MSVKSPFNVMSRNNLEAPPCKMTEPFNFEKNENKLPPHESLRSPGTLPNHPNFRLKSSENGNKKNNFLLCEQTKQYLASQEDNSVSSNPNGINGEVVGSKGDRKKLPAGNSVSPPSAESNSPPKEVNIKPGNNVRPAKSKKLNKLVENSLSISNPGLFTSLGPPLRSTTCHRCGLFGSLRCSQCKQTYYCSTACQRRDWSAHSIVCRPVQPNFHKLENKSSIETKDVEVNNKSDCPLGVTKEIAIWAERIMFSDLRSLQLKKTMEIKGTVTEFKHPGDFYVQLYSSEVLEYMNQLSASLKETYANVHEKDYIPVKGEVCIAKYTVDQTWNRAIIQNVDVQQKKAHVLYIDYGNEEIIPLNRIYHLNRNIDLFPPCAIKCFVANVIPAEGNWSSDCIKATKPLLMEQYCSIKIVDILEEEVVTFAVEVELPNSGKLLDHVLIEMGYGLKPSGQDSKKENADQSDPEDVGKMTTENNIVVDKSDLIPKVLTLNVGDEFCGVVAHIQTPEDFFCQQLQSGRKLAELQASLSKYCDQLPPRSDFYPAIGDICCAQFSEDDQWYRASVLAYASEESVLVGYVDYGNFEILSLMRLCPIIPKLLELPMQAIKCVLAGVKPSLGIWTPEAICLMKKLVQNKIITVKVVDKLENSSLVELIDKSETPHVSVSKVLLDAGFAVGEQSMVTDKPSDVKETSVPLGVEGKVNPLEWTWVELGVDQTVDVVVCVIYSPGEFYCHVLKEDALKKLNDLNKSLAEHCQQKLPNGFKAEIGQPCCAFFAGDGSWYRALVKEILPNGHVKVHFVDYGNIEEVTADELRMISSTFLNLPFQGIRCQLADIQSRNKHWSEEAITRFQMCVAGIKLQARVVEVTENGIGVELTDLSTCYPRIISDVLIDEHLVLKSASPHKDLPNDRLVNKHELQVHVQGLQATSSAEQWKTIELPVDKTIQANVLEIISPNLFYALPKGMPENQEKLCMLTAELLEYCNAPKSRPPYRPRIGDACCAKYTSDDFWYRAVVLGTSDTDVEVLYADYGNIETLPLCRVQPITSSHLALPFQIIRCSLEGLMELNGSSSQLIIMLLKNFMLNQNVMLSVKGITKNVHTVSVEKCSENGTVDVADKLVTFGLAKNITPQRQSALNTEKMYRMNCCCTELQKQVEKHEHILLFLLNNSTNQNKFIEMKKLLKKTASLGGKPL

SEQ ID NO: 93740 - protein, 1104 aa, Homo sapiens
  Payload ID: 18700
  Gene Name: tudor domain containing 1
  ENSP ID: ENSP00000358286
MSVKSPFNVMSRNNLEAPPCKMTEPFNFEKNENKLPPHESLRSPGTLPNHPNFRLKSSENGNKKNNFLLCEQTKQYLASQEDNSVSSNPNGINGEVVGSKGDRKKLPAGNSVSPPSAESNSPPKEVNIKPGNNVRPAKSKKLNKLVENSLSISNPGLFTSLGPPLRSTTCHRCGLFGSLRCSQCKQTYYCSTACQRRDWSAHSIVCRPVQPNFHKLENKSSIETKDVEVNNKSDCPLGVTKEIAIWAERIMFSDLRSLQLKKTMEIKGTVTEFKHPGDFYVQLYSSEVLEYMNQLSASLKETYANVHEKDYIPVKGEVCIAKYTVDQTWNRAIIQNVDVQQKKAHVLYIDYGNEEIIPLNRIYHLNRNIDLFPPCAIKCFVANVIPAEGNWSSDCIKATKPLLMEQYCSIKIVDILEEEVVTFAVEVELPNSGKLLDHVLIEMGYGLKPSGQDSKKENADQSDPEDVGKMTTENNIVVDKSDLIPKVLTLNVGDEFCGVVAHIQTPEDFFCQQLQSGRKLAELQASLSKYCDQLPPRSDFYPAIGDICCAQFSEDDQWYRASVLAYASEESVLVGYVDYGNFEILSLMRLCPIIPKLLELPMQAIKCVLAGVKPSLGIWTPEAICLMKKLVQNKIITVKVVDKLENSSLVELIDKSETPHVSVSKVLLDAGFAVGEQSMVTDKPSDVKETSVPLGVEGKVNPLEWTWVELGVDQTVDVVVCVIYSPGEFYCHVLKEDALKKLNDLNKSLAEHCQQKLPNGFKAEIGQPCCAFFAGDGSWYRALVKEILPNGHVKVHFVDYGNIEEVTADELRMISSTFLNLPFQGIRCQLADIQSRNKHWSEEAITRFQMCVAGIKLQARVVEVTENGIGVELTDLSTCYPRIISDVLIDEHLVLKSASPHKDLPNDRLVNKHELQVHVQGLQATSSAEQWKTIELPVDKTIQANVLEIISPNLFYALPKGMPENQEKLCMLTAELLEYCNAPKSRPPYRPRIGDACCAKYTSDDFWYRAVVLGTSDTDVEVLYADYGNIETLPLCRVQPITSSHLALPFQIIRCSLEEKMYRMNCCCTELQKQVEKHEHILLFLLNNSTNQNKFIEMKKLLKS

SEQ ID NO: 93741 - protein, 1113 aa, Homo sapiens
  Payload ID: 18700
  Gene Name: tudor domain containing 1
  ENSP ID: ENSP00000358288
MSVKSPFNVMSRNNLEAPPCKMTEPFNFEKNENKLPPHESLRSPGTLPNHPNFRLKSSENGNKKNNFLLCEQTKQYLASQEDNSVSSNPNGINGEVVGSKGDRKKLPAGNSVSPPSAESNSPPKEVNIKPGNNVRPAKSKKLNKLVENSLSISNPGLFTSLGPPLRSTTCHRCGLFGSLRCSQCKQTYYCSTACQRRDWSAHSIVCRPVQPNFHKLENKSSIETKDVEVNNKSDCPLGVTKEIAIWAERIMFSDLRSLQLKKTMEIKGTVTEFKHPGDFYVQLYSSEVLEYMNQLSASLKETYANVHEKDYIPVKGEVCIAKYTVDQTWNRAIIQNVDVQQKKAHVLYIDYGNEEIIPLNRIYHLNRNIDLFPPCAIKCFVANVIPAEGNWSSDCIKATKPLLMEQYCSIKIVDILEEEVVTFAVEVELPNSGKLLDHVLIEMGYGLKPSGQDSKKENADQSDPEDVGKMTTENNIVVDKSDLIPKVLTLNVGDEFCGVVAHIQTPEDFFCQQLQSGRKLAELQASLSKYCDQLPPRSDFYPAIGDICCAQFSEDDQWYRASVLAYASEESVLVGYVDYGNFEILSLMRLCPIIPKLLELPMQAIKCVLAGVKPSLGIWTPEAICLMKKLVQNKIITVKVVDKLENSSLVELIDKSETPHVSVSKVLLDAGFAVGEQSMVTDKPSDVKETSVPLGVEGKVNPLEWTWVELGVDQTVDVVVCVIYSPGEFYCHVLKEDALKKLNDLNKSLAEHCQQKLPNGFKAEIGQPCCAFFAGDGSWYRALVKEILPNGHVKVHFVDYGNIEEVTADELRMISSTFLNLPFQGIRCQLADIQSRNKHWSEEAITRFQMCVAGIKLQARVVEVTENGIGVELTDLSTCYPRIISDVLIDEHLVLKSASPHKDLPNDRLVNKHELQVHVQGLQATSSAEQWKTIELPVDKTIQANVLEIISPNLFYALPKGMPENQEKLCMLTAELLEYCNAPKSRPPYRPRIGDACCAKYTSDDFWYRAVVLGTSDTDVEVLYADYGNIETLPLCRVQPITSSHLALPFQIIRCSLEEKMYRMNCCCTELQKQVEKHEHILLFLLNNSTNQNKFIEMKKLLKKTASLGGKPL

SEQ ID NO: 93742 - protein, 366 aa, Homo sapiens
  Payload ID: 18701
  Gene Name: tudor domain containing 10
  Uniprot ID: Q5VZ19
  ENSP ID: ENSP00000357465
MSWNISHPQLSDKLFGKNGVLEEQKSPGFKKRETEVYVGNLPLDISKEEILYLLKDFNPLDVHKIQNGCKCFAFVDLGSMQKVTLAIQELNGKLFHKRKLFVNTSKRPPKRTPDMIQQPRAPLVLEKASGEGFGKTAAIIQLAPKAPVDLCETEKLRAAFFAVPLEMRGSFLVLLLRECFRDLSWLALIHSVRGEAGLLVTSIVPKTPFFWAMHVTEALHQNMQALFSTLAQAEEQQPYLEGSTVMRGTRCLAEYHLGDYGHAWNRCWVLDRVDTWAVVMFIDFGQLATIPVQSLRSLDSDDFWTIPPLTQPFMLEKDILSSYEVVHRILKGKITGALNSAVTAPASNLAVVPPLLPLGCLQQAAA

SEQ ID NO: 93743 - protein, 351 aa, Homo sapiens
  Payload ID: 18701
  Gene Name: tudor domain containing 10
  Uniprot ID: Q5VZ19
  ENSP ID: ENSP00000357467
MSWNISHPQLSDKLFGKNGVLEEQKSPGFKKRETEVYVGNLPLDISKEEILYLLKDFNPLDVHKIQNGCKCFAFVDLGSMQKVTLAIQELNGKLFHKRKLFVNTSKRPPKRTPDMIQQPRAPLVLEKASGEGFGKTAAIIQLAPKAPVDLCETEKLRAAFFAVPLEMRGSFLVLLLRECFRDLSWLALIHSVRGEAGLLVTSIVPKTPFFWAMHVTEALHQNMQALFSTLAQAEEQQPYLEGSTVMRGTRCLAEYHLGDYGHAWNRCWVLDRVDTWAVVMFIDFGQLATIPVQSLRSLDSDDFWTIPPLTQPFMLEKDILSSYEVVHRILKGKITGALNSALHILKFEESK

SEQ ID NO: 93744 - protein, 395 aa, Homo sapiens
  Payload ID: 18702
  Gene Name: tudor domain containing 12
  Uniprot ID: Q587J7
  ENSP ID: ENSP00000390621
MLQLLVLKIEDPGCFWVIIKGCSPFLDHDVDYQKLNSAMNDFYNSTCQDIEIKPLTLEEGQVCVVYCEELKCWCRAIVKSITSSADQYLAECFLVDFAKNIPVKSKNIRVVVESFMQLPYRAKKFSLYCTKPVTLHIDFCRDSTDIVPAKKWDNAAIQYFQNLLKATTQVEARLCAVEEDTFEVYLYVTIKDEKVCVNDDLVAKNYACYMSPTKNKNLDYLEKPRLNIKSAPSFNKLNPALTLWPMFLQGKDVQGMEDSHGVNFPAQSLQHTWCKGIVGDLRPTATAQDKAVKCNMDSLRDSPKDKSEKKHHCISLKDTNKRVESSVYWPAKRGITIYADPDVPEASALSQKSNEKPLRLTEKKEYDEKNSCVKLLQFLNPDPLRADGISDLQQT

SEQ ID NO: 93745 - protein, 1177 aa, Homo sapiens
  Payload ID: 18702
  Gene Name: tudor domain containing 12
  Uniprot ID: Q587J7
  ENSP ID: ENSP00000416248
MLQLLVLKIEDPGCFWVIIKGCSPFLDHDVDYQKLNSAMNDFYNSTCQDIEIKPLTLEEGQVCVVYCEELKCWCRAIVKSITSSADQYLAECFLVDFAKNIPVKSKNIRVVVESFMQLPYRAKKFSLYCTKPVTLHIDFCRDSTDIVPAKKWDNAAIQYFQNLLKATTQVEARLCAVEEDTFEVYLYVTIKDEKVCVNDDLVAKNYACYMSPTKNKNLDYLEKPRLNIKSAPSFNKLNPALTLWPMFLQGKDVQGMEDSHGVNFPAQSLQHTWCKGIVGDLRPTATAQDKAVKCNMDSLRDSPKDKSEKKHHCISLKDTNKRVESSVYWPAKRGITIYADPDVPEASALSQKSNEKPLRLTEKKEYDEKNSCVKLLQFLNPDPLRADGISDLQQLQKLKGLQPPVVVLRNKIKPCLTIDSSPLSADLKKALQRNKFPGPSHTESYSWPPIARGCDVVVISHCESNPLLYLLPVLTVLQTGACYKSLPSRNGPLAVIVCPGWKKAQFIFELLGEYSMSSRPLHPVLLTIGLHKEEAKNTKLPRGCDVIVTTPYSLLRLLACQSLLFLRLCHLILDEVEVLFLEANEQMFAILDNFKKNIEVEERESAPHQIVAVGVHWNKHIEHLIKEFMNDPYIVITAMEEAALYGNVQQVVHLCLECEKTSSLLQALDFIPSQAQKTLIFTCSVAETEIVCKVVESSSIFCLKMHKEMIFNLQNVLEQWKKKLSSGSQIILALTDDCVPLLAITDATCVIHFSFPASPKVFGGRLYCMSDHFHAEQGSPAEQGDKKAKSVLLLTEKDASHAVGVLRYLERADAKVPAELYEFTAGVLEAKEDKKAGRPLCPYLKAFGFCKDKRICPDRHRINPETDLPRKLSSQALPSFGYIKIIPFYILNATNYFGRIVDKHMDLYATLNAEMNEYFKDSNKTTVEKVEKFGLYGLAEKTLFHRVQVLEVNQKEDAWALDDILVEFIDEGRTGLVTRDQLLHLPEHFHTLPPQAVEFIVCRVKPADNEIEWNPKVTRYIHHKIVGKLHDAKVILALGNTVWIDPMVHITNLSSLKTSVIDYNVRAEILSMGMGIDNPEHIEQLKKLREDAKIPACEESLSQTPPRVTGTSPAQDQDHPSEEQGGQGTPPAEDAACLQSPQPEDTGAEGGAESKTSSENQKPGGYLVFKRWLSSNR

SEQ ID NO: 93746 - protein, 112 aa, Homo sapiens
  Payload ID: 18702
  Gene Name: tudor domain containing 12
  ENSP ID: ENSP00000457498
  MOD_RES (1)..(1): Any amino acid
XKLREDAKIPACEESLSQTPPRVTGTSPAQDQDHPSEEQGGQGSCREPGVNPCLSRLGRLQQKMLLACRAPSLRTRVQKEGLSPRRAQKTRSLKLYLETLKVPSLAELHSRL

SEQ ID NO: 93747 - protein, 1934 aa, Homo sapiens
  Payload ID: 18703
  Gene Name: tudor domain containing 15
  Uniprot ID: B5MCY1
  ENSP ID: ENSP00000384376
MDSTSFLPTFLDVDLTISHIKCLPKDILVKFQGIKSNECEFDYHVLQREIQHTPKVKNNVEIDEFCLVEERVSGEWQRGRVMEKKNELYTVLLIDRGEELRVAGPQIASACGNLFELPPRVVFGIFANILPVGEKWSPKALNYFKSLVGIQVKGYVQAILPLQMFLFEVPKIISQALELQLGRLVDGDSFRLIVEMLEEFPQQMPDLLQHKRPELSLGNKDTSLDIQHVLDKLQPSLSVGSTESVKVSSALSPSKFYCQLIKWTPELENLTAHMTLHYDTVCQETSPTCDNFGLLCVARRRNGQWHRGILQQLLPPNQVKIWFMDYGSSEAIPSIYVKKLKQDFILVPLFSFPCSLTCLHSPDRDARIFQLSIFKQALLGQVVYAHIDWFNKDECLYYVTLQTQESTVNSKCLLKTVGTQVLCPMSDSKISNILSETSVSDVNSFAVESFMGNIEWSIDSLNKKGILKVGFPIKTVQMEIEAAYIAFIAYVLNPSNFWVRTNDHRNEFQEIMKNINKFYDLCENDEMILRKPEPGLFCCARYSKDRRFYRAVITEINGYKINVYFLDYGNTDSIPFFDVKILLPEFCELPALAMCCSLAHIFPVEDLWTKAAIDYFKKLVLNKAILLQVIAKKDDKYTVNIQSVEASENIDVISLMLQAGYAEYFQVELEYFPKSVSEYSMLNSESKNKVNIKKVISALLEGPKSKKYHSNNLVENNLSLPKSLAVNISEFKNPFTLSVGPESSWPYKEYIFRPGTVLEVKCSCYYGPGDFSCQLQCKSEDLKLLMEQIQNYYSIHSDPYEIGQTACVAKYSGKWCRAAVLTQVSKEVDIVFVDYGYQKRVLIEDLCAINPRFLLLESQAFRCCLNHFIEPVSCKLFSWTRKAFRDLWNFISSSRGLLTCIIYALVIIHPNHLYNLVDLQSSFTSAKEFLMNRGSAQYITLSETFPSLFSLYSYCYSSFNIQIGSEEEVYISHIYSPQKFYCQLGRNNKDLEMIETKITESVNLQNFPKYDSNKMRVCISKYVEDGLSYRALAIPTDSSSEFQVYFVDFGNKQLVGENMLRAISAQFPELLFTPMQAIKCFLSDLRDVDIPAEISSWFKDNFLGRSLKAIILSQESDGQLGIELYDGSQYINEKIKVLLHAYGKRHCDQACCMEKSNKINENKRFTTSLKGKTGNNYRHNVINKPSPVTYSERKIDQLMHPKNIHARFLKPSVCYKMEPVSKNKMKTSLNDGLKGIKIVPGAAHILENRRVGQKSVKVVSQSFIRALNQTTSQNPYDLIRPQIKDLPQPQIYLNAKVKGYVSNISNPANFHIQLAENESVIIRLADALNATARRLRERKSVKPLVGDLVVAEYSGDNAIYRAVIKKILPGNSFEVEFIDYGNSAIVNTSKIYELQREFLTVPQLGIHAFLSGVKWNEPDEIWDDKTVDYFTSKVHNKTVYCEFLKKHDQKWEVNMICDEKCVINELLKWKACSKLQKSALQMPQVLSQKVRPGDNEMKKGKSNESEGSMNSNQQLFKIPLEEFKLGQLEKAEMLNVSKSGRFYVKLSKNKKILSDLIVLITKEEKKSPFLSMESIEKGLECLAKSKNTLKWHRSKVEEKYVDDKVLVFLVDCGIYEIVPVCNTKLLSNEIRNIPRQAVPCKWIWFENSKNISFECLFADLEINILFLKYLDAVWEVEILVDDLLLLEYLNLNTVPVEENKLRLAEIVYNIESKTPVSSCTIKSFTWVQFQNDRQYSGIATAVSDPSDFSIQLEDFFDIMKYLFMLLSDLPETLQTLPQEFIIPGSSCLFKYKSEDQWNRVEISEVSPQSLCLVLVDYGFSFYIRYSEIINLKVVPEELLNLPRLSYPCILYGILPAKGKHWSEEAKIFFRDFLSKPDLVFQFREYHSETKLKVDVIHEKNNLADILVASGLATYSKDSPHLDAITATESAKNPI

SEQ ID NO: 93748 - protein, 1934 aa, Homo sapiens; identical to SEQ ID NO: 93747
  Payload ID: 18703
  Gene Name: tudor domain containing 15
  Uniprot ID: B5MCY1
  ENSP ID: ENSP00000478350

SEQ ID NO: 93749 - protein, 651 aa, Homo sapiens
  Payload ID: 18704
  Gene Name: tudor domain containing 3
  Uniprot ID: Q9H7E2
  ENSP ID: ENSP00000196169
MLRLQMTDGHISCTAVEFSYMSKISLNTPPGTKVKLSGIVDIKNGFLLLNDSNTTVLGGEVEHLIEKWELQRSLSKHNRSNIGTEGGPPPFVPFGQKCVSHVQVDSRELDRRKTLQVTMPVKPTNDNDEFEKQRTAAIAEVAKSKETKTFGGGGGGARSNLNMNAAGNRNREVLQKEKSTKSEGKHEGVYRELVDEKALKHITEMGFSKEASRQALMDNGNNLEAALNVLLTSNKQKPVMGPPLRGRGKGRGRIRSEDEEDLGNARPSAPSTLFDFLESKMGTLNVEEPKSQPQQLHQGQYRSSNTEQNGVKDNNHLRHPPRNDTRQPRNEKPPRFQRDSQNSKSVLEGSGLPRNRGSERPSTSSVSEVWAEDRIKCDRPYSRYDRTKDTSYPLGSQHSDGAFKKRDNSMQSRSGKGPSFAEAKENPLPQGSVDYNNQKRGKRESQTSIPDYFYDRKSQTINNEAFSGIKIEKHFNVNTDYQNPVRSNSFIGVPNGEVEMPLKGRRIGPIKPAGPVTAVPCDDKIFYNSGPKRRSGPIKPEKILESSIPMEYAKMWKPGDECFALYWEDNKFYRAEVEALHSSGMTAVVKFIDYGNYEEVLLSNIKPIQTEAWEEEGTYDQTLEFRRGGDGQPRRSTRPTQQFYQPPRARN

SEQ ID NO: 93750 - protein, 651 aa, Homo sapiens; identical to SEQ ID NO: 93749
  Payload ID: 18704
  Gene Name: tudor domain containing 3
  Uniprot ID: Q9H7E2
  ENSP ID: ENSP00000367113

SEQ ID NO: 93751 - protein, 129 aa, Homo sapiens
  Payload ID: 18704
  Gene Name: tudor domain containing 3
  ENSP ID: ENSP00000367114
MLRLQMTDGHISCTAVEFSYMSKISLNTPPGTKVKLSGIVDIKNGFLLLNDSNTTVLGGEVEHLIEKWELQRSLSKHNRSNIGTEGGPPPFVPFGQKCVSHVQVDSRELDRRKTLQVTMPVKPTNDNDE

SEQ ID NO: 93752 - protein, 651 aa, Homo sapiens; identical to SEQ ID NO: 93749
  Payload ID: 18704
  Gene Name: tudor domain containing 3
  Uniprot ID: Q9H7E2
  ENSP ID: ENSP00000367126

SEQ ID NO: 93753 - protein, 116 aa, Homo sapiens
  Payload ID: 18704
  Gene Name: tudor domain containing 3
  ENSP ID: ENSP00000432703
MLRLQMTDGHISCTAVEFSYMSKISLNTPPGTKVKLSGIVDIKNGFLLLNDSNTTVLGGEVEHLIEKWELQRSLSKHNRSNIGTEGGPPPFVPFGQFGRRNSQDKRKCEVLWCDPC

SEQ ID NO: 93754 - protein, 744 aa, Homo sapiens
  Payload ID: 18704
  Gene Name: tudor domain containing 3
  Uniprot ID: Q9H7E2
  ENSP ID: ENSP00000440190
MAQVAGAALSQAGWYLSDEGIEACTSSPDKVNVNDIILIALNTDLRTIGKKFLPSDINSGKVEKLEGPCVLQIQKIRNVAAPKDNEESQAAPRMLRLQMTDGHISCTAVEFSYMSKISLNTPPGTKVKLSGIVDIKNGFLLLNDSNTTVLGGEVEHLIEKWELQRSLSKHNRSNIGTEGGPPPFVPFGQKCVSHVQVDSRELDRRKTLQVTMPVKPTNDNDEFEKQRTAAIAEVAKSKETKTFGGGGGGARSNLNMNAAGNRNREVLQKEKSTKSEGKHEGVYRELVDEKALKHITEMGFSKEASRQALMDNGNNLEAALNVLLTSNKQKPVMGPPLRGRGKGRGRIRSEDEEDLGNARPSAPSTLFDFLESKMGTLNVEEPKSQPQQLHQGQYRSSNTEQNGVKDNNHLRHPPRNDTRQPRNEKPPRFQRDSQNSKSVLEGSGLPRNRGSERPSTSSVSEVWAEDRIKCDRPYSRYDRTKDTSYPLGSQHSDGAFKKRDNSMQSRSGKGPSFAEAKENPLPQGSVDYNNQKRGKRESQTSIPDYFYDRKSQTINNEAFSGIKIEKHFNVNTDYQNPVRSNSFIGVPNGEVEMPLKGRRIGPIKPAGPVTAVPCDDKIFYNSGPKRRSGPIKPEKILESSIPMEYAKMWKPGDECFALYWEDNKFYRAEVEALHSSGMTAVVKFIDYGNYEEVLLSNIKPIQTEAWEEEGTYDQTLEFRRGGDGQPRRSTRPTQQFYQPPRARN

SEQ ID NO: 93755 - protein, 650 aa, Homo sapiens
  Payload ID: 18704
  Gene Name: tudor domain containing 3
  Uniprot ID: Q9H7E2
  ENSP ID: ENSP00000477993
MLRLQMTDGHISCTAVEFSYMSKISLNTPPGTKVKLSGIVDIKNGFLLLNDSNTTVLGGEVEHLIEKWELQRSLSKHNRSNIGTEGGPPPFVPFGQCVSHVQVDSRELDRRKTLQVTMPVKPTNDNDEFEKQRTAAIAEVAKSKETKTFGGGGGGARSNLNMNAAGNRNREVLQKEKSTKSEGKHEGVYRELVDEKALKHITEMGFSKEASRQALMDNGNNLEAALNVLLTSNKQKPVMGPPLRGRGKGRGRIRSEDEEDLGNARPSAPSTLFDFLESKMGTLNVEEPKSQPQQLHQGQYRSSNTEQNGVKDNNHLRHPPRNDTRQPRNEKPPRFQRDSQNSKSVLEGSGLPRNRGSERPSTSSVSEVWAEDRIKCDRPYSRYDRTKDTSYPLGSQHSDGAFKKRDNSMQSRSGKGPSFAEAKENPLPQGSVDYNNQKRGKRESQTSIPDYFYDRKSQTINNEAFSGIKIEKHFNVNTDYQNPVRSNSFIGVPNGEVEMPLKGRRIGPIKPAGPVTAVPCDDKIFYNSGPKRRSGPIKPEKILESSIPMEYAKMWKPGDECFALYWEDNKFYRAEVEALHSSGMTAVVKFIDYGNYEEVLLSNIKPIQTEAWEEEGTYDQTLEFRRGGDGQPRRSTRPTQQFYQPPRARN

SEQ ID NO: 93756 - protein, 981 aa, Homo sapiens
  Payload ID: 18705
  Gene Name: tudor domain containing 5
  Uniprot ID: Q8NAT2
  ENSP ID: ENSP00000294848
MSEQERIQECLRKEIRSLLISTKDGLSPQELEKEYLLMVGNHLPLRILGYRSTMELVLDMPDVVRVCPGAGGTVILKAIPDESTKGIASLVAKQRSSHKLRNSMHKGRPSIYSGPRSHRRVPYRGRVAPILPAVVKSELKDLLALSPVLLSDFEKAFAKRFGRSFQYMQYGFLSMFEVLNAASDVISVEQTRAGSLLMLKKSVTEEKPRGCPAGKIFTQPFRMKQGSYSTGFPVAKPCFSQPTSNMEPPKQIMSMEKTSKLNVVETSRLNHTEKLNQLENTFKSVIAQIGPGGTISSELKHKIKFVVSKFPEGLFISKLLGEYEVIFKEQLSPKKLGFLNVTELVGALSDILHVEFRKGHQDLLVFDADKKPLPPVQSDKKIEAKACVSSPPRNSLSTAAVKETVWNCPSKKQKEPQQKICKKPNLVVKPLQLQVETNKSELNLAMANHDIPPDAVPNKKLCRLPPLDTSSLIGVFVEYIISPSQFYIRIYSRDSSELLEDMMIEMRRCYSNQLVSDRYVMPECFIQPGHLCCVRISEDKWWYRVIIHRVLEKQEVEVFYPDFGNIGIVQKSSLRFLKCCYTKLPAQAIPCSLAWVRPVEEHWTSKAILQFQKLCGLKPLVGVVDEYVDGILNIFLCDTSSNEDVYFHHVLRTEGHAIVCRENISSKGFSELNPLALYTTSSGGPEDIVLTELGYPSQQHYFNEDRKISPQSKESELRILDEIPTGMPCLESVTIGDDIWDENWLPLQAKMGKGGDAASHLFTASLGGKNQYSSCKEMPQKDWCFSTPKDTWDDSWQPSGLVNGTKVEVHKPEVLGAQEKNTGTNRTQKQLDINGSSDSSTLPKLEEFCTSLTQSEQSADGSQSEPNNSQTQPKQIQLSTAAPCSTTAVDDSAEKPSGSVESSPEILKNEDFSSSRAITLYKDKRQESVDQLSLILSYECQISQKLYIPRSTATAALGAAARLATSRSLLHWYPSVKRMEA

SEQ ID NO: 93757 - protein, 981 aa, Homo sapiens; identical to SEQ ID NO: 93756
  Payload ID: 18705
  Gene Name: tudor domain containing 5
  Uniprot ID: Q8NAT2
  ENSP ID: ENSP00000356586

SEQ ID NO: 93758 - protein, 1035 aa, Homo sapiens
  Payload ID: 18705
  Gene Name: tudor domain containing 5
  Uniprot ID: Q8NAT2
  ENSP ID: ENSP00000406052
MSEQERIQECLRKEIRSLLISTKDGLSPQELEKEYLLMVGNHLPLRILGYRSTMELVLDMPDVVRVCPGAGGTVILKAIPDESTKGIASLVAKQRSSHKLRNSMHKGRPSIYSGPRSHRRVPYRGRVAPILPAVVKSELKDLLALSPVLLSDFEKAFAKRFGRSFQYMQYGFLSMFEVLNAASDVISVEQTRAGSLLMLKKSVTEEKPRGCPAGKIFTQPFRMKQGSYSTGFPVAKPCFSQPTSNMEPPKQIMSMEKTSKLNVVETSRLNHTEKLNQLENTFKSVIAQIGPGGTISSELKHKIKFVVSKFPEGLFISKLLGEYEVIFKEQLSPKKLGFLNVTELVGALSDILHVEFRKGHQDLLVFDADKKPLPPVQSDKKIEAKACVSSPPRNSLSTAAVKETVWNCPSKKQKEPQQKICKKPNLVVKPLQLQVETNKSELNLAMANHDIPPDAVPNKKLCRLPPLDTSSLIGVFVEYIISPSQFYIRIYSRDSSELLEDMMIEMRRCYSNQLVSDRYVMPECFIQPGHLCCVRISEDKWWYRVIIHRVLEKQEVEVFYPDFGNIGIVQKSSLRFLKCCYTKLPAQAIPCSLAWVRPVEEHWTSKAILQFQKLCGLKPLVGVVDEYVDGILNIFLCDTSSNEDVYFHHVLRTEGHAIVCRENISSKGFSELNPLALYTTSSGGPEDIVLTELGYPSQQHYFNEDRKISPQSKESELRILQDINDEKSLSHLKSESKEPLKDSEFESLKTCNKSFEEDPKWSNPEPNDLKEENEDEIPTGMPCLESVTIGDDIWDENWLPLQAKMGKGGDAASHLFTASLGGKNQYSSCKEMPQKDWCFSTPKDTWDDSWQPSGLVNGTKVEVHKPEVLGAQEKNTGTNRTQKQLDINGSSDSSTLPKLEEFCTSLTQSEQSADGSQSEPNNSQTQPKQIQLSTAAPCSTTAVDDSAEKPSGSVESSPEILKNEDFSSSRAITLYKDKRQESVDQLSLILSYECQISQKLYIPRSTATAALGAAARLATSRSLLHWYPSVKRMEA

SEQ ID NO: 93759 - protein, 491 aa, Homo sapiens
  Payload ID: 18705
  Gene Name: tudor domain containing 5
  ENSP ID: ENSP00000410744
VIIHRVLEKQEVEVFYPDFGNIGIVQKSSLRFLKCCYTKLPAQAIPCSLAWVRPVEEHWTSKAILQFQKLCGLKPLVGVVDEYVDGILNIFLCDTSSNEDVYFHHVLRTEGHAIVCRENISSKGFSELNPLALYTTSSGGPEDIVLTELGYPSQQHYFNEDRKISPQSKESELRILQDINDEKSLSHLKSESKEPLKDSEFESLKTCNKSFEEDPKWSNPEPNDLKEENEDEIPTGMPCLESVTIGDDIWDENWLPLQAKMGKGGDAASHLFTASLGGKNQYSSCKEMPQKDWCFSTPKDTWDDSWQPSGLVNGTKVEVHKPEVLGAQEKNTGTNRTQKQLDINGSSDSSTLPKLEEFCTSLTQSEQSADGSQSEPNNSQTQPKQIQLSTAAPCSTTAVDDSAEKPSGSVESSPEILKNEDFSSSRAITLYKDKRQESVDQLSLILSYECQISQKLYIPRSTATAALGAAARLATSRSLLHWYPSVKRMEA

SEQ ID NO: 93760 - protein, 2096 aa, Homo sapiens
  Payload ID: 18706
  Gene Name: tudor domain containing 6
  Uniprot ID: O60522
  ENSP ID: ENSP00000346065
MCSTPGMPAPGASLALRVSFVDVHPDVIPVQLWGLVGERRGEYLRLSREIQEAAATRGQWALGSASASPGELCLVQVGLLWHRCRVVSRQAQESRVFLLDEGRTITAGAGSLAPGRREFFNLPSEVLGCVLAGLVPAGCGAGSGEPPQHWPADAVDFLSNLQGKEVHGCVLDVLLLHRLVLLEVPDVFQQMRELGLARRVPDSLFRSLLERYLTAATASVGSGVPVLSRVPLKQKQPGLDYFYPQLQLGVTEAVVITQVCHPHRIHCQLRSVSQEIHRLSESMAQVYRGSTGTGDENSTSATWEEREESPDKPGSPCASCGLDGHWYRALLLETFRPQRCAQVLHVDYGRKELVSCSSLRYLLPEYFRMPVVTYPCALYGLWDGGRGWSRSQVGDLKTLILGKAVNAKIEFYCSFEHVYYVSLYGEDGINLNRVFGVQSCCLADRVLQSQATEEEEPETSQSQSPAEEVDEEISLPALRSIRLKMNAFYDAQVEFVKNPSEFWIRLRKHNVTFSKLMRRMCGFYSSASKLDGVVLKPEPDDLCCVKWKENGYYRAIVTKLDDKSVDVFLVDRGNSENVDWYDVRMLLPQFRQLPILAVKCTLADIWPLGKTWSQEAVSFFKKTVLHKELVIHILDKQDHQYVIEILDESRTGEENISKVIAQAGYAKYQEFETKENILVNAHSPGHVSNHFTTESNKIPFAKTGEGEQKAKRENKTTSVSKALSDTTVVTNGSTELVVQEKVKRASVYFPLMQNCLEIKPGSSSKGELEVGSTVEVRVSYVENPGYFWCQLTRNIQGLKTLMSDIQYYCKNTAAPHQRNTLACLAKRTVNRQWSRALISGIQSVEHVNVTFVDYGDREMVSVKNIYSISEEFLKVKAQAFRCSLYNLIQPVGQNPFVWDVKAIQAFNEFIDNAWQKNLELKCTIFALASINEELFNIVDLLTPFQSACHFLVEKRLARPVKLQKPLESSVQLHSYFYSTHDMKIGSEELVYITHIDDPWTFYCQLARNANILEQLSCSITQLSKVLLNLKTSPLNPGTLCLAKYTDGNWYRGIVIEKEPKKVFFVDFGNIYVVTSDDLLPIPSDAYDVLLLPMQAVRCSLSDIPDHIPEEVVVWFQETILDKSLKALVVAKDPDGTLIIELYGDNIQISASINKKLGLLSYKDRIRKKESEVLCSTTETLEEKNENMKLPCTEYLSKSVGYKLPNKEILEESYKPQINSSYKELKLLQSLTKTNLVTQYQDSVGNKNSQVFPLTTEKKEEISAETPLKTARVEATLSERKIGDSCDKDLPLKFCEFPQKTIMPGFKTTVYVSHINDLSDFYVQLIEDEAEISHLSERLNSVKTRPEYYVGPPLQRGDMICAVFPEDNLWYRAVIKEQQPNDLLSVQFIDYGNVSVVHTNKIGRLDLVNAILPGLCIHCSLQGFEVPDNKNSKKMMHYFSQRTSEAAIRCEFVKFQDRWEVILADEHGIIADDMISRYALSEKSQVELSTQVIKSASSKSVNKSDIDTSVFLNWYNPEKKMIRAYATVIDGPEYFWCQFADTEKLQCLEVEVQTAGEQVADRRNCIPCPYIGDPCIVRYREDGHYYRALITNICEDYLVSVRLVDFGNIEDCVDPKALWAIPSELLSVPMQAFPCCLSGFNISEGLCSQEGNDYFYEIITEDVLEITILEIRRDVCDIPLAIVDLKSKGKSINEKMEKYSKTGIKSALPYENIDSEIKQTLGSYNLDVGLKKLSNKAVQNKIYMEQQTDELAEITEKDVNIIGTKPSNFRDPKTDNICEGFENPCKDKIDTEELEGELECHLVDKAEFDDKYLITGFNTLLPHANETKEILELNSLEVPLSPDDESKEFLELESIELQNSLVVDEEKGELSPVPPNVPLSQECVTKGAMELFTLQLPLSCEAEKQPELELPTAQLPLDDKMDPLSLGVSQKAQESMCTEDMRKSSCVESFDDQRRMSLHLHGADCDPKTQNEMNICEEEFVEYKNRDAISALMPLFSEEESSDGSKHNNGLPDHISAQLQNTYTLKAFTVGSKCVVWSSLRNTWSKCEILETAEEGTRVLNLSNGMEEIVNPENVWNGIPKLDKSPPEKRGLEVMEI

SEQ ID NO: 93761 - protein, 175 aa, Homo sapiens
  Payload ID: 18706
  Gene Name: tudor domain containing 6
  ENSP ID: ENSP00000397165
  MOD_RES (1)..(1): Any amino acid
XFDDQRRMSLHLHGADCDPKTQNEMNICEEEFVEYKNRDAISALMPLFSEEESSDGSKHNNGLPDHISAQLQNTYTLKAFTVGSKCVVWSSLRNTWSKCEILETAEEGTRVLNLSNGMEEIVNPENVWNGIPKLDKSPPEAVSQRVGKDLYFMSVGDTTIKEKGFGGDGDLTVDL

SEQ ID NO: 93762 - protein, 2066 aa, Homo sapiens
  Payload ID: 18706
  Gene Name: tudor domain containing 6
  Uniprot ID: O60522
  ENSP ID: ENSP00000443299
MCSTPGMPAPGASLALRVSFVDVHPDVIPVQLWGLVGERRGEYLRLSREIQEAAATRGQWALGSASASPGELCLVQVGLLWHRCRVVSRQAQESRVFLLDEGRTITAGAGSLAPGRREFFNLPSEVLGCVLAGLVPAGCGAGSGEPPQHWPADAVDFLSNLQGKEVHGCVLDVLLLHRLVLLEVPDVFQQMRELGLARRVPDSLFRSLLERYLTAATASVGSGVPVLSRVPLKQKQPGLDYFYPQLQLGVTEAVVITQVCHPHRIHCQLRSVSQEIHRLSESMAQVYRGSTGTGDENSTSATWEEREESPDKPGSPCASCGLDGHWYRALLLETFRPQRCAQVLHVDYGRKELVSCSSLRYLLPEYFRMPVVTYPCALYGLWDGGRGWSRSQVGDLKTLILGKAVNAKIEFYCSFEHVYYVSLYGEDGINLNRVFGVQSCCLADRVLQSQATEEEEPETSQSQSPAEEVDEEISLPALRSIRLKMNAFYDAQVEFVKNPSEFWIRLRKHNVTFSKLMRRMCGFYSSASKLDGVVLKPEPDDLCCVKWKENGYYRAIVTKLDDKSVDVFLVDRGNSENVDWYDVRMLLPQFRQLPILAVKCTLADIWPLGKTWSQEAVSFFKKTVLHKELVIHILDKQDHQYVIEILDESRTGEENISKVIAQAGYAKYQEFETKENILVNAHSPGHVSNHFTTESNKIPFAKTGEGEQKAKRENKTTSVSKALSDTTVVTNGSTELVVQEKVKRASVYFPLMQNCLEIKPGSSSKGELEVGSTVEVRVSYVENPGYFWCQLTRNIQGLKTLMSDIQYYCKNTAAPHQRNTLACLAKRTVNRQWSRALISGIQSVEHVNVTFVDYGDREMVSVKNIYSISEEFLKVKAQAFRCSLYNLIQPVGQNPFVWDVKAIQAFNEFIDNAWQKNLELKCTIFALASINEELFNIVDLLTPFQSACHFLVEKRLARPVKLQKPLESSVQLHSYFYSTHDMKIGSEELVYITHIDDPWTFYCQLARNANILEQLSCSITQLSKVLLNLKTSPLNPGTLCLAKYTDGNWYRGIVIEKEPKKVFFVDFGNIYVVTSDDLLPIPSDAYDVLLLPMQAVRCSLSDIPDHIPEEVVVWFQETILDKSLKALVVAKDPDGTLIIELYGDNIQISASINKKLGLLSYKDRIRKKESEVLCSTTETLEEKNENMKLPCTEYLSKSVGYKLPNKEILEESYKPQINSSYKELKLLQSLTKTNLVTQYQDSVGNKNSQVFPLTTEKKEEISAETPLKTARVEATLSERKIGDSCDKDLPLKFCEFPQKTIMPGFKTTVYVSHINDLSDFYVQLIEDEAEISHLSERLNSVKTRPEYYVGPPLQRGDMICAVFPEDNLWYRAVIKEQQPNDLLSVQFIDYGNVSVVHTNKIGRLDLVNAILPGLCIHCSLQGFEVPDNKNSKKMMHYFSQRTSEAAIRCEFVKFQDRWEVILADEHGIIADDMISRYALSEKSQVELSTQVIKSASSKSVNKSDIDTSVFLNWYNPEKKMIRAYATVIDGPEYFWCQFADTEKLQCLEVEVQTAGEQVADRRNCIPCPYIGDPCIVRYREDGHYYRALITNICEDYLVSVRLVDFGNIEDCVDPKALWAIPSELLSVPMQAFPCCLSGFNISEGLCSQEGNDYFYEIITEDVLEITILEIRRDVCDIPLAIVDLKSKGKSINEKMEKYSKTGIKSALPYENIDSEIKQTLGSYNLDVGLKKLSNKAVQNKIYMEQQTDELAEITEKDVNIIGTKPSNFRDPKTDNICEGFENPCKDKIDTEELEGELECHLVDKAEFDDKYLITGFNTLLPHANETKEILELNSLEVPLSPDDESKEFLELESIELQNSLVVDEEKGELSPVPPNVPLSQECVTKGAMELFTLQLPLSCEAEKQPELELPTAQLPLDDKMDPLSLGVSQKAQESMCTEDMRKSSCVESFDDQRRMSLHLHGADCDPKTQNEMNICEEEFVEYKNRDAISALMPLFSEEESSDGSKHNNGLPDHISAQLQNTYTLKAFTVGSKCVVWSSLRNTWSKCEILETAEEGTRKRGLEVMEI

SEQ ID NO: 93763 - protein, 1098 aa, Homo sapiens
  Payload ID: 18707
  Gene Name: tudor domain containing 7
  Uniprot ID: Q8NHU6
  ENSP ID: ENSP00000347444
MLEGDLVSKMLRAVLQSHKNGVALPRLQGEYRSLTGDWIPFKQLGFPTLEAYLRSVPAVVRIETSRSGEITCYAMACTETARIAQLVARQRSSKRKTGRQVNCQMRVKKTMPFFLEGKPKATLRQPGFASNFSVGKKPNPAPLRDKGNSVGVKPDAEMSPYMLHTTLGNEAFKDIPVQRHVTMSTNNRFSPKASLQPPLQMHLSRTSTKEMSDNLNQTVEKPNVKPPASYTYKMDEVQNRIKEILNKHNNGIWISKLPHFYKELYKEDLNQGILQQFEHWPHICTVEKPCSGGQDLLLYPAKRKQLLRSELDTEKVPLSPLPGPKQTPPLKGCPTVMAGDFKEKVADLLVKYTSGLWASALPKAFEEMYKVKFPEDALKNLASLSDVCSIDYISGNPQKAILYAKLPLPTDKIQKDAGQAHGDNDIKAMVEQEYLQVEESIAESANTFMEDITVPPLMIPTEASPSVLVVELSNTNEVVIRYVGKDYSAAQELMEDEMKEYYSKNPKITPVQAVNVGQLLAVNAEEDAWLRAQVISTEENKIKVCYVDYGFSENVEKSKAYKLNPKFCSLSFQATKCKLAGLEVLSDDPDLVKVVESLTCGKIFAVEILDKADIPLVVLYDTSGEDDININATCLKAICDKSLEVHLQVDAMYTNVKVTNICSDGTLYCQVPCKGLNKLSDLLRKIEDYFHCKHMTSECFVSLPFCGKICLFHCKGKWLRVEITNVHSSRALDVQFLDSGTVTSVKVSELREIPPRFLQEMIAIPPQAIKCCLADLPQSIGMWTPDAVLWLRDSVLNCSDCSIKVTKVDETRGIAHVYLFTPKNFPDPHRSINRQITNADLWKHQKDVFLSAISSGADSPNSKNGNMPMSGNTGENFRKNLTDVIKKSMVDHTSAFSTEELPPPVHLSKPGEHMDVYVPVACHPGYFVIQPWQEIHKLEVLMEEMILYYSVSEERHIAVEKDQVYAAKVENKWHRVLLKGILTNGLVSVYELDYGKHELVNIRKVQPLVDMFRKLPFQAVTAQLAGVKCNQWSEEASMVFRNHVEKKPLVALVQTVIENANPWDRKVVVYLVDTSLPDTDTWIHDFMSEYLIELSKVN

SEQ ID NO: 93764 - protein, 877 aa, Homo sapiens [sequence omitted]

SEQ ID NO: 93765 - protein, 1382 aa, Homo sapiens
  Payload ID: 18708
  Gene Name: tudor domain containing 9
  Uniprot ID: Q8NDG6
  ENSP ID: ENSP00000387303
MLRKLTIEQINDWFTIGKTVTNVELLGAPPAFPAGAAREEVQRQDVAPGAGPAAQAPALAQAPARPAAAFERSLSQRSSEVEYINKYRQLEAQELDVCRSVQPTSGPGPRPSLAKLSSVTCIPGTTYKYPDLPISRYKEEVVSLIESNSVVIIHGATGSGKSTQLPQYILDHYVQRSAYCSIVVTQPRKIGASSIARWISKERAWTLGGVVGYQVGLEKIATEDTRLIYMTTGVLLQKIVSAKSLMEFTHIIIDEVHERTEEMDFLLLVVRKLLRTNSRFVKVVLMSATISCKEFADYFAVPVQNKMNPAYIFEVEGKPHSVEEYYLNDLEHIHHSKLSPHLLEEPVITKDIYEVAVSLIQMFDDLDMKESGNKAWSGAQFVLERSSVLVFLPGLGEINYMHELLTSLVHKRLQVYPLHSSVALEEQNNVFLSPVPGYRKIILSTNIAESSVTVPDVKYVIDFCLTRTLVCDEDTNYQSLRLSWASKTSCNQRKGRAGRVSRGYCYRLVHKDFWDNSIPDHVVPEMLRCPLGSTILKVKLLDMGEPRALLATALSPPGLSDIERTILLLKEVGALAVSGQREDENPHDGELTFLGRVLAQLPVNQQLGKLIVLGHVFGCLDECLIIAAALSLKNFFAMPFRQHLDGYRNKVNFSGSSKSDCIALVEAFKTWKACRQTGELRYPKDELNWGRLNYIQIKRIREVAELYEELKTRISQFNMHVDSRRPVMDQEYIYKQRFILQVVLAGAFYPNYFTFGQPDEEMAVRELAGKDPKTTVVLKHIPPYGFLYYKQLQSLFRQCGQVKSIVFDGAKAFVEFSRNPTERFKTLPAVYMAIKMSQLKVSLELSVHSAEEIEGKVQGMNVSKLRNTRVNVDFQKQTVDPMQVSFNTSDRSQTVTDLLLTIDVTEVVEVGHFWGYRIDENNSEILKKLTAEINQLTLVPLPTHPHPDLVCLAPFADFDKQRYFRAQVLYVSGNSAEVFFVDYGNKSHVDLHLLMEIPCQFLELPFQALEFKICKMRPSAKSLVCGKHWSDGASQWFASLVSGCTLLVKVFSVVHSVLHVDVYQYSGVQDAINIRDVLIQQGYAELTEESYESKQSHEVLKGLFSKSVENMTDGSVPFPMKDDEKYLIRILLESFSTNKLGTPNCKAELHGPFNPYELKCHSLTRISKFRCVWIEKESINSVIISDAPEDLHQRMLVAASLSINATGSTMLLRETSLMPHIPGLPALLSMLFAPVIELRIDQNGKYYTGVLCGLGWNPATGASILPEHDMELAFDVQFSVEDVVEVNILRAAINKLVCDGPNGCKCLGPERVAQLQDIARQKLLGLFCQSKPREKIVPKWHEKPYEWNQVDPKLVMEQADRESSRGKNTFLYQLHKLVVLGT

SEQ ID NO: 93766 - protein, 918 aa, Homo sapiens
  Payload ID: 18708
  Gene Name: tudor domain containing 9
  ENSP ID: ENSP00000451637
  MOD_RES (1)..(1): Any amino acid
XRTNSRFVKVVLMSATISCKEFADYFAVPVQNKMNPAYIFEVEGKPHSVEEYYLNDLEHIHHSKLSPHLLEEPVITKDIYEVAVSLIQMFDDLDMKESGNKAWSGAQFVLERSSVLVFLPGLGEINYMHELLTSLVHKRLQVYPLHSSVALEEQNNVFLSPVPGYRKIILSTNIAESSVTVPDVKYVIDFCLTRTLVCDEDTNYQSLRLSWASKTSCNQRKGRAGRVSRGYCYRLVHKDFWDNSIPDHVVPEMLRCPLGSTILKVKLLDMGEPRALLATALSPPGLSDIERTILLLKEVGALAVSGQREDENPHDGELTFLGRVLAQLPVNQQLGKLIVLGHVFGCLDECLIIAAALSLKNFFAMPFRQHLDGYRNKVNFSGSSKSDCIALVEAFKTWKACRQTGELRYPKDELNWGRLNYIQIKRIREVAELYEELKTRISQFNMHVDSRRPVMDQEYIYKQRFILQVVLAGAFYPNYFTFGQPDEEMAVRELAGKDPKTTVVLKHIPPYGFLYYKQLQSLFRQCGQVKSIVFDGAKAFVEFSRNPTERFKTLPAVYMAIKMSQLKVSLELSVHSAEEIEGKVQGMNVSKLRNTRVNVDFQKQTVDPMQVSFNTSDRSQTVTDLLLTIDVTEVVEVGHFWGYRIDENNSEILKKLTAEINQLTLVPLPTHPHPDLVCLAPFADFDKQRYFRAQVLYVSGNSAEVFFVDYGNKSHVDLHLLMEIPCQFLELPFQALEFKICKMRPSAKSLVCGKHWSDGASQWFASLVSGCTLLVKVFSVVHSVLHVDVYQYSGVQDAINIRDVLIQQGYAELTEESYESKVNILRAAINKLVCDGPNGCKCLGPERVAQLQDIARQKLLGLFCQSKPREKIVPKWHEKPYEWNQVDPKLVMEQADRESSRGKNTFLYQLHKLVVLGT

SEQ ID NO: 93767 - protein, 199 aa, Homo sapiens [sequence omitted]

SEQ ID NO: 93768 - protein, 365 aa, Homo sapiens
  Payload ID: 18709
  Gene Name: tuftelin 1
  Uniprot ID: Q9NNX1
  ENSP ID: ENSP00000357841
MNGTRNWCTLVDVHPEDQAAAGRKTYAMVSSHSAGHSLASELVESHDGHEEIIKVYLKGRSGDKMIHEKNINQLKSEVQYIQEARNCLQKLREDISSKLDRNLGDSLHRQEIQVVLEKPNGFSQSPTALYSSPPEVDTCINEDVESLRKTVQDLLAKLQEAKRQHQSDCVAFEVTLSRYQREAEQSNVALQREEDRVEQKEAEVGELQRRLLGMETEHQALLAKVREGEVALEELRSNNADCQAEREKAATLEKEVAGLREKIHHLDDMLKSQQRKVRQMIEQLQNSKAVIQSKDATIQELKEKIAYLEAENLEMHDRMEHLIEKQISHGNFSTQARAKTENPGSIRISKPPSPKPMPVIRVVET

SEQ ID NO: 93769 - protein, 390 aa, Homo sapiens
  Payload ID: 18709
  Gene Name: tuftelin 1
  Uniprot ID: Q9NNX1
  ENSP ID: ENSP00000357842
MNGTRNWCTLVDVHPEDQAAGSVDILRLTLQGELTGDELEHIAQKAGRKTYAMVSSHSAGHSLASELVESHDGHEEIIKVYLKGRSGDKMIHEKNINQLKSEVQYIQEARNCLQKLREDISSKLDRNLGDSLHRQEIQVVLEKPNGFSQSPTALYSSPPEVDTCINEDVESLRKTVQDLLAKLQEAKRQHQSDCVAFEVTLSRYQREAEQSNVALQREEDRVEQKEAEVGELQRRLLGMETEHQALLAKVREGEVALEELRSNNADCQAEREKAATLEKEVAGLREKIHHLDDMLKSQQRKVRQMIEQLQNSKAVIQSKDATIQELKEKIAYLEAENLEMHDRMEHLIEKQISHGNFSTQARAKTENPGSIRISKPPSPKPMPVIRVVET

SEQ ID NO: 93770 - protein, 335 aa, Homo sapiens
  Payload ID: 18709
  Gene Name: tuftelin 1
  ENSP ID: ENSP00000376476
MNGTRNWCTLVDVHPEDQAAAGRKTYAMVSSHSAGHSLASELVESHDGHEEIIKVYLKGRSGDKMIHEKNINQLKSEVQYIQEVVLEKPNGFSQSPTALYSSPPEVDTCINEDVESLRKTVQDLLAKLQEAKRQHQSDCVAFEVTLSRYQREAEQSNVALQREEDRVEQKEAEVGELQRRLLGMETEHQALLAKVREGEVALEELRSNNADCQAEREKAATLEKEVAGLREKIHHLDDMLKSQQRKVRQMIEQLQNSKAVIQSKDATIQELKEKIAYLEAENLEMHDRMEHLIEKQISHGNFSTQARAKTENPGSIRISKPPSPKPMPVIRVVET

SEQ ID NO: 93771 - protein, 837 aa, Homo sapiens
  Payload ID: 18710
  Gene Name: tuftelin interacting protein 11
  Uniprot ID: Q9UBB9
  ENSP ID: ENSP00000383892
MSLSHLYRDGEGRIDDDDDERENFEITDWDLQNEFNPNRQRHWQTKEEATYGVWAERDSDDERPSFGGKRARDYSAPVNFISAGLKKGAAEEAELEDSDDEEKPVKQDDFPKDFGPRKLKTGGNFKPSQKGFAGGTKSFMDFGSWERHTKGIGQKLLQKMGYVPGRGLGKNAQGIINPIEAKQRKGKGAVGAYGSERTTQSMQDFPVVDSEEEAEEEFQKELSQWRKDPSGSKKKPKYSYKTVEELKAKGRISKKLTAPQKELSQVKVIDMTGREQKVYYSYSQISHKHNVPDDGLPLQSQQLPQSGKEAKAPGFALPELEHNLQLLIDLTEQEIIQNDRQLQYERDMVVNLFHELEKMTEVLDHEERVISNLSKVLEMVEECERRMQPDCSNPLTLDECARIFETLQDKYYEEYRMSDRVDLAVAIVYPLMKEYFKEWDPLKDCTYGTEIISKWKSLLENDQLLSHGGQDLSADAFHRLIWEVWMPFVRNIVTQWQPRNCDPMVDFLDSWVHIIPVWILDNILDQLIFPKLQKEVENWNPLTDTVPIHSWIHPWLPLMQARLEPLYSPIRSKLSSALQKWHPSDSSAKLILQPWKDVFTPGSWEAFMVKNIVPKLGMCLGELVINPHQQHMDAFYWVIDWEGMISVSSLVGLLEKHFFPKWLQVLCSWLSNSPNYEEITKWYLGWKSMFSDQVLAHPSVKDKFNEALDIMNRAVSSNVGAYMQPGARENIAYLTHTERRKDFQYEAMQERREAENMAQRGIGVAASSVPMNFKDLIETKAEEHNIVFMPVIGKRHEGKQLYTFGRIVIYIDRGVVFVQGEKTWVPTSLQSLIDMAK

SEQ ID NO: 93772 - protein, 837 aa, Homo sapiens; identical to SEQ ID NO: 93771
  Payload ID: 18710
  Gene Name: tuftelin interacting protein 11
  Uniprot ID: Q9UBB9
  ENSP ID: ENSP00000384297

SEQ ID NO: 93773 - protein, 837 aa, Homo sapiens; identical to SEQ ID NO: 93771
  Payload ID: 18710
  Gene Name: tuftelin interacting protein 11
  Uniprot ID: Q9UBB9
  ENSP ID: ENSP00000384421

SEQ ID NO: 93774 - protein, 837 aa, Homo sapiens; identical to SEQ ID NO: 93771
  Payload ID: 18710
  Gene Name: tuftelin interacting protein 11
  Uniprot ID: Q9UBB9
  ENSP ID: ENSP00000385861

SEQ ID NO: 93775 - protein, 190 aa, Homo sapiens
  Payload ID: 18710
  Gene Name: tuftelin interacting protein 11
  ENSP ID: ENSP00000394266
  MOD_RES (1)..(1): Any amino acid
XGRGLGKNAQGIINPIEAKQRKGKGAVGAYGSERTTQSMQDFPVVDSEEEAEEWLFLAASDCILLVQEFQKELSQWRKDPSGSKKKPKYSYKTVEELKAKGRISKKLTAPQKELSQVKVIDMTGREQKVYYSYSQISHKHNVPDDGLPLQSQQLPQSGKEAKAPGFALPELEHNLQLLIDLTEQEIIQND

SEQ ID NO: 93776 - protein, 86 aa, Homo sapiens
  Payload ID: 18710
  Gene Name: tuftelin interacting protein 11
  ENSP ID: ENSP00000397475
MSLSHLYRDGEGRIDDDDDERENFEITDWDLQNEFNPNRQRHWQTKEEATYGVWAERDSDDERPSFGGKRARDYSAPVNFISAGLK

SEQ ID NO: 93777 - protein, 121 aa, Homo sapiens
  Payload ID: 18710
  Gene Name: tuftelin interacting protein 11
  ENSP ID: ENSP00000399347
MSLSHLYRDGEGRIDDDDDERENFEITDWDLQNEFNPNRQRHWQTKEEATYGVWAERDSDDERPSFGGKRARDYSAPVNFISAGLKKGAAEEAELEDSDDEEKPVKQDDFPKDFGPRKLKT

SEQ ID NO: 93778 - protein, 88 aa, Homo sapiens
  Payload ID: 18710
  Gene Name: tuftelin interacting protein 11
  ENSP ID: ENSP00000404973
MSLSHLYRDGEGRIDDDDDERENFEITDWDLQNEFNPNRQRHWQTKEEATYGVWAERDSDDERPSFGGKRARDYSAPVNFISAGLKKG

SEQ ID NO: 93779 - protein, 42 aa, Homo sapiens
  Payload ID: 18710
  Gene Name: tuftelin interacting protein 11
  ENSP ID: ENSP00000411840
MSLSHLYRDGEGRIDDDDDERENFEITDWDLQNEFNPNRQRH

SEQ ID NO: 93780 - protein, 837 aa, Homo sapiens; identical to SEQ ID NO: 93771
  Payload ID: 18710
  Gene Name: tuftelin interacting protein 11
  Uniprot ID: Q9UBB9
  ENSP ID: ENSP00000480171

SEQ ID NO: 93781 - protein, 233 aa, Homo sapiens
  Payload ID: 18711
  Gene Name: tumor necrosis factor
  Uniprot ID: P01375
  ENSP ID: ENSP00000365290
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 93782 - protein, 233 aa, Homo sapiens; identical to SEQ ID NO: 93781
  Payload ID: 18711
  Gene Name: tumor necrosis factor
  Uniprot ID: P01375
  ENSP ID: ENSP00000372988

SEQ ID NO: 93783 - protein, 171 aa, Homo sapiens
  Payload ID: 18711
  Gene Name: tumor necrosis factor
  ENSP ID: ENSP00000389265
FPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 93784 - protein, 233 aa, Homo sapiens; identical to SEQ ID NO: 93781
  Payload ID: 18711
  Gene Name: tumor necrosis factor
  Uniprot ID: P01375
  ENSP ID: ENSP00000389490

SEQ ID NO: 93785 - protein, 233 aa, Homo sapiens; identical to SEQ ID NO: 93781
  Payload ID: 18711
  Gene Name: tumor necrosis factor
  Uniprot ID: P01375
  ENSP ID: ENSP00000389492

SEQ ID NO: 93786 - protein, 233 aa, Homo sapiens; identical to SEQ ID NO: 93781
  Payload ID: 18711
  Gene Name: tumor necrosis factor
  Uniprot ID: P01375
  ENSP ID: ENSP00000392858

SEQ ID NO: 93787 - protein, 233 aa, Homo sapiens; identical to SEQ ID NO: 93781
  Payload ID: 18711
  Gene Name: tumor necrosis factor
  Uniprot ID: P01375
  ENSP ID: ENSP00000398698

SEQ ID NO: 93788 - protein, 233 aa, Homo sapiens; identical to SEQ ID NO: 93781
  Payload ID: 18711
  Gene Name: tumor necrosis factor
  Uniprot ID: P01375
  ENSP ID: ENSP00000410668

SEQ ID NO: 93789 - protein, 281 aa, Homo sapiens [sequence omitted]

SEQ ID NO: 93790 - protein, 101 aa, Homo sapiens
  Payload ID: 18712
  Gene Name: tumor necrosis factor (ligand) superfamily, member 10
  Uniprot ID: P50591
  ENSP ID: ENSP00000389931
MAMMEVQGGPSLGQTCVLIVIFTVLLQSLCVAVTYVYFTNELKQMQDKYSKSGIACFLKEDDSYWDPNDEESMNSPCWQVKWQLRQLVRKTPRMKRLWAAK

SEQ ID NO: 93791 - protein, 74 aa, Homo sapiens
  Payload ID: 18712
  Gene Name: tumor necrosis factor (ligand) superfamily, member 10
  ENSP ID: ENSP00000404008
  MOD_RES (1)..(1): Any amino acid
XLQSLCVAVTYVYFTNELKQMQDKYSKSGIACFLKEDDSYWDPNDEESMNSPCWQVKWQLRQLVRKKSNKIFLP

SEQ ID NO: 93792 - protein, 270 aa, Homo sapiens
  Payload ID: 18713
  Gene Name: tumor necrosis factor (ligand) superfamily, member 11
  Uniprot ID: O14788
  ENSP ID: ENSP00000239849
MFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 93793 - protein, 244 aa, Homo sapiens
  Payload ID: 18713
  Gene Name: tumor necrosis factor (ligand) superfamily, member 11
  Uniprot ID: O14788
  ENSP ID: ENSP00000351347
MDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 93794 - protein, 317 aa, Homo sapiens
  Payload ID: 18713
  Gene Name: tumor necrosis factor (ligand) superfamily, member 11
  Uniprot ID: O14788
  ENSP ID: ENSP00000381775
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 93795 - protein, 244 aa, Homo sapiens; identical to SEQ ID NO: 93793
  Payload ID: 18713
  Gene Name: tumor necrosis factor (ligand) superfamily, member 11
  Uniprot ID: O14788
  ENSP ID: ENSP00000384042

SEQ ID NO: 93796 - protein, 244 aa, Homo sapiens; identical to SEQ ID NO: 93793
  Payload ID: 18713
  Gene Name: tumor necrosis factor (ligand) superfamily, member 11
  Uniprot ID: O14788
  ENSP ID: ENSP00000444913

SEQ ID NO: 93797 - protein, 249 aa, Homo sapiens
  Payload ID: 18714
  Gene Name: tumor necrosis factor (ligand) superfamily, member 12
  Uniprot ID: O43508
  ENSP ID: ENSP00000293825
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 93798 - protein, 134 aa, Homo sapiens
  Payload ID: 18714
  Gene Name: tumor necrosis factor (ligand) superfamily, member 12
  ENSP ID: ENSP00000314636
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQADGGYTTCLRP

SEQ ID NO: 93799 - protein, 234 aa, Homo sapiens
  Payload ID: 18715
  Gene Name: tumor necrosis factor (ligand) superfamily, member 13
  Uniprot ID: O75888
  ENSP ID: ENSP00000314455
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKNDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 93800 - protein, 250 aa, Homo sapiens [sequence omitted]

SEQ ID NO: 93801 - protein, 223 aa, Homo sapiens
  Payload ID: 18715
  Gene Name: tumor necrosis factor (ligand) superfamily, member 13
  ENSP ID: ENSP00000369908
MPASSPFLLAPKGPPGNMGGPVREPALSVALWLSWGAALGAVACAMALLTQQTELQSLRREVSRLQGTGGPSQNGEGYPWQSLPEQQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 93802 - protein, 205 aa, Homo sapiens
  Payload ID: 18715
  Gene Name: tumor necrosis factor (ligand) superfamily, member 13
  Uniprot ID: O75888
  ENSP ID: ENSP00000379792
MGGPVREPALSVALWLSWGAALGAVACAMALLTQQTELQSLRREVSRLQGTGGPSQNGEGYPWQSLPEQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 93803 - protein, 247 aa, Homo sapiens
  Payload ID: 18715
  Gene Name: tumor necrosis factor (ligand) superfamily, member 13
  Uniprot ID: O75888
  ENSP ID: ENSP00000379794
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGL

SEQ ID NO: 93804 - protein, 150 aa, Homo sapiens
  Payload ID: 18715
  Gene Name: tumor necrosis factor (ligand) superfamily, member 13
  ENSP ID: ENSP00000390771
MGGPVREPALSVALWLSWGAALGAVACAMALLTQQTELQSLRREVSRLQGTGGPSQNGEGYPWQSLPEQSSDALEAWENGERSRKRRAVLTQKQKNDSDVTEVMWQPALRRGRGLQAQGYGVRIQDAGVYLLYSQVLFQDVTFTMGQVVS

SEQ ID NO: 93805 - protein, 158 aa, Homo sapiens
  Payload ID: 18715
  Gene Name: tumor necrosis factor (ligand) superfamily, member 13
  ENSP ID: ENSP00000410094
MGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVT

SEQ ID NO: 93806 - protein, 114 aa, Homo sapiens
  Payload ID: 18715
  Gene Name: tumor necrosis factor (ligand) superfamily, member 13
  ENSP ID: ENSP00000464998
MWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 93807 - protein, 222 aa, Homo sapiens
  Payload ID: 18715
  Gene Name: tumor necrosis factor (ligand) superfamily, member 13
  Uniprot ID: O75888
  ENSP ID: ENSP00000486052
MPASSPFLLAPKGPPGNMGGPVREPALSVALWLSWGAALGAVACAMALLTQQTELQSLRREVSRLQGTGGPSQNGEGYPWQSLPEQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 93808 - protein, 285 aa, Homo sapiens
  Payload ID: 18716
  Gene Name: tumor necrosis factor (ligand) superfamily, member 13b
  Uniprot ID: Q9Y275
  ENSP ID: ENSP00000365048
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 93809 - protein, 266 aa, Homo sapiens
  Payload ID: 18716
  Gene Name: tumor necrosis factor (ligand) superfamily, member 13b
  Uniprot ID: Q9Y275
  ENSP ID: ENSP00000389540
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 93810 - protein, 164 aa, Homo sapiens
  Payload ID: 18716
  Gene Name: tumor necrosis factor (ligand) superfamily, member 13b
  Uniprot ID: Q9Y275
  ENSP ID: ENSP00000445334
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGFIY

SEQ ID NO: 93811 - protein, 204 aa, Homo sapiens
  Payload ID: 18717
  Gene Name: tumor necrosis factor (ligand) superfamily, member 14
  Uniprot ID: O43557
  ENSP ID: ENSP00000245912
MEESVVRPSVFVVDGQTDIPFTRLGRSHRRQSCSVARDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 93812 - protein, 240 aa, Homo sapiens
  Payload ID: 18717
  Gene Name: tumor necrosis factor (ligand) superfamily, member 14
  Uniprot ID: O43557
  ENSP ID: ENSP00000469049
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 93813 - protein, 174 aa, Homo sapiens
  Payload ID: 18718
  Gene Name: tumor necrosis factor (ligand) superfamily, member 15
  ENSP ID: ENSP00000363156
MRHFLSKVYSFPMRKLILFLVFPVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 93814 - protein, 251 aa, Homo sapiens
  Payload ID: 18718
  Gene Name: tumor necrosis factor (ligand) superfamily, member 15
  Uniprot ID: O95150
  ENSP ID: ENSP00000363157
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 93815 - protein, 199 aa, Homo sapiens
  Payload ID: 18719
  Gene Name: tumor necrosis factor (ligand) superfamily, member 18
  Uniprot ID: Q9UNG2
  ENSP ID: ENSP00000385470
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 93816 - protein, 183 aa, Homo sapiens
  Payload ID: 18720
  Gene Name: tumor necrosis factor (ligand) superfamily, member 4
  Uniprot ID: P23510
  ENSP ID: ENSP00000281834
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 93817 - protein, 133 aa, Homo sapiens
  Payload ID: 18720
  Gene Name: tumor necrosis factor (ligand) superfamily, member 4
  Uniprot ID: P23510
  ENSP ID: ENSP00000356691
MVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 93818 - protein, 234 aa, Homo sapiens
  Payload ID: 18721
  Gene Name: tumor necrosis factor (ligand) superfamily, member 8
  Uniprot ID: P32971
  ENSP ID: ENSP00000223795
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 93819 - protein, 164 aa, Homo sapiens
  Payload ID: 18721
  Gene Name: tumor necrosis factor (ligand) superfamily, member 8
  ENSP ID: ENSP00000484651
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPDYCGMILHHSHSTLDSGKGHCCLETLQP

SEQ ID NO: 93820 - protein, 254 aa, Homo sapiens
  Payload ID: 18722
  Gene Name: tumor necrosis factor (ligand) superfamily, member 9
  Uniprot ID: P41273
  ENSP ID: ENSP00000245817
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 93821 - protein, 468 aa, Homo sapiens
  Payload ID: 18723
  Gene Name: tumor necrosis factor receptor superfamily, member 10a
  Uniprot ID: O00220
  ENSP ID: ENSP00000221132
MAPPPARVHLGAFLAVTPNPGSAASGTEAAAATPSKVWGSSAGRIEPRGGGRGALPTSMGQHGPSARARAGRAPGPRPAREASPRLRVHKTFKFVVVGVLLQVVPSSAATIKLHDQSIGTQQWEHSPLGELCPPGSHRSEHPGACNRCTEGVGYTNASNNLFACLPCTACKSDEEERSPCTTTRNTACQCKPGTFRNDNSAEMCRKCSRGCPRGMVKVKDCTPWSDIECVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAREKIQDLLVDSGKFIYLEDGTGSAVSLE

SEQ ID NO: 93822 - protein, 75 aa, Homo sapiens
  Payload ID: 18723
  Gene Name: tumor necrosis factor receptor superfamily, member 10a
  ENSP ID: ENSP00000428884
MCRKCSRGCPRGMVKVKDCTPWSDIECVHKESGNGHNIWVILVVTLVVPLLLVAVLIVCCCIGSGCGGDPKCMDR

SEQ ID NO: 93823 - protein, 310 aa, Homo sapiens
  Payload ID: 18723
  Gene Name: tumor necrosis factor receptor superfamily, member 10a
  ENSP ID: ENSP00000480778
MAPPPARVHLACKSDEEERSPCTTTRNTACQCKPGTFRNDNSAEMCRKCSRGCPRGMVKVKDCTPWSDIECVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAREKIQDLLVDSGKFIYLEDGTGSAVSLE

SEQ ID NO: 93824 - protein, 440 aa, Homo sapiens
  Payload ID: 18724
  Gene Name: tumor necrosis factor receptor superfamily, member 10b
  Uniprot ID: O14763
  ENSP ID: ENSP00000276431
MEQRGQNAPAASGARKRHGPGPREARGARPGPRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGTKHSGEVPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 93825 - protein, 411 aa, Homo sapiens
  Payload ID: 18724
  Gene Name: tumor necrosis factor receptor superfamily, member 10b
  Uniprot ID: O14763
  ENSP ID: ENSP00000317859
MEQRGQNAPAASGARKRHGPGPREARGARPGPRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 93826 - protein, 90 aa, Homo sapiens
  Payload ID: 18724
  Gene Name: tumor necrosis factor receptor superfamily, member 10b
  ENSP ID: ENSP00000427999
MEQRGQNAPAASGARKRHGPGPREARGARPGPRVPKTLVLVVAAVLLLDTISQKTVEIASPANMDRTIALTGMTSFSACAAPGVIQVKWS

SEQ ID NO: 93827 - protein, 259 aa, Homo sapiens
  Payload ID: 18725
  Gene Name: tumor necrosis factor receptor superfamily, member 10c, decoy without an intracellular dom ain
  Uniprot ID: O14798
  ENSP ID: ENSP00000349324
MARIPKTLKFVVVIVAVLLPVLAYSATTARQEEVPQQTVAPQQQRHSFKGEECPAGSHRSEHTGACNPCTEGVDYTNASNNEPSCFPCTVCKSDQKHKSSCTMTRDTVCQCKEGTFRNENSPEMCRKCSRCPSGEVQVSNCTSWDDIQCVEEFGANATVETPAAEETMNTSPGTPAPAAEETMNTSPGTPAPAAEETMTTSPGTPAPAAEETMTTSPGTPAPAAEETMITSPGTPASSHYLSCTIVGIIVLIVLLIVFV

SEQ ID NO: 93828 - protein, 155 aa, Homo sapiens [sequence omitted]

SEQ ID NO: 93829 - protein, 67 aa, Homo sapiens
  Payload ID: 18725
  Gene Name: tumor necrosis factor receptor superfamily, member 10c, decoy without an intracellular dom ain
  ENSP ID: ENSP00000428235
MARIPKTLKFVVVIVAVLLPDLIDQNILEPVTRAQRVWITPTLPTMNLLASHVQFVNQIKNIKVPAP

SEQ ID NO: 93830 - protein, 386 aa, Homo sapiens
  Payload ID: 18726
  Gene Name: tumor necrosis factor receptor superfamily, member 10d, decoy with truncated death domain
  Uniprot ID: Q9UBN6
  ENSP ID: ENSP00000310263
MGLWGQSVPTASSARAGRYPGARTASGTRPWLLDPKILKFVVFIVAVLLPVRVDSATIPRQDEVPQQTVAPQQQRRSLKEEECPAGSHRSEYTGACNPCTEGVDYTIASNNLPSCLLCTVCKSGQTNKSSCTTTRDTVCQCEKGSFQDKNSPEMCRTCRTGCPRGMVKVSNCTPRSDIKCKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVELPEEPQRLLEQAEAEGCQRRRLLVPVNDADSADISTLLDASATLEEGHAKETIQDQLVGSEKLFYEEDEAGSATSCL

SEQ ID NO: 93831 - protein, 299 aa, Homo sapiens
  Payload ID: 18727
  Gene Name: tumor necrosis factor receptor superfamily, member 11a, NFKB activator
  Uniprot ID: Q9Y6Q6
  ENSP ID: ENSP00000269485
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 93832 - protein, 616 aa, Homo sapiens
  Payload ID: 18727
  Gene Name: tumor necrosis factor receptor superfamily, member 11a, NFKB activator
  Uniprot ID: Q9Y6Q6
  ENSP ID: ENSP00000465500
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTANLWHWINEACGRLSGDKESSGDSCVSTHTANFGQQGACEGVLLLTLEEKTFPEDMCYPDQGGVCQGTCVGGGPYAQGEDARMLSLVSKTEIEEDSFRQMPTEDEYMDRPSQPTDQLLFLTEPGSKSTPPFSEPLEVGENDSLSQCFTGTQSTVGSESCNCTEPLCRTDWTPMSSENYLQKEVDSGHCPHWAASPSPNWADVCTGCRNPPGEDCEPLVGSPKRGPLPQCAYGMGLPPEEEASRTEARDQPEDGADGRLPSSARAGAGSGSSPGGQSPASGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 93833 - protein, 263 aa, Homo sapiens
  Payload ID: 18727
  Gene Name: tumor necrosis factor receptor superfamily, member 11a, NFKB activator
  Uniprot ID: Q9Y6Q6
  ENSP ID: ENSP00000479567
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTANLWHWINEACGRLSGDKEM

SEQ ID NO: 93834 - protein, 337 aa, Homo sapiens
  Payload ID: 18727
  Gene Name: tumor necrosis factor receptor superfamily, member 11a, NFKB activator
  Uniprot ID: Q9Y6Q6
  ENSP ID: ENSP00000482466
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 93835 - protein, 401 aa, Homo sapiens
  Payload ID: 18728
  Gene Name: tumor necrosis factor receptor superfamily, member 11b
  Uniprot ID: O00300
  ENSP ID: ENSP00000297350
MNNLLCCALVFLDISIKWTTQETFPPKYLHYDEETSHQLLCDKCPPGTYLKQHCTAKWKTVCAPCPDHYYTDSWHTSDECLYCSPVCKELQYVKQECNRTHNRVCECKEGRYLEIEFCLKHRSCPPGFGVVQAGTPERNTVCKRCPDGFFSNETSSKAPCRKHTNCSVFGLLLTQKGNATHDNICSGNSESTQKCGIDVTLCEEAFFRFAVPTKFTPNWLSVLVDNLPGTKVNAESVERIKRQHSSQEQTFQLLKLWKHQNKDQDIVKKIIQDIDLCENSVQRHIGHANLTFEQLRSLMESLPGKKVGAEDIEKTIKACKPSDQILKLLSLWRIKNGDQDTLKGLMHALKHSKTYHFPKTVTQSLKKTIRFLHSFTMYKLYQKLFLEMIGNQVQSVKISCL

SEQ ID NO: 93836 - protein, 145 aa, Homo sapiens
  Payload ID: 18728
  Gene Name: tumor necrosis factor receptor superfamily, member 11b
  ENSP ID: ENSP00000427924
MNNLLCCALVFLDISIKWTTQETFPPKYLHYDEETSHQLLCDKCPPGTYLKQHCTAKWKTVCAPCPDHYYTDSWHTSDECLYCSPVCKELQYVKQECNRTHNRVCECKEGRYLEIEFCLKHRSCPPGFGVVQAGCRRRPKPQICI

SEQ ID NO: 93837 - protein, 129 aa, Homo sapiens
  Payload ID: 18729
  Gene Name: tumor necrosis factor receptor superfamily, member 12A
  Uniprot ID: Q9NP84
  ENSP ID: ENSP00000326737
MARGSLRRLLRLLVLGLWLALLRSVAGEQAPGTAPCSRGSSWSADLDKCMDCASCRARPHSDFCLGCAAAPPAPFRLLWPILGGALSLTFVLGLLSGFLVWRRCRRREKFTTPIEETGGEGCPAVALIQ

SEQ ID NO: 93838 - protein, 94 aa, Homo sapiens
  Payload ID: 18729
  Gene Name: tumor necrosis factor receptor superfamily, member 12A
  Uniprot ID: Q9NP84
  ENSP ID: ENSP00000343894
MARGSLRRLLRLLVLGLWLALLRSVAGEQAPGAAAPPAPFRLLWPILGGALSLTFVLGLLSGFLVWRRCRRREKFTTPIEETGGEGCPAVALIQ

SEQ ID NO: 93839 - protein, 94 aa, Homo sapiens
  Payload ID: 18729
  Gene Name: tumor necrosis factor receptor superfamily, member 12A
  ENSP ID: ENSP00000458305
MARGSLRRLLRLLVLGLWLALLRSVAGEQAPASDPRPPPQAPPPAPAAAPGARTWTSAWTARLAGRDRTATSAWAALQHLLPPSGCFGPSLGAL

SEQ ID NO: 93840 - protein, 80 aa, Homo sapiens
  Payload ID: 18729
  Gene Name: tumor necrosis factor receptor superfamily, member 12A
  ENSP ID: ENSP00000458898
MDCASCRARPHSDFCLGCAAAPPAPFRLLWPILGGALSLTFVLGLLSGFLVWRRCRRREKFTTPIEETGGEGCPAVALIQ

SEQ ID NO: 93841 - protein, 226 aa, Homo sapiens
  Payload ID: 18729
  Gene Name: tumor necrosis factor receptor superfamily, member 12A
  ENSP ID: ENSP00000460610
MARGSLRRLLRLLVLGLWLALLRSVAGEQAPGTRDSGVGEPRAGAREPDWVSGEQRRTGGTGGCGDLGSGGLQTARSRLWEVPSLSKLHSQSGPQFLPPSNWGWGGSSVPQVRSTSNGERKRCSTSCPLPAALAHPWGRSEPDLRAGAAFWLFGLETMPQEREVHHPHRGDRRRGLPSCGADPVTMCPLPAGARPLIIHSSILEPVSASQTRREPSSSNHKGGGGR

SEQ ID NO: 93842 - protein, 47 aa, Homo sapiens
  Payload ID: 18729
  Gene Name: tumor necrosis factor receptor superfamily, member 12A
  ENSP ID: ENSP00000461756
MARGSLRRLLRLLVLGLWLALLRSVAGEQAPDPRIAESRPQPLTRGP

SEQ ID NO: 93843 - protein, 293 aa, Homo sapiens
  Payload ID: 18730
  Gene Name: tumor necrosis factor receptor superfamily, member 13B
  Uniprot ID: O14836
  ENSP ID: ENSP00000261652
MSGLGRSRRGGRSRVDQEERFPQGLWTGVAMRSCPEEQYWDPLLGTCMSCKTICNHQSQRTCAAFCRSLSCRKEQGKFYDHLLRDCISCASICGQHPKQCAYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRWGCHTRTTVLQPCPHIPDSGLGIVCVPAQEGGPGA

SEQ ID NO: 93844 - protein, 247 aa, Homo sapiens
  Payload ID: 18730
  Gene Name: tumor necrosis factor receptor superfamily, member 13B
  Uniprot ID: O14836
  ENSP ID: ENSP00000462952
MSGLGRSRRGGRSRVDQEERWSLSCRKEQGKFYDHLLRDCISCASICGQHPKQCAYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRWGCHTRTTVLQPCPHIPDSGLGIVCVPAQEGGPGA

SEQ ID NO: 93845 - protein, 248 aa, Homo sapiens
  Payload ID: 18730
  Gene Name: tumor necrosis factor receptor superfamily, member 13B
  ENSP ID: ENSP00000463582
MSGLGRSRRGGRSRVDQEERWSLSCRKEQGKFYDHLLRDCISCASICGQHPKQCAYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRKTKPPPVLTAGNCGVHRPPPETSTGSPRGQRLLWTQ

SEQ ID NO: 93846 - protein, 156 aa, Homo sapiens
  Payload ID: 18730
  Gene Name: tumor necrosis factor receptor superfamily, member 13B
  ENSP ID: ENSP00000464069
MSGLGRSRRGGRSRVDQEERFPQGLWTGVAMRSCPEEQYWDPLLGTCMSCKTICNHQSQRTCAAFCRSLSCRKEQGKFYDHLLRDCISCASICGQHPKQCAYFCENKLRSPVNLPPELRRQRSGEVENNSDNSGRYQGLEHRGSEASPGKRSPLLY

SEQ ID NO: 93847 - protein, 184 aa, Homo sapiens
  Payload ID: 18731
  Gene Name: tumor necrosis factor receptor superfamily, member 13C
  Uniprot ID: Q96RJ3
  ENSP ID: ENSP00000291232
MRRGPRSLRGRDAPAPTPCVPAECFDLLVRHCVACGLLRTPRPKPAGASSPAPRTALQPQESVGAGAGEAALPLPGLLFGAPALLGLALVLALVLVGLVSWRRRQRRLRGASSAEAPDGDKDAPEPLDKVIILSPGISDATAPAWPPPGEDPGTTPPGHSVPVPATELGSTELVTTKTAGPEQQ

SEQ ID NO: 93848 - protein, 283 aa, Homo sapiens
  Payload ID: 18732
  Gene Name: tumor necrosis factor receptor superfamily, member 14
  Uniprot ID: Q92956
  ENSP ID: ENSP00000347948
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 93849 - protein, 193 aa, Homo sapiens
  Payload ID: 18732
  Gene Name: tumor necrosis factor receptor superfamily, member 14
  ENSP ID: ENSP00000386859
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTNRAWKSQTDL

SEQ ID NO: 93850 - protein, 231 aa, Homo sapiens
  Payload ID: 18732
  Gene Name: tumor necrosis factor receptor superfamily, member 14
  ENSP ID: ENSP00000399292
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPR

SEQ ID NO: 93851 - protein, 231 aa, Homo sapiens; identical to SEQ ID NO: 93850
  Payload ID: 18732
  Gene Name: tumor necrosis factor receptor superfamily, member 14
  ENSP ID: ENSP00000399533

SEQ ID NO: 93852 - protein, 183 aa, Homo sapiens
  Payload ID: 18732
  Gene Name: tumor necrosis factor receptor superfamily, member 14
  ENSP ID: ENSP00000411854
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQT

SEQ ID NO: 93853 - protein, 231 aa, Homo sapiens; identical to SEQ ID NO: 93850
  Payload ID: 18732
  Gene Name: tumor necrosis factor receptor superfamily, member 14
  ENSP ID: ENSP00000415254

SEQ ID NO: 93854 - protein, 283 aa, Homo sapiens; identical to SEQ ID NO: 93848
  Payload ID: 18732
  Gene Name: tumor necrosis factor receptor superfamily, member 14
  Uniprot ID: Q92956
  ENSP ID: ENSP00000478308

SEQ ID NO: 93855 - protein, 193 aa, Homo sapiens; identical to SEQ ID NO: 93849
  Payload ID: 18732
  Gene Name: tumor necrosis factor receptor superfamily, member 14
  ENSP ID: ENSP00000485884

SEQ ID NO: 93856 - protein, 231 aa, Homo sapiens; identical to SEQ ID NO: 93850
  Payload ID: 18732
  Gene Name: tumor necrosis factor receptor superfamily, member 14
  ENSP ID: ENSP00000485902

SEQ ID NO: 93857 - protein, 25 aa, Homo sapiens
  Payload ID: 18732
  Gene Name: tumor necrosis factor receptor superfamily, member 14
  ENSP ID: ENSP00000485988
  MOD_RES (1)..(1): Any amino acid
XGTLEECQHQTNWPNHMCEKKKAKG

SEQ ID NO: 93858 - protein, 183 aa, Homo sapiens; identical to SEQ ID NO: 93852
  Payload ID: 18732
  Gene Name: tumor necrosis factor receptor superfamily, member 14
  ENSP ID: ENSP00000486250

SEQ ID NO: 93859 - protein, 25 aa, Homo sapiens
  Payload ID: 18732
  Gene Name: tumor necrosis factor receptor superfamily, member 14
  ENSP ID: ENSP00000486304
  MOD_RES (1)..(1): Any amino acid
XGTLEECQHQTNWPNHMCEKKKAKG

SEQ ID NO: 93860 - protein, 231 aa, Homo sapiens; identical to SEQ ID NO: 93850
  Payload ID: 18732
  Gene Name: tumor necrosis factor receptor superfamily, member 14
  ENSP ID: ENSP00000486883

SEQ ID NO: 93861 - protein, 231 aa, Homo sapiens; identical to SEQ ID NO: 93850
  Payload ID: 18732
  Gene Name: tumor necrosis factor receptor superfamily, member 14
  ENSP ID: ENSP00000487464

SEQ ID NO: 93862 - protein, 184 aa, Homo sapiens
  Payload ID: 18733
  Gene Name: tumor necrosis factor receptor superfamily, member 17
  Uniprot ID: Q02223
  ENSP ID: ENSP00000053243
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 93863 - protein, 135 aa, Homo sapiens
  Payload ID: 18733
  Gene Name: tumor necrosis factor receptor superfamily, member 17
  Uniprot ID: Q02223
  ENSP ID: ENSP00000379753
MLQMAGQCSQNEYFDSLLHACIPCQLRCSSNTPPLTCQRYCNARSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 93864 - protein, 133 aa, Homo sapiens
  Payload ID: 18733
  Gene Name: tumor necrosis factor receptor superfamily, member 17
  ENSP ID: ENSP00000454314
  MOD_RES (1)..(1): Any amino acid
XQNEYFDSLLHACIPCQLRCSSNTPPLTCQRYCNASVTNSVKGTNAILWTCLGLSLIISLAVFVLMFLLRKINSEPLKDEFKNTEMESRSVAQAGVQWRDLNSLQPLPLGFKQFSHLSLLSNWDYRIRSPGHG

SEQ ID NO: 93865 - protein, 255 aa, Homo sapiens
  Payload ID: 18734
  Gene Name: tumor necrosis factor receptor superfamily, member 18
  Uniprot ID: Q9Y5U5
  ENSP ID: ENSP00000328207
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCCWRCRRRPKTPEAASSPRKSGASDRQRRRGGWETCGCEPGRPPGPPTAASPSPGAPQAAGALRSALGRALLPWQQKWVQEGGSDQRPGPCSSAAAAGPCRRERETQSWPPSSLAGPDGVGS

SEQ ID NO: 93866 - protein, 234 aa, Homo sapiens
  Payload ID: 18734
  Gene Name: tumor necrosis factor receptor superfamily, member 18
  Uniprot ID: Q9Y5U5
  ENSP ID: ENSP00000368567
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRKTQLLLEVPPSTEDARSCQFPEEERGERSAEEKGRLGDLWV

SEQ ID NO: 93867 - protein, 241 aa, Homo sapiens
  Payload ID: 18734
  Gene Name: tumor necrosis factor receptor superfamily, member 18
  Uniprot ID: Q9Y5U5
  ENSP ID: ENSP00000368570
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 93868 - protein, 169 aa, Homo sapiens
  Payload ID: 18734
  Gene Name: tumor necrosis factor receptor superfamily, member 18
  ENSP ID: ENSP00000462735
MCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 93869 - protein, 417 aa, Homo sapiens
  Payload ID: 18735
  Gene Name: tumor necrosis factor receptor superfamily, member 19
  Uniprot ID: Q9NS68
  ENSP ID: ENSP00000248484
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQEA

SEQ ID NO: 93870 - protein, 423 aa, Homo sapiens
  Payload ID: 18735
  Gene Name: tumor necrosis factor receptor superfamily, member 19
  Uniprot ID: Q9NS68
  ENSP ID: ENSP00000371693
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQVRQRLGSL

SEQ ID NO: 93871 - protein, 417 aa, Homo sapiens; identical to SEQ ID NO: 93869
  Payload ID: 18735
  Gene Name: tumor necrosis factor receptor superfamily, member 19
  Uniprot ID: Q9NS68
  ENSP ID: ENSP00000371698

SEQ ID NO: 93872 - protein, 285 aa, Homo sapiens
  Payload ID: 18735
  Gene Name: tumor necrosis factor receptor superfamily, member 19
  Uniprot ID: Q9NS68
  ENSP ID: ENSP00000385408
MECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQEA

SEQ ID NO: 93873 - protein, 455 aa, Homo sapiens
  Payload ID: 18736
  Gene Name: tumor necrosis factor receptor superfamily, member 1A
  Uniprot ID: P19438
  ENSP ID: ENSP00000162749
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 93874 - protein, 218 aa, Homo sapiens
  Payload ID: 18736
  Gene Name: tumor necrosis factor receptor superfamily, member 1A
  Uniprot ID: P19438
  ENSP ID: ENSP00000380389
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSKVLLCRPGWNAVARSRLTATSASQIQAILLLQPPK

SEQ ID NO: 93875 - protein, 254 aa, Homo sapiens
  Payload ID: 18736
  Gene Name: tumor necrosis factor receptor superfamily, member 1A
  ENSP ID: ENSP00000413224
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCERSSPEAKPSPHPRGWPLPHAVALPFLPPPVFCGSDNQLLSGRPHPVPRHFLCPVGWGCRRFSFSCAALLPTGQEKQNTVCTCHAGFFLRENECVS

SEQ ID NO: 93876 - protein, 412 aa, Homo sapiens
  Payload ID: 18736
  Gene Name: tumor necrosis factor receptor superfamily, member 1A
  ENSP ID: ENSP00000438343
MGLSTVPDLLLPLVLLELLVGIYPSGVIGLVPHLGDREKRDSVCPQGKYIHPQNNSICCTKCHKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 93877 - protein, 71 aa, Homo sapiens
  Payload ID: 18736
  Gene Name: tumor necrosis factor receptor superfamily, member 1A
  ENSP ID: ENSP00000439981
MGLSTVPDLLLPLVLLELLVGIYPSGVIGLVPHLGDREKRDSVCPQGKYIHPQNNSICCTKCHKGTYLYND

SEQ ID NO: 93878 - protein, 122 aa, Homo sapiens
  Payload ID: 18736
  Gene Name: tumor necrosis factor receptor superfamily, member 1A
  ENSP ID: ENSP00000441803
MGLSTVPDLLLPLEPTCTMTVQARGRIRTAGSVRAAPSPLQKTTSDTASAAPNAERKWVRWRSLLAQWTGTPCVAAGRTSTGIIGVKTFSSASIAASASMGPCTSPARRNRTPCAPAMQVSF

SEQ ID NO: 93879 - protein, 298 aa, Homo sapiens
  Payload ID: 18736
  Gene Name: tumor necrosis factor receptor superfamily, member 1A
  ENSP ID: ENSP00000442059
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIGEWGLWEGEGAGGGEGGHGWVRWTCVEGGEECPLSSYRWGLWAEGGPGWLGR

SEQ ID NO: 93880 - protein, 72 aa, Homo sapiens
  Payload ID: 18736
  Gene Name: tumor necrosis factor receptor superfamily, member 1A
  ENSP ID: ENSP00000442405
MGLSTVPDLLLPLVLLELLVGIYPSGVIGLVPHLGDREKRDSVCPQGKYIHPQNNSICCTKCHKEPVPALLE

SEQ ID NO: 93881 - protein, 118 aa, Homo sapiens
  Payload ID: 18736
  Gene Name: tumor necrosis factor receptor superfamily, member 1A
  ENSP ID: ENSP00000442919
MGLSTVPDLLLPLVLLELLVGIYPSGVIGLVPHLGDREKRDSVCPQGKYIHPQNNSICCTKCHKGPGQDTDCRECESGSFTASENHLRHCLSCSKCRKEMGQVEISSCTVDRDTVCGC

SEQ ID NO: 93882 - protein, 461 aa, Homo sapiens
  Payload ID: 18737
  Gene Name: tumor necrosis factor receptor superfamily, member 1B
  Uniprot ID: P20333
  ENSP ID: ENSP00000365435
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 93883 - protein, 155 aa, Homo sapiens
  Payload ID: 18737
  Gene Name: tumor necrosis factor receptor superfamily, member 1B
  ENSP ID: ENSP00000440425
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPDLS

SEQ ID NO: 93884 - protein, 655 aa, Homo sapiens
  Payload ID: 18738
  Gene Name: tumor necrosis factor receptor superfamily, member 21
  Uniprot ID: O75509
  ENSP ID: ENSP00000296861
MGTSPSSSTALASCSRIARRATATMIAGSLLLLGFLSTTTAQPEQKASNLIGTYRHVDRATGQVLTCDKCPAGTYVSEHCTNTSLRVCSSCPVGTFTRHENGIEKCHDCSQPCPWPMIEKLPCAALTDRECTCPPGMFQSNATCAPHTVCPVGWGVRKKGTETEDVRCKQCARGTFSDVPSSVMKCKAYTDCLSQNLVVIKPGTKETDNVCGTLPSFSSSTSPSPGTAIFPRPEHMETHEVPSSTYVPKGMNSTESNSSASVRPKVLSSIQEGTVPDNTSSARGKEDVNKTLPNLQVVNHQQGPHHRHILKLLPSMEATGGEKSSTPIKGPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 93885 - protein, 372 aa, Homo sapiens
  Payload ID: 18739
  Gene Name: tumor necrosis factor receptor superfamily, member 25
  Uniprot ID: Q93038
  ENSP ID: ENSP00000314451
MEQRPRGCAAVAAALLLVLLGARAQGGTRSPRCDCAGDFHKKIGLFCCRGCPAASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 93886 - protein, 234 aa, Homo sapiens
  Payload ID: 18739
  Gene Name: tumor necrosis factor receptor superfamily, member 25
  Uniprot ID: Q93038
  ENSP ID: ENSP00000326762
MEQRPRGCAAVAAALLLVLLGARAQGGTRSPRCDCAGDFHKKIGLFCCRGCPADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 93887 - protein, 380 aa, Homo sapiens
  Payload ID: 18739
  Gene Name: tumor necrosis factor receptor superfamily, member 25
  Uniprot ID: Q93038
  ENSP ID: ENSP00000337713
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQNEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 93888 - protein, 417 aa, Homo sapiens
  Payload ID: 18739
  Gene Name: tumor necrosis factor receptor superfamily, member 25
  Uniprot ID: Q93038
  ENSP ID: ENSP00000349341
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 93889 - protein, 426 aa, Homo sapiens
  Payload ID: 18739
  Gene Name: tumor necrosis factor receptor superfamily, member 25
  Uniprot ID: Q93038
  ENSP ID: ENSP00000367013
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTPPPSLAGAPWGAVQSAVPLSVAGGRVGVFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 93890 - protein, 218 aa, Homo sapiens
  Payload ID: 18739
  Gene Name: tumor necrosis factor receptor superfamily, member 25
  Uniprot ID: Q93038
  ENSP ID: ENSP00000404274
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTVLGPGAPGWPCGPPPAWGHPDLHIPPLLASQAPGYCR

SEQ ID NO: 93891 - protein, 126 aa, Homo sapiens
  Payload ID: 18739
  Gene Name: tumor necrosis factor receptor superfamily, member 25
  Uniprot ID: Q93038
  ENSP ID: ENSP00000421976
MEQRPRGCAAVAAALLLVLLGARAQGGTRSPRCDCAGDFHKKIGLFCCRGCPAASQVALENCSAVADTRCGCKPGWFVECQVSQCVSSSPFYCQPCLDCGALHRHTRLLCHPSVTLGQRPHPSSTS

SEQ ID NO: 93892 - protein, 136 aa, Homo sapiens
  Payload ID: 18739
  Gene Name: tumor necrosis factor receptor superfamily, member 25
  Uniprot ID: Q93038
  ENSP ID: ENSP00000423121
MEQRPRGCAAVAAALLLVLLGARAQGGTRSPRCDCAGDFHKKIGLFCCRGCPAASQVALENCSAVADTRCGCKPGWFVECQVSQCVSSSPFYCQPCLDCGALHRHTRLLCSRRDTDCGTCLPGFYEHGDGCVSCPT

SEQ ID NO: 93893 - protein, 181 aa, Homo sapiens
  Payload ID: 18739
  Gene Name: tumor necrosis factor receptor superfamily, member 25
  Uniprot ID: Q93038
  ENSP ID: ENSP00000424071
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPT

SEQ ID NO: 93894 - protein, 277 aa, Homo sapiens
  Payload ID: 18739
  Gene Name: tumor necrosis factor receptor superfamily, member 25
  Uniprot ID: Q93038
  ENSP ID: ENSP00000431554
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTPPPSLAGAPWGAVQSAVPLSVAGGRVGGVLGMRVGELGWTEGRRVRRGATTQHPPAAFSVLGPGAPGWPCGPPPAWGHPDLHIPPLLASQAPGYCR

SEQ ID NO: 93895 - protein, 253 aa, Homo sapiens
  Payload ID: 18739
  Gene Name: tumor necrosis factor receptor superfamily, member 25
  ENSP ID: ENSP00000434129
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQSRWCAGNASGRTGMDRGEAGEEGGNHPTPTSCFQCSGSRCSWLALWSPSCLGPP

SEQ ID NO: 93896 - protein, 45 aa, Homo sapiens
  Payload ID: 18739
  Gene Name: tumor necrosis factor receptor superfamily, member 25
  ENSP ID: ENSP00000465381
MFWVQVLLAGLVVPLLLGATLTYTYRHCWPHKPLVTDEAGMEALT

SEQ ID NO: 93897 - protein, 277 aa, Homo sapiens
  Payload ID: 18740
  Gene Name: tumor necrosis factor receptor superfamily, member 4
  Uniprot ID: P43489
  ENSP ID: ENSP00000368538
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 93898 - protein, 300 aa, Homo sapiens
  Payload ID: 18741
  Gene Name: tumor necrosis factor receptor superfamily, member 6b, decoy
  Uniprot ID: O95407
  ENSP ID: ENSP00000359013
MRALEGPGLSLLCLVLALPALLPVPAVRGVAETPTYPWRDAETGERLVCAQCPPGTFVQRPCRRDSPTTCGPCPPRHYTQFWNYLERCRYCNVLCGEREEEARACHATHNRACRCRTGFFAHAGFCLEHASCPPGAGVIAPGTPSQNTQCQPCPPGTFSASSSSSEQCQPHRNCTALGLALNVPGSSSHDTLCTSCTGFPLSTRVPGAEECERAVIDFVAFQDISIKRLQRLLQALEAPEGWGPTPRAGRAALQLKLRRRLTELLGAQDGALLVRLLQALRVARMPGLERSVRERFLPVH

SEQ ID NO: 93899 - protein, 595 aa, Homo sapiens
  Payload ID: 18742
  Gene Name: tumor necrosis factor receptor superfamily, member 8
  Uniprot ID: P28908
  ENSP ID: ENSP00000263932
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 93900 - protein, 483 aa, Homo sapiens
  Payload ID: 18742
  Gene Name: tumor necrosis factor receptor superfamily, member 8
  Uniprot ID: P28908
  ENSP ID: ENSP00000390650
MFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 93901 - protein, 132 aa, Homo sapiens
  Payload ID: 18742
  Gene Name: tumor necrosis factor receptor superfamily, member 8
  Uniprot ID: P28908
  ENSP ID: ENSP00000398337
MSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 93902 - protein, 55 aa, Homo sapiens
  Payload ID: 18742
  Gene Name: tumor necrosis factor receptor superfamily, member 8
  ENSP ID: ENSP00000421938
MRVLLAALGLLFLGALRAFPQGCSRHSSAHRGLLTAGSSVSLTTTWMRPTAVQPA

SEQ ID NO: 93903 - protein, 255 aa, Homo sapiens
  Payload ID: 18743
  Gene Name: tumor necrosis factor receptor superfamily, member 9
  Uniprot ID: Q07011
  ENSP ID: ENSP00000366729
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 93904 - protein, 75 aa, Homo sapiens
  Payload ID: 18743
  Gene Name: tumor necrosis factor receptor superfamily, member 9
  ENSP ID: ENSP00000464978
SSTSNAECDCTPGFHCLGAGCSMCEQDCKQGQELTKKGCKDCCFGTFNDQKRGICRPWTNIRVADEWNHDSQEKY

SEQ ID NO: 93905 - protein, 87 aa, Homo sapiens
  Payload ID: 18743
  Gene Name: tumor necrosis factor receptor superfamily, member 9
  ENSP ID: ENSP00000465272
ERDVVCGPSPADLSPGASSVTPPAPAREPGHSPQIISFFLALTSTALLFLLFFLTLRFSVVKRGRKKLLYIFKQHGSSGDTFTILES

SEQ ID NO: 93906 - protein, 255 aa, Homo sapiens; identical to SEQ ID NO: 93903
  Payload ID: 18743
  Gene Name: tumor necrosis factor receptor superfamily, member 9
  Uniprot ID: Q07011
  ENSP ID: ENSP00000478699

SEQ ID NO: 93907 - protein, 316 aa, Homo sapiens
  Payload ID: 18744
  Gene Name: tumor necrosis factor, alpha-induced protein 1 (endothelial)
  Uniprot ID: Q13829
  ENSP ID: ENSP00000226225
MSGDTCLCPASGAKPKLSGFKGGGLGNKYVQLNVGGSLYYTTVRALTRHDTMLKAMFSGRMEVLTDKEGWILIDRCGKHFGTILNYLRDDTITLPQNRQEIKELMAEAKYYLIQGLVNMCQSALQDKKDSYQPVCNIPIITSLKEEERLIESSTKPVVKLLYNRSNNKYSYTSNSDDHLLKNIELFDKLSLRFNGRVLFIKDVIGDEICCWSFYGQGRKLAEVCCTSIVYATEKKQTKVEFPEARIYEETLNVLLYETPRVPDNSLLEATSRSRSQASPSEDEETFELRDRVRRIHVKRYSTYDDRQLGHQSTHRD

SEQ ID NO: 93908 - protein, 212 aa, Homo sapiens
  Payload ID: 18744
  Gene Name: tumor necrosis factor, alpha-induced protein 1 (endothelial)
  Uniprot ID: Q13829
  ENSP ID: ENSP00000440749
MAEAKYYLIQGLVNMCQSALQDKKDSYQPVCNIPIITSLKEEERLIESSTKPVVKLLYNRSNNKYSYTSNSDDHLLKNIELFDKLSLRFNGRVLFIKDVIGDEICCWSFYGQGRKLAEVCCTSIVYATEKKQTKVEFPEARIYEETLNVLLYETPRVPDNSLLEATSRSRSQASPSEDEETFELRDRVRRIHVKRYSTYDDRQLGHQSTHRD

SEQ ID NO: 93909 - protein, 125 aa, Homo sapiens
  Payload ID: 18744
  Gene Name: tumor necrosis factor, alpha-induced protein 1 (endothelial)
  ENSP ID: ENSP00000464515
MSGDTCLCPASGAKPKLSGFKGGGLGNKYVQLNVGGSLYYTTVRALTRHDTMLKAMFSGRMEVLTDKEGWILIDRCGKHFGTILNYLRDDTITLPQNRQEIKELMAEAKYYLIQGLVNMCQSALQ

SEQ ID NO: 93910 - protein, 107 aa, Homo sapiens
  Payload ID: 18744
  Gene Name: tumor necrosis factor, alpha-induced protein 1 (endothelial)
  ENSP ID: ENSP00000464637
MSGDTCLCPASGAKPKLSGFKGGGLGNKYVQLNVGGSLYYTTVRALTRHDTMLKAMFSGRMEVLTDKEGWILIDRCGKHFGTILNYLRDDTITLPQNRQEIKELMAE

SEQ ID NO: 93911 - protein, 157 aa, Homo sapiens
  Payload ID: 18744
  Gene Name: tumor necrosis factor, alpha-induced protein 1 (endothelial)
  ENSP ID: ENSP00000466301
MAEAKYYLIQGLVNMCQSALQDKKDSYQPVCNIPIITSLKEEERLIESSTKPVVKLLYNRSNNKYSYTSNSDDHLLKNIELFDKLSLRFNGRVLFIKDVIGDEICCWSFYGQGRKLAEVCCTSIVYATEKKQTKVWGIAPAWVGEDTHPLCGGRGRA

SEQ ID NO: 93912 - protein, 654 aa, Homo sapiens
  Payload ID: 18745
  Gene Name: tumor necrosis factor, alpha-induced protein 2
  Uniprot ID: Q03169
  ENSP ID: ENSP00000332326
MSEASSEDLVPPLEAGAAPYREEEEAAKKKKEKKKKSKGLANVFCVFTKGKKKKGQPSSAEPEDAAGSRQGLDGPPPTVEELKAALERGQLEAARPLLALERELAAAAAAGGVSEEELVRRQSKVEALYELLRDQVLGVLRRPLEAPPERLRQALAVVAEQEREDRQAAAAGPGTSGLAATRPRRWLQLWRRGVAEAAEERMGQRPAAGAEVPESVFLHLGRTMKEDLEAVVERLKPLFPAEFGVVAAYAESYHQHFAAHLAAVAQFELCERDTYMLLLWVQNLYPNDIINSPKLVGELQGMGLGSLLPPRQIRLLEATFLSSEAANVRELMDRALELEARRWAEDVPPQRLDGHCHSELAIDIIQITSQAQAKAESITLDLGSQIKRVLLVELPAFLRSYQRAFNEFLERGKQLTNYRANVIANINNCLSFRMSMEQNWQVPQDTLSLLLGPLGELKSHGFDTLLQNLHEDLKPLFKRFTHTRWAAPVETLENIIATVDTRLPEFSELQGCFREELMEALHLHLVKEYIIQLSKGRLVLKTAEQQQQLAGYILANADTIQHFCTQHGSPATWLQPALPTLAEIIRLQDPSAIKIEVATYATCYPDFSKGHLSAILAIKGNLSNSEVKRIRSILDVSMGAQEPSRPLFSLIKVG

SEQ ID NO: 93913 - protein, 654 aa, Homo sapiens; identical to SEQ ID NO: 93912
  Payload ID: 18745
  Gene Name: tumor necrosis factor, alpha-induced protein 2
  Uniprot ID: Q03169
  ENSP ID: ENSP00000452634

SEQ ID NO: 93914 - protein, 97 aa, Homo sapiens
  Payload ID: 18745
  Gene Name: tumor necrosis factor, alpha-induced protein 2
  ENSP ID: ENSP00000452824
MSEASSEDLVPPLEAGAAPYREEEEAAKKKKEKKKKSKGLANVFCVFTKGKKKKGQPSSAEPEDAAGSRQGLDGPPPTGQCEGVDGPSSGARGTALG

SEQ ID NO: 93915 - protein, 243 aa, Homo sapiens
  Payload ID: 18745
  Gene Name: tumor necrosis factor, alpha-induced protein 2
  ENSP ID: ENSP00000452914
  MOD_RES (1)..(1): Any amino acid
XPLFKRFTHTRWAAPVETLENIIATVDTRLPEFSELQGCFREELMEALHLHLVKEYIIQLSKGRLVLKTAEQQQQLAGYILANADTIQHFCTQHGSPATWLQPALPTLAEIIRLQDPSAIKIEVATYATCYPDFSKGHLSAILAIKGNLSNSEVKRIRSILDVSMGAQEPSRPLFSLIKPRAAVSGIQQWWNGRQNWKRKKEKMSSRLAGAFRVLWRAVSTASIRRHIQVAPRPLQAGPAMGP

SEQ ID NO: 93916 - protein, 48 aa, Homo sapiens
  Payload ID: 18745
  Gene Name: tumor necrosis factor, alpha-induced protein 2
  ENSP ID: ENSP00000452992
MSEASSEDLVPPLEAGAAPYREEEEAAKKKKEKKKKSPRASFCTWAAP

SEQ ID NO: 93917 - protein, 39 aa, Homo sapiens
  Payload ID: 18745
  Gene Name: tumor necrosis factor, alpha-induced protein 2
  ENSP ID: ENSP00000453103
MSEASSEDLVPPLEAGAAPYREEEEAAKKKKEKKKKSKG

SEQ ID NO: 93918 - protein, 347 aa, Homo sapiens
  Payload ID: 18745
  Gene Name: tumor necrosis factor, alpha-induced protein 2
  ENSP ID: ENSP00000453142
VRARHLHAAALGAEPLPQANVRELMDRALELEARRWAEDVPPQRLDGHCHSELAIDIIQITSQAQAKAESITLDLGSQIKRVLLVELPAFLRSYQRAFNEFLERGKQLTNYRANVIANINNCLSFRMSMEQNWQVPQDTLSLLLGPLGELKSHGFDTLLQNLHEDLKPLFKRFTHTRWAAPVETLENIIATVDTRLPEFSELQGCFREELMEALHLHLVKEYIIQLSKGRLVLKTAEQQQQLAGYILANADTIQHFCTQHGSPATWLQPALPTLAEIIRLQDPSAIKIEVATYATCYPDFSKGHLSAILAIKGNLSNSEVKRIRSILDVSMGAQEPSRPLFSLIKVG

SEQ ID NO: 93919 - protein, 66 aa, Homo sapiens
  Payload ID: 18745
  Gene Name: tumor necrosis factor, alpha-induced protein 2
  ENSP ID: ENSP00000453458
  MOD_RES (1)..(1): Any amino acid
XTNYRANVIANINNCLSFRMSMEQNWQVPQDTLSLLLGPLGELKSHGFDTLLQNLHEDLKPFLSRA

SEQ ID NO: 93920 - protein, 790 aa, Homo sapiens
  Payload ID: 18746
  Gene Name: tumor necrosis factor, alpha-induced protein 3
  Uniprot ID: P21580
  ENSP ID: ENSP00000237289
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKMASTDTPMARSGLQYNSLEEIHIFVLCNILRRPIIVISDKMLRSLESGSNFAPLKVGGIYLPLHWPAQECYRYPIVLGYDSHHFVPLVTLKDSGPEIRAVPLVNRDRGRFEDLKVHFLTDPENEMKEKLLKEYLMVIEIPVQGWDHGTTHLINAAKLDEANLPKEINLVDDYFELVQHEYKKWQENSEQGRREGHAQNPMEPSVPQLSLMDVKCETPNCPFFMSVNTQPLCHECSERRQKNQNKLPKLNSKPGPEGLPGMALGASRGEAYEPLAWNPEESTGGPHSAPPTAPSPFLFSETTAMKCRSPGCPFTLNVQHNGFCERCHNARQLHASHAPDHTRHLDPGKCQACLQDVTRTFNGICSTCFKRTTAEASSSLSTSLPPSCHQRSKSDPSRLVRSPSPHSCHRAGNDAPAGCLSQAARTPGDRTGTSKCRKAGCVYFGTPENKGFCTLCFIEYRENKHFAAASGKVSPTASRFQNTIPCLGRECGTLGSTMFEGYCQKCFIEAQNQRFHEAKRTEEQLRSSQRRDVPRTTQSTSRPKCARASCKNILACRSEELCMECQHPNQRMGPGAHRGEPAPEDPPKQRCRAPACDHFGNAKCNGYCNECFQFKQMYG

SEQ ID NO: 93921 - protein, 25 aa, Homo sapiens
  Payload ID: 18746
  Gene Name: tumor necrosis factor, alpha-induced protein 3
  ENSP ID: ENSP00000393577
MAEQVLPQALYLSNMRKAVKIRERT

SEQ ID NO: 93922 - protein, 162 aa, Homo sapiens
  Payload ID: 18746
  Gene Name: tumor necrosis factor, alpha-induced protein 3
  ENSP ID: ENSP00000401562
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTR

SEQ ID NO: 93923 - protein, 98 aa, Homo sapiens
  Payload ID: 18746
  Gene Name: tumor necrosis factor, alpha-induced protein 3
  ENSP ID: ENSP00000409845
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTN

SEQ ID NO: 93924 - protein, 749 aa, Homo sapiens
  Payload ID: 18746
  Gene Name: tumor necrosis factor, alpha-induced protein 3
  ENSP ID: ENSP00000478438
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKMASTDTPMARSGLQYNSLEEIHIFVLCNILRRPIIVISDKMLRSLESGSNFAPLKVGGIYLPLHWPAQECYRYPIVLGYDSHHFVPLVTLKDSGPEIRAVPLVNRDRGRFEDLKVHFLTDPENEMKEKLLKEYLMVIEIPVQGWDHGTTHLINAAKLDEANLPKEINLVDDYFELVQHEYKKWQENSEQGRREGHAQNPMEPSVPQLSLMDVKCETPNCPFFMSVNTQPLCHECSERRQKNQNKLPKLNSKPGPEGLPGMALGASRGEAYEPLAWNPEESTGGPHSAPPTAPSPFLFSETTAMKCRSPGCPFTLNVQHNGFCERCHNARQLHASHAPDHTRHLDPGKCQACLQDVTRTFNGICSTCFKRTTAEASSSLSTSLPPSCHQRSKSDPSRLVRSPSPHSCHRAGNDAPAGCLSQAARTPGDRTGTSKCRKAGCVYFGTPENKGFCTLCFIEYRENKHFAAASGKVSPTASRFQNTIPCLGRECGTLGSTMFEGYCQKCFIEAQNQRFHEAKRTEEQLRSSQRRDVPRTTQSTSRPKCARASCKNILACRSEELCMECQHQPEDGPWGPPG

SEQ ID NO: 93925 - protein, 214 aa, Homo sapiens
  Payload ID: 18746
  Gene Name: tumor necrosis factor, alpha-induced protein 3
  ENSP ID: ENSP00000479556
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKWLPQTHPWPEVDFSTTHWKKYTYLSFATSSEGQSLSFQTKC

SEQ ID NO: 93926 - protein, 470 aa, Homo sapiens
  Payload ID: 18746
  Gene Name: tumor necrosis factor, alpha-induced protein 3
  ENSP ID: ENSP00000481122
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKMASTDTPMARSGLQYNSLEEIHIFVLCNILRRPIIVISDKMLRSLESGSNFAPLKVGGIYLPLHWPAQECYRYPIVLGYDSHHFVPLVTLKDSGPEIRAVPLVNRDRGRFEDLKVHFLTDPENEMKEKLLKEYLMVIEIPVQGWDHGTTHLINAAKLDEANLPKEINLVDDYFELVQHEYKKWQENSEQGRREGHAQNPMEPSVPQLSLMDVKCETPNCPFFMSVNTQPLCHECSERRQKNQNKLPKLNSKPGPEGLPGMALGASRGEAYEPLAWNPEESTGGSFGPTDSTQPFSVQ

SEQ ID NO: 93927 - protein, 669 aa, Homo sapiens
  Payload ID: 18746
  Gene Name: tumor necrosis factor, alpha-induced protein 3
  ENSP ID: ENSP00000481454
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKMASTDTPMARSGLQYNSLEEIHIFVLCNILRRPIIVISDKMLRSLESGSNFAPLKVGGIYLPLHWPAQECYRYPIVLGYDSHHFVPLVTLKDSGPEIRAVPLVNRDRGRFEDLKVHFLTDPENEMKEKLLKEYLMVIEIPVQGWDHGTTHLINAAKLDEANLPKEINLVDDYFELVQHEYKKWQENSEQGRREGHAQNPMEPSVPQLSLMDVKCETPNCPFFMSVNTQPLCHECSERRQKNQNKLPKLNSKPGPEGLPGMALGASRGEAYEPLAWNPEESTGGPHSAPPTAPSPFLFSETTAMKCRSPGCPFTLNVQHNGFCERCHNARQLHASHAPDHTRHLDPGKCQACLQDVTRTFNGICSTCFKRTTAEASSSLSTSLPPSCHQRSKSDPSRLVRSPSPHSCHRAGNDAPAGCLSQAARTPGDRTGTSKCRKAGCVYFGTPENKGFCTLFHRVQRKQTFCCCLRESQSHSVQVPEHHSVPGEGMRHPWKHHV

SEQ ID NO: 93928 - protein, 790 aa, Homo sapiens; identical to SEQ ID NO: 93920
  Payload ID: 18746
  Gene Name: tumor necrosis factor, alpha-induced protein 3
  Uniprot ID: P21580
  ENSP ID: ENSP00000481570

SEQ ID NO: 93929 - protein, 531 aa, Homo sapiens
  Payload ID: 18746
  Gene Name: tumor necrosis factor, alpha-induced protein 3
  ENSP ID: ENSP00000484332
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKMASTDTPMARSGLQYNSLEEIHIFVLCNILRRPIIVISDKMLRSLESGSNFAPLKVGGIYLPLHWPAQECYRYPIVLGYDSHHFVPLVTLKDSGPEIRAVPLVNRDRGRFEDLKVHFLTDPENEMKEKLLKEYLMVIEIPVQGWDHGTTHLINAAKLDEANLPKEINLVDDYFELVQHEYKKWQENSEQGRREGHAQNPMEPSVPQLSLMDVKCETPNCPFFMSVNTQPLCHECSERRQKNQNKLPKLNSKPGPEGLPGMALGASRGEAYEPLAWNPEESTGGPHSAPPTAPSPFLFSETTAMKCRSPGCPFTLNVQHNGFCERCHNARQLRQPRPRPHKALGSREVPSLPPGCYQDI

SEQ ID NO: 93930 - protein, 277 aa, Homo sapiens
  Payload ID: 18747
  Gene Name: tumor necrosis factor, alpha-induced protein 6
  Uniprot ID: P98066
  ENSP ID: ENSP00000243347
MIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 93931 - protein, 188 aa, Homo sapiens
  Payload ID: 18748
  Gene Name: tumor necrosis factor, alpha-induced protein 8
  Uniprot ID: O95379
  ENSP ID: ENSP00000274456
MATDVFNSKNLAVQAQKKILGKMVSKSIATTLIDDTSSEVLDELYRVTREYTQNKKEAEKIIKNLIKTVIKLAILYRNNQFNQDELALMEKFKKKVHQLAMTVVSFHQVDYTFDRNVLSRLLNECREMLHQIIQRHLTAKSHGRVNNVFDHFSDCEFLAALYNPFGNFKPHLQKLCDGINKMLDEENI

SEQ ID NO: 93932 - protein, 39 aa, Homo sapiens
  Payload ID: 18748
  Gene Name: tumor necrosis factor, alpha-induced protein 8
  ENSP ID: ENSP00000408534
MHSEAEESKEGLGLNTGIYGENSCHSTQRLSRHPKNCSS

SEQ ID NO: 93933 - protein, 198 aa, Homo sapiens
  Payload ID: 18748
  Gene Name: tumor necrosis factor, alpha-induced protein 8
  Uniprot ID: O95379
  ENSP ID: ENSP00000421848
MHSEAEESKEVATDVFNSKNLAVQAQKKILGKMVSKSIATTLIDDTSSEVLDELYRVTREYTQNKKEAEKIIKNLIKTVIKLAILYRNNQFNQDELALMEKFKKKVHQLAMTVVSFHQVDYTFDRNVLSRLLNECREMLHQIIQRHLTAKSHGRVNNVFDHFSDCEFLAALYNPFGNFKPHLQKLCDGINKMLDEENI

SEQ ID NO: 93934 - protein, 198 aa, Homo sapiens; identical to SEQ ID NO: 93933
  Payload ID: 18748
  Gene Name: tumor necrosis factor, alpha-induced protein 8
  Uniprot ID: O95379
  ENSP ID: ENSP00000422245

SEQ ID NO: 93935 - protein, 200 aa, Homo sapiens
  Payload ID: 18748
  Gene Name: tumor necrosis factor, alpha-induced protein 8
  ENSP ID: ENSP00000427160
MSKQPRLLLLCKVATDVFNSKNLAVQAQKKILGKMVSKSIATTLIDDTSSEVLDELYRVTREYTQNKKEAEKIIKNLIKTVIKLAILYRNNQFNQDELALMEKFKKKVHQLAMTVVSFHQVDYTFDRNVLSRLLNECREMLHQIIQRHLTAKSHGRVNNVFDHFSDCEFLAALYNPFGNFKPHLQKLCDGINKMLDEENI

SEQ ID NO: 93936 - protein, 210 aa, Homo sapiens
  Payload ID: 18748
  Gene Name: tumor necrosis factor, alpha-induced protein 8
  Uniprot ID: O95379
  ENSP ID: ENSP00000427424
MTLPRYCEVVLLIAHGEKMLKLVATDVFNSKNLAVQAQKKILGKMVSKSIATTLIDDTSSEVLDELYRVTREYTQNKKEAEKIIKNLIKTVIKLAILYRNNQFNQDELALMEKFKKKVHQLAMTVVSFHQVDYTFDRNVLSRLLNECREMLHQIIQRHLTAKSHGRVNNVFDHFSDCEFLAALYNPFGNFKPHLQKLCDGINKMLDEENI

SEQ ID NO: 93937 - protein, 68 aa, Homo sapiens
  Payload ID: 18748
  Gene Name: tumor necrosis factor, alpha-induced protein 8
  ENSP ID: ENSP00000429432
MVSKSIATTLIDDTSSEVLDELYRVTREYTQNKKEAEKIIKNLIKTVIKLAILYRNNQFNQDELALME

SEQ ID NO: 93938 - protein, 186 aa, Homo sapiens
  Payload ID: 18749
  Gene Name: tumor necrosis factor, alpha-induced protein 8-like 1
  Uniprot ID: Q8WVP5
  ENSP ID: ENSP00000331827
MDTFSTKSLALQAQKKLLSKMASKAVVAVLVDDTSSEVLDELYRATREFTRSRKEAQKMLKNLVKVALKLGLLLRGDQLGGEELALLRRFRHRARCLAMTAVSFHQVDFTFDRRVLAAGLLECRDLLHQAVGPHLTAKSHGRINHVFGHLADCDFLAALYGPAEPYRSHLRRICEGLGRMLDEGSL

SEQ ID NO: 93939 - protein, 186 aa, Homo sapiens; identical to SEQ ID NO: 93938
  Payload ID: 18749
  Gene Name: tumor necrosis factor, alpha-induced protein 8-like 1
  Uniprot ID: Q8WVP5
  ENSP ID: ENSP00000444215

SEQ ID NO: 93940 - protein, 184 aa, Homo sapiens
  Payload ID: 18750
  Gene Name: tumor necrosis factor, alpha-induced protein 8-like 2
  Uniprot ID: Q6P589
  ENSP ID: ENSP00000357906
MESFSSKSLALQAEKKLLSKMAGRSVAHLFIDETSSEVLDELYRVSKEYTHSRPQAQRVIKDLIKVAIKVAVLHRNGSFGPSELALATRFRQKLRQGAMTALSFGEVDFTFEAAVLAGLLTECRDVLLELVEHHLTPKSHGRIRHVFDHFSDPGLLTALYGPDFTQHLGKICDGLRKLLDEGKL

SEQ ID NO: 93941 - protein, 292 aa, Homo sapiens
  Payload ID: 18751
  Gene Name: tumor necrosis factor, alpha-induced protein 8-like 3
  Uniprot ID: Q5GJ75
  ENSP ID: ENSP00000328016
MGKPRQNPSTLVSTLCEAEPKGKLWVNGYAGTQGTRDATLQTRLIPLSFHLQRGKGLAAPLSALSAPRLPERPADGRVAVDAQPAARSMDSDSGEQSEGEPVTAAGPDVFSSKSLALQAQKKILSKIASKTVANMLIDDTSSEIFDELYKVTKEHTHNKKEAHKIMKDLIKVAIKIGILYRNNQFSQEELVIVEKFRKKLNQTAMTIVSFYEVEYTFDRNVLSNLLHECKDLVHELVQRHLTPRTHGRINHVFNHFADVEFLSTLYSLDGDCRPNLKRICEGINKLLDEKVL

SEQ ID NO: 93942 - protein, 184 aa, Homo sapiens
  Payload ID: 18752
  Gene Name: tumor protein D52
  Uniprot ID: P55327
  ENSP ID: ENSP00000368390
MDRGEQGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKNSPTFKSFEEKVENLKSKVGGTKPAGGDFGEVLNSAANASATTTEPLPEKTQESL

SEQ ID NO: 93943 - protein, 224 aa, Homo sapiens
  Payload ID: 18752
  Gene Name: tumor protein D52
  Uniprot ID: P55327
  ENSP ID: ENSP00000368391
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKNSPTFKSFEEKVENLKSKVGGTKPAGGDFGEVLNSAANASATTTEPLPEKTQESL

SEQ ID NO: 93944 - protein, 238 aa, Homo sapiens
  Payload ID: 18752
  Gene Name: tumor protein D52
  Uniprot ID: P55327
  ENSP ID: ENSP00000410222
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVNIRSIQHSISMPAMRNSPTFKSFEEKVENLKSKVGGTKPAGGDFGEVLNSAANASATTTEPLPEKTQESL

SEQ ID NO: 93945 - protein, 60 aa, Homo sapiens
  Payload ID: 18752
  Gene Name: tumor protein D52
  ENSP ID: ENSP00000428951
MPAMRNSPTFKSFEEKVENLKSKVGGTKPAGGDFGEVLNSAANASATTTEPLPEKTQESL

SEQ ID NO: 93946 - protein, 247 aa, Homo sapiens
  Payload ID: 18752
  Gene Name: tumor protein D52
  Uniprot ID: P55327
  ENSP ID: ENSP00000429309
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKLQAFSHSFSIRSIQHSISMPAMRNSPTFKSFEEKVENLKSKVGGTKPAGGDFGEVLNSAANASATTTEPLPEKTQESL

SEQ ID NO: 93947 - protein, 233 aa, Homo sapiens
  Payload ID: 18752
  Gene Name: tumor protein D52
  Uniprot ID: P55327
  ENSP ID: ENSP00000429351
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKLQAFSHSFRNSPTFKSFEEKVENLKSKVGGTKPAGGDFGEVLNSAANASATTTEPLPEKTQESL

SEQ ID NO: 93948 - protein, 151 aa, Homo sapiens
  Payload ID: 18752
  Gene Name: tumor protein D52
  Uniprot ID: P55327
  ENSP ID: ENSP00000429708
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSARSKLLAAETELLCLLY

SEQ ID NO: 93949 - protein, 207 aa, Homo sapiens
  Payload ID: 18752
  Gene Name: tumor protein D52
  Uniprot ID: P55327
  ENSP ID: ENSP00000429915
MDRGEQGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKLQAFSHSFSIRSIQHSISMPAMRNSPTFKSFEEKVENLKSKVGGTKPAGGDFGEVLNSAANASATTTEPLPEKTQESL

SEQ ID NO: 93950 - protein, 38 aa, Homo sapiens
  Payload ID: 18752
  Gene Name: tumor protein D52
  ENSP ID: ENSP00000430140
MDRGEQAFYFIWNFWLELGKDLSFLHSYKMSAENRPSP

SEQ ID NO: 93951 - protein, 111 aa, Homo sapiens
  Payload ID: 18752
  Gene Name: tumor protein D52
  ENSP ID: ENSP00000430323
MDRGEQGLLRTDPVPEEGEDVAATISATETLSEEEQEELRRELAKVEEEIQTLSQVLAAKEKHLAEIKRKLGINSLQELKQNIAKGWQDVTATSARSKLLAAETELLCLLY

SEQ ID NO: 93952 - protein, 38 aa, Homo sapiens; identical to SEQ ID NO: 93950
  Payload ID: 18752
  Gene Name: tumor protein D52
  ENSP ID: ENSP00000430421

SEQ ID NO: 93953 - protein, 61 aa, Homo sapiens
  Payload ID: 18752
  Gene Name: tumor protein D52
  ENSP ID: ENSP00000430646
MDRGEQGRRRNPDSVSSVSSKREASSRDQAETWNQFSTGTKTEHCQRVARRDSNICLQEDI

SEQ ID NO: 93954 - protein, 148 aa, Homo sapiens
  Payload ID: 18752
  Gene Name: tumor protein D52
  ENSP ID: ENSP00000430865
  MOD_RES (1)..(1): Any amino acid
XGLGLGLWLGAGLSAARRLEQVPSLLGRRRKLHLPDPDLASWGPGRSGSGGGRWDCMCECLLRTDPVPEEGEDVAATISATETLSEEEQEELRRELAKVEEEIQTLSQVLAAKEKHLAEIKRKLGINSLQELKQNIAKGWQDVTATSA

SEQ ID NO: 93955 - protein, 209 aa, Homo sapiens
  Payload ID: 18753
  Gene Name: tumor protein D52-like 1
  ENSP ID: ENSP00000306285
MEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMRSHSIGYSIRHSISMPAMRNSPTFKSFEERVETTVTSLKTKVGGTNPNGGSFEEVLSSTAHASAQSLAGGSRRTKEEELQC

SEQ ID NO: 93956 - protein, 131 aa, Homo sapiens
  Payload ID: 18753
  Gene Name: tumor protein D52-like 1
  Uniprot ID: Q16890
  ENSP ID: ENSP00000357373
MEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMRRK

SEQ ID NO: 93957 - protein, 144 aa, Homo sapiens
  Payload ID: 18753
  Gene Name: tumor protein D52-like 1
  Uniprot ID: Q16890
  ENSP ID: ENSP00000357387
MEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRRK

SEQ ID NO: 93958 - protein, 102 aa, Homo sapiens
  Payload ID: 18753
  Gene Name: tumor protein D52-like 1
  Uniprot ID: Q16890
  ENSP ID: ENSP00000376273
MLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMRRK

SEQ ID NO: 93959 - protein, 102 aa, Homo sapiens; identical to SEQ ID NO: 93958
  Payload ID: 18753
  Gene Name: tumor protein D52-like 1
  Uniprot ID: Q16890
  ENSP ID: ENSP00000432590

SEQ ID NO: 93960 - protein, 102 aa, Homo sapiens; identical to SEQ ID NO: 93958
  Payload ID: 18753
  Gene Name: tumor protein D52-like 1
  Uniprot ID: Q16890
  ENSP ID: ENSP00000432787

SEQ ID NO: 93961 - protein, 92 aa, Homo sapiens
  Payload ID: 18753
  Gene Name: tumor protein D52-like 1
  ENSP ID: ENSP00000432806
MLSEEEKEELKAELVQLEDEITTLRQVLSAKERHLVEIKQKLGMNLMNELKQNFSKSWHDMQTTTAYKKTHETLSHAGQKATAAFSNVGTAI

SEQ ID NO: 93962 - protein, 204 aa, Homo sapiens
  Payload ID: 18753
  Gene Name: tumor protein D52-like 1
  Uniprot ID: Q16890
  ENSP ID: ENSP00000434142
MEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRNSPTFKSFEERVETTVTSLKTKVGGTNPNGGSFEEVLSSTAHASAQSLAGGSRRTKEEELQC

SEQ ID NO: 93963 - protein, 166 aa, Homo sapiens
  Payload ID: 18753
  Gene Name: tumor protein D52-like 1
  ENSP ID: ENSP00000434743
MEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRNSPTFKSFEERVETTVTSLKVQMK

SEQ ID NO: 93964 - protein, 175 aa, Homo sapiens
  Payload ID: 18753
  Gene Name: tumor protein D52-like 1
  Uniprot ID: Q16890
  ENSP ID: ENSP00000435447
MLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRNSPTFKSFEERVETTVTSLKTKVGGTNPNGGSFEEVLSSTAHASAQSLAGGSRRTKEEELQC

SEQ ID NO: 93965 - protein, 191 aa, Homo sapiens
  Payload ID: 18753
  Gene Name: tumor protein D52-like 1
  ENSP ID: ENSP00000436953
MEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMRNSPTFKSFEERVETTVTSLKTKVGGTNPNGGSFEEVLSSTAHASAQSLAGGSRRTKEEELQC

SEQ ID NO: 93966 - protein, 229 aa, Homo sapiens
  Payload ID: 18754
  Gene Name: tumor protein D52-like 2
  Uniprot ID: O43399
  ENSP ID: ENSP00000217121
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYVKTSEKLGEWNEKVTQSDLYKKTQETLSQAGQKTSAALSTVGSAISRKLGDMRAHPFSHSFSSYSIRHSISMPAMRNSATFKSFEDRVGTIKSKVVGDRENGSDNLPSSAGSGDKPLSDPAPF

SEQ ID NO: 93967 - protein, 209 aa, Homo sapiens
  Payload ID: 18754
  Gene Name: tumor protein D52-like 2
  Uniprot ID: O43399
  ENSP ID: ENSP00000340006
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYKKTQETLSQAGQKTSAALSTVGSAISRKLGDMRAHPFSHSFSSYSIRHSISMPAMRNSATFKSFEDRVGTIKSKVVGDRENGSDNLPSSAGSGDKPLSDPAPF

SEQ ID NO: 93968 - protein, 206 aa, Homo sapiens
  Payload ID: 18754
  Gene Name: tumor protein D52-like 2
  Uniprot ID: O43399
  ENSP ID: ENSP00000343547
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYVKTSEKLGEWNEKVTQSDLYKKTQETLSQAGQKTSAALSTVGSAISRKLGDMRNSATFKSFEDRVGTIKSKVVGDRENGSDNLPSSAGSGDKPLSDPAPF

SEQ ID NO: 93969 - protein, 186 aa, Homo sapiens
  Payload ID: 18754
  Gene Name: tumor protein D52-like 2
  Uniprot ID: O43399
  ENSP ID: ENSP00000343554
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYKKTQETLSQAGQKTSAALSTVGSAISRKLGDMRNSATFKSFEDRVGTIKSKVVGDRENGSDNLPSSAGSGDKPLSDPAPF

SEQ ID NO: 93970 - protein, 220 aa, Homo sapiens
  Payload ID: 18754
  Gene Name: tumor protein D52-like 2
  Uniprot ID: O43399
  ENSP ID: ENSP00000344647
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYVKTSEKLGEWNEKVTQSDLYKKTQETLSQAGQKTSAALSTVGSAISRKLGDMSSYSIRHSISMPAMRNSATFKSFEDRVGTIKSKVVGDRENGSDNLPSSAGSGDKPLSDPAPF

SEQ ID NO: 93971 - protein, 200 aa, Homo sapiens
  Payload ID: 18754
  Gene Name: tumor protein D52-like 2
  Uniprot ID: O43399
  ENSP ID: ENSP00000351350
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYKKTQETLSQAGQKTSAALSTVGSAISRKLGDMSSYSIRHSISMPAMRNSATFKSFEDRVGTIKSKVVGDRENGSDNLPSSAGSGDKPLSDPAPF

SEQ ID NO: 93972 - protein, 163 aa, Homo sapiens
  Payload ID: 18754
  Gene Name: tumor protein D52-like 2
  Uniprot ID: O43399
  ENSP ID: ENSP00000358943
MDSAGQGVAARTPAVEGLTEAEEEELRAELTKVEEEIVTLRQVLAAKERHCGELKRRLGLSTLGELKQNLSRSWHDVQVSSAYKKTQETLSQAGQKTSAALSTVGSAISRKLGDMRNSATFKSFEDRVGTIKSKVVGDRENGSDNLPSSAGSGDKPLSDPAPF

SEQ ID NO: 93973 - protein, 222 aa, Homo sapiens
  Payload ID: 18754
  Gene Name: tumor protein D52-like 2
  ENSP ID: ENSP00000482024
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYVKTSEKLGEWNEKVTQSDLYKKTQETLSQAGQKTSAALSTVGSAISRKLGDMSLRLWVTERTAVTTSLPQRGVVTSPCRIPHLSKPVVASPAAEHTQPSLSITAAALFSGAASQGG

SEQ ID NO: 93974 - protein, 152 aa, Homo sapiens
  Payload ID: 18754
  Gene Name: tumor protein D52-like 2
  ENSP ID: ENSP00000482370
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSANSATFKSFEDRVGTIKSKVVGDRENGSDNLPSSAGSGDKPLSDPAPF

SEQ ID NO: 93975 - protein, 136 aa, Homo sapiens
  Payload ID: 18755
  Gene Name: tumor protein D52-like 3
  Uniprot ID: Q96J77
  ENSP ID: ENSP00000318665
MPHARTETSVGTYESHSTSELEDLTEPEQRELKTKLTKLEAEIVTLRHVLAAKERRCGELKRKLGLTALVGLRQNLSKSWLDVQVSNTYVKQKTSAALSTMGTLICRKLGGVKKSATFRSFEGLIFNKYTLNQGRN

SEQ ID NO: 93976 - protein, 140 aa, Homo sapiens
  Payload ID: 18755
  Gene Name: tumor protein D52-like 3
  Uniprot ID: Q96J77
  ENSP ID: ENSP00000341677
MPHARTETSVGTYESHSTSELEDLTEPEQRELKTKLTKLEAEIVTLRHVLAAKERRCGELKRKLGLTALVGLRQNLSKSWLDVQVSNTYVKQKTSAALSTMGTLICRKLGGVKKSATFRSFEGLMGTIKSKVSGGKRAWP

SEQ ID NO: 93977 - protein, 132 aa, Homo sapiens
  Payload ID: 18755
  Gene Name: tumor protein D52-like 3
  Uniprot ID: Q96J77
  ENSP ID: ENSP00000370836
MPHARTETSVGTYESHSTSELEDLTEPEQRELKTKLTKLEAEIVTLRHVLAAKERRCGELKRKLGLTALVGLRQNLSKSWLDVQVSNTYVKQKTSAALSTMGTLICRKLGGVKKSATFRSFEGNPKGEGSRI

SEQ ID NO: 93978 - protein, 393 aa, Homo sapiens [sequence omitted]

SEQ ID NO: 93979 - protein, 343 aa, Homo sapiens
  Payload ID: 18756
  Gene Name: tumor protein p53
  ENSP ID: ENSP00000352610
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQKTFPARHGGSHL

SEQ ID NO: 93980 - protein, 341 aa, Homo sapiens
  Payload ID: 18756
  Gene Name: tumor protein p53
  Uniprot ID: P04637
  ENSP ID: ENSP00000391127
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 93981 - protein, 393 aa, Homo sapiens [sequence omitted]

SEQ ID NO: 93982 - protein, 346 aa, Homo sapiens
  Payload ID: 18756
  Gene Name: tumor protein p53
  Uniprot ID: P04637
  ENSP ID: ENSP00000398846
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 93983 - protein, 285 aa, Homo sapiens
  Payload ID: 18756
  Gene Name: tumor protein p53
  ENSP ID: ENSP00000410739
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSRPRQVDHLRSGVQDSLANIAKSHLY

SEQ ID NO: 93984 - protein, 155 aa, Homo sapiens
  Payload ID: 18756
  Gene Name: tumor protein p53
  ENSP ID: ENSP00000423862
MEEPQSDPSVEPPLSQETFSDLWKLLPENNVLYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNR

SEQ ID NO: 93985 - protein, 165 aa, Homo sapiens
  Payload ID: 18756
  Gene Name: tumor protein p53
  ENSP ID: ENSP00000424104
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQ

SEQ ID NO: 93986 - protein, 199 aa, Homo sapiens
  Payload ID: 18756
  Gene Name: tumor protein p53
  ENSP ID: ENSP00000425104
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQ

SEQ ID NO: 93987 - protein, 127 aa, Homo sapiens
  Payload ID: 18756
  Gene Name: tumor protein p53
  ENSP ID: ENSP00000426252
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYS

SEQ ID NO: 93988 - protein, 31 aa, Homo sapiens
  Payload ID: 18756
  Gene Name: tumor protein p53
  ENSP ID: ENSP00000458393
  MOD_RES (1)..(1): Any amino acid
XSPQPKKKPLDGEYFTLQPPEVQKGSVYLPP

SEQ ID NO: 93989 - protein, 143 aa, Homo sapiens
  Payload ID: 18756
  Gene Name: tumor protein p53
  ENSP ID: ENSP00000473895
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTMFCQLAKTCPVQLWVDST

SEQ ID NO: 93990 - protein, 187 aa, Homo sapiens
  Payload ID: 18756
  Gene Name: tumor protein p53
  ENSP ID: ENSP00000477531
MAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 93991 - protein, 354 aa, Homo sapiens
  Payload ID: 18756
  Gene Name: tumor protein p53
  Uniprot ID: P04637
  ENSP ID: ENSP00000478219
MDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 93992 - protein, 209 aa, Homo sapiens
  Payload ID: 18756
  Gene Name: tumor protein p53
  Uniprot ID: P04637
  ENSP ID: ENSP00000478499
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 93993 - protein, 307 aa, Homo sapiens
  Payload ID: 18756
  Gene Name: tumor protein p53
  Uniprot ID: P04637
  ENSP ID: ENSP00000480868
MDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 93994 - protein, 261 aa, Homo sapiens
  Payload ID: 18756
  Gene Name: tumor protein p53
  Uniprot ID: P04637
  ENSP ID: ENSP00000481179
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 93995 - protein, 182 aa, Homo sapiens
  Payload ID: 18756
  Gene Name: tumor protein p53
  ENSP ID: ENSP00000481401
MAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 93996 - protein, 354 aa, Homo sapiens; identical to SEQ ID NO: 93991
  Payload ID: 18756
  Gene Name: tumor protein p53
  Uniprot ID: P04637
  ENSP ID: ENSP00000481638

SEQ ID NO: 93997 - protein, 302 aa, Homo sapiens
  Payload ID: 18756
  Gene Name: tumor protein p53
  Uniprot ID: P04637
  ENSP ID: ENSP00000482222
MDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 93998 - protein, 341 aa, Homo sapiens; identical to SEQ ID NO: 93980
  Payload ID: 18756
  Gene Name: tumor protein p53
  Uniprot ID: P04637
  ENSP ID: ENSP00000482258

SEQ ID NO: 93999 - protein, 354 aa, Homo sapiens; identical to SEQ ID NO: 93991
  Payload ID: 18756
  Gene Name: tumor protein p53
  Uniprot ID: P04637
  ENSP ID: ENSP00000482537

SEQ ID NO: 94000 - protein, 382 aa, Homo sapiens
  Payload ID: 18756
  Gene Name: tumor protein p53
  ENSP ID: ENSP00000482903
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLSCKYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 94001 - protein, 234 aa, Homo sapiens
  Payload ID: 18756
  Gene Name: tumor protein p53
  ENSP ID: ENSP00000484375
MAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 94002 - protein, 214 aa, Homo sapiens
  Payload ID: 18756
  Gene Name: tumor protein p53
  Uniprot ID: P04637
  ENSP ID: ENSP00000484409
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 94003 - protein, 410 aa, Homo sapiens
  Payload ID: 18756
  Gene Name: tumor protein p53
  ENSP ID: ENSP00000488924
MDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSRECQTLSPGDPDPPLSETFNLNICPYPAGKLELLKLSPCPCLCRQVTLMSFLFFFLIFFYFRLYWGIIDPPKLHTFKVCSVMI

SEQ ID NO: 94004 - protein, 1972 aa, Homo sapiens
  Payload ID: 18757
  Gene Name: tumor protein p53 binding protein 1
  Uniprot ID: Q12888
  ENSP ID: ENSP00000263801
MDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 94005 - protein, 1927 aa, Homo sapiens
  Payload ID: 18757
  Gene Name: tumor protein p53 binding protein 1
  ENSP ID: ENSP00000371470
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 94006 - protein, 1977 aa, Homo sapiens
  Payload ID: 18757
  Gene Name: tumor protein p53 binding protein 1
  Uniprot ID: Q12888
  ENSP ID: ENSP00000371475
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 94007 - protein, 1033 aa, Homo sapiens
  Payload ID: 18757
  Gene Name: tumor protein p53 binding protein 1
  ENSP ID: ENSP00000388028
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSS

SEQ ID NO: 94008 - protein, 163 aa, Homo sapiens
  Payload ID: 18757
  Gene Name: tumor protein p53 binding protein 1
  ENSP ID: ENSP00000392048
LLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGRHA

SEQ ID NO: 94009 - protein, 1975 aa, Homo sapiens
  Payload ID: 18757
  Gene Name: tumor protein p53 binding protein 1
  Uniprot ID: Q12888
  ENSP ID: ENSP00000393497
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 94010 - protein, 48 aa, Homo sapiens
  Payload ID: 18757
  Gene Name: tumor protein p53 binding protein 1
  ENSP ID: ENSP00000398508
  MOD_RES (1)..(1): Any amino acid
XTMSVLSCICEARQENEARSEDPPTTPIREKKSLICLSLHMAMSYIVT

SEQ ID NO: 94011 - protein, 192 aa, Homo sapiens
  Payload ID: 18757
  Gene Name: tumor protein p53 binding protein 1
  ENSP ID: ENSP00000413010
  MOD_RES (1)..(1): Any amino acid
XSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIVSAGR

SEQ ID NO: 94012 - protein, 149 aa, Homo sapiens
  Payload ID: 18757
  Gene Name: tumor protein p53 binding protein 1
  ENSP ID: ENSP00000416212
  MOD_RES (1)..(1): Any amino acid
XTGEPSALEEQRGPLPLNKTLFLGYAFLLTMATTSDKLASRSKLPDGPTGSSEEEEAYCNHPSQSGLNALPSSPFAFYGHLLEQTHVEEFLEIPPFNKQYTESQLRAGAGYILEDFNEAQCNTAYQCLLIADQHCRTRKYFLCLASGIP

SEQ ID NO: 94013 - protein, 144 aa, Homo sapiens
  Payload ID: 18757
  Gene Name: tumor protein p53 binding protein 1
  ENSP ID: ENSP00000471624
  MOD_RES (1)..(1): Any amino acid
XHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLRCRQGLQRERATAGAGLLTF

SEQ ID NO: 94014 - protein, 1134 aa, Homo sapiens
  Payload ID: 18758
  Gene Name: tumor protein p53 binding protein 2
  Uniprot ID: Q13625
  ENSP ID: ENSP00000341957
MRFGSKMMPMFLTVYLSNNEQHFTEVPVTPETICRDVVDLCKEPGESDCHLAEVWCGSERPVADNERMFDVLQRFGSQRNEVRFFLRHERPPGRDIVSGPRSQDPSLKRNGVKVPGEYRRKENGVNSPRMDLTLAELQEMASRQQQQIEAQQQLLATKEQRLKFLKQQDQRQQQQVAEQEKLKRLKEIAENQEAKLKKVRALKGHVEQKRLSNGKLVEEIEQMNNLFQQKQRELVLAVSKVEELTRQLEMLKNGRIDSHHDNQSAVAELDRLYKELQLRNKLNQEQNAKLQQQRECLNKRNSEVAVMDKRVNELRDRLWKKKAALQQKENLPVSSDGNLPQQAASAPSRVAAVGPYIQSSTMPRMPSRPELLVKPALPDGSLVIQASEGPMKIQTLPNMRSGAASQTKGSKIHPVGPDWSPSNADLFPSQGSASVPQSTGNALDQVDDGEVPLREKEKKVRPFSMFDAVDQSNAPPSFGTLRKNQSSEDILRDAQVANKNVAKVPPPVPTKPKQINLPYFGQTNQPPSDIKPDGSSQQLSTVVPSMGTKPKPAGQQPRVLLSPSIPSVGQDQTLSPGSKQESPPAAAVRPFTPQPSKDTLLPPFRKPQTVAASSIYSMYTQQQAPGKNFQQAVQSALTKTHTRGPHFSSVYGKPVIAAAQNQQQHPENIYSNSQGKPGSPEPETEPVSSVQENHENERIPRPLSPTKLLPFLSNPYRNQSDADLEALRKKLSNAPRPLKKRSSITEPEGPNGPNIQKLLYQRTTIAAMETISVPSYPSKSASVTASSESPVEIQNPYLHVEPEKEVVSLVPESLSPEDVGNASTENSDMPAPSPGLDYEPEGVPDNSPNLQNNPEEPNPEAPHVLDVYLEEYPPYPPPPYPSGEPEGPGEDSVSMRPPEITGQVSLPPGKRTNLRKTGSERIAHGMRVKFNPLALLLDSSLEGEFDLVQRIIYEVDDPSLPNDEGITALHNAVCAGHTEIVKFLVQFGVNVNAADSDGWTPLHCAASCNNVQVCKFLVESGAAVFAMTYSDMQTAADKCEEMEEGYTQCSQFLYGVQEKMGIMNKGVIYALWDYEPQNDDELPMKEGDCMTIIHREDEDEIEWWWARLNDKEGYVPRNLLGLYPRIKPRQRSLA

SEQ ID NO: 94015 - protein, 1005 aa, Homo sapiens
  Payload ID: 18758
  Gene Name: tumor protein p53 binding protein 2
  Uniprot ID: Q13625
  ENSP ID: ENSP00000375750
MDLTLAELQEMASRQQQQIEAQQQLLATKEQRLKFLKQQDQRQQQQVAEQEKLKRLKEIAENQEAKLKKVRALKGHVEQKRLSNGKLVEEIEQMNNLFQQKQRELVLAVSKVEELTRQLEMLKNGRIDSHHDNQSAVAELDRLYKELQLRNKLNQEQNAKLQQQRECLNKRNSEVAVMDKRVNELRDRLWKKKAALQQKENLPVSSDGNLPQQAASAPSRVAAVGPYIQSSTMPRMPSRPELLVKPALPDGSLVIQASEGPMKIQTLPNMRSGAASQTKGSKIHPVGPDWSPSNADLFPSQGSASVPQSTGNALDQVDDGEVPLREKEKKVRPFSMFDAVDQSNAPPSFGTLRKNQSSEDILRDAQVANKNVAKVPPPVPTKPKQINLPYFGQTNQPPSDIKPDGSSQQLSTVVPSMGTKPKPAGQQPRVLLSPSIPSVGQDQTLSPGSKQESPPAAAVRPFTPQPSKDTLLPPFRKPQTVAASSIYSMYTQQQAPGKNFQQAVQSALTKTHTRGPHFSSVYGKPVIAAAQNQQQHPENIYSNSQGKPGSPEPETEPVSSVQENHENERIPRPLSPTKLLPFLSNPYRNQSDADLEALRKKLSNAPRPLKKRSSITEPEGPNGPNIQKLLYQRTTIAAMETISVPSYPSKSASVTASSESPVEIQNPYLHVEPEKEVVSLVPESLSPEDVGNASTENSDMPAPSPGLDYEPEGVPDNSPNLQNNPEEPNPEAPHVLDVYLEEYPPYPPPPYPSGEPEGPGEDSVSMRPPEITGQVSLPPGKRTNLRKTGSERIAHGMRVKFNPLALLLDSSLEGEFDLVQRIIYEVDDPSLPNDEGITALHNAVCAGHTEIVKFLVQFGVNVNAADSDGWTPLHCAASCNNVQVCKFLVESGAAVFAMTYSDMQTAADKCEEMEEGYTQCSQFLYGVQEKMGIMNKGVIYALWDYEPQNDDELPMKEGDCMTIIHREDEDEIEWWWARLNDKEGYVPRNLLGLYPRIKPRQRSLA

SEQ ID NO: 94016 - protein, 64 aa, Homo sapiens
  Payload ID: 18758
  Gene Name: tumor protein p53 binding protein 2
  ENSP ID: ENSP00000417174
  MOD_RES (1)..(1): Any amino acid
XSTGNALDQVDDGEVPLREKEKKVRPFSMFDAVDQSNAPPSFGTLRKNQSSEDILRDAQYMVSL

SEQ ID NO: 94017 - protein, 64 aa, Homo sapiens; identical to SEQ ID NO: 94016
  Payload ID: 18758
  Gene Name: tumor protein p53 binding protein 2
  ENSP ID: ENSP00000417987
  MOD_RES (1)..(1): Any amino acid

SEQ ID NO: 94018 - protein, 47 aa, Homo sapiens
  Payload ID: 18758
  Gene Name: tumor protein p53 binding protein 2
  ENSP ID: ENSP00000418252
MRFGSKMMPNVQLRIMSECLMFFNDLEVRGTKFASSFVMNAPLAGTL

SEQ ID NO: 94019 - protein, 234 aa, Homo sapiens
  Payload ID: 18758
  Gene Name: tumor protein p53 binding protein 2
  ENSP ID: ENSP00000420225
  MOD_RES (1)..(1): Any amino acid
XMFDVLQRFGSQRNEVRFFLRHERPPGRDIVSGPRSQDPSLKRNGVKVPGEYRRKENGVNSPRMDLTLAELQEMASRQQQQIEAQQQLLATKEQRLKFLKQQDQRQQQQVAEQEKLKRLKEIAENQEAKLKKVRALKGHVVSLVPESLSPEDVGNASTENSDMPAPSPGLDYEPEGVPDNSPNLQNNPEEPNPEAPHVLDVYLEEYPPYPPPPYPSGEPEGPGEDSVSMRPPEI

SEQ ID NO: 94020 - protein, 240 aa, Homo sapiens
  Payload ID: 18759
  Gene Name: tumor protein p53 inducible nuclear protein 1
  Uniprot ID: Q96A56
  ENSP ID: ENSP00000344215
MFQRLNKMFVGEVSSSSNQEPEFNEKEDDEWILVDFIDTCTGFSAEEEEEEEDISEESPTEHPSVFSCLPASLECLADTSDSCFLQFESCPMEESWFITPPPCFTAGGLTTIKVETSPMENLLIEHPSMSVYAVHNSCPGLSEATRGTDELHSPSSPRVEAQNEMGQHIHCYVAALAAHTTFLEQPKSFRPSQWIKEHSERQPLNRNSLRRQNLTRDCHPRQVKHNGWVVHQPCPRQYNY

SEQ ID NO: 94021 - protein, 164 aa, Homo sapiens
  Payload ID: 18759
  Gene Name: tumor protein p53 inducible nuclear protein 1
  Uniprot ID: Q96A56
  ENSP ID: ENSP00000390063
MFQRLNKMFVGEVSSSSNQEPEFNEKEDDEWILVDFIDTCTGFSAEEEEEEEDISEESPTEHPSVFSCLPASLECLADTSDSCFLQFESCPMEESWFITPPPCFTAGGLTTIKVETSPMENLLIEHPSMSVYAVHNSCPGLSEATRGTDELHSPSSPRARKSCL

SEQ ID NO: 94022 - protein, 220 aa, Homo sapiens
  Payload ID: 18760
  Gene Name: tumor protein p53 inducible nuclear protein 2
  Uniprot ID: Q8IXH6
  ENSP ID: ENSP00000363942
MFQRLSSLFFSTPSPPEDPDCPRAFVSEEDEVDGWLIIDLPDSYAAPPSPGAAPAPAGRPPPAPSLMDESWFVTPPACFTAEGPGLGPARLQSSPLEDLLIEHPSMSVYVTGSTIVLEPGSPSPLPDAALPDGDLSEGELTPARREPRAARHAAPLPARAALLEKAGQVRRLQRARQRAERHALSAKAVQRQNRARESRPRRSKNQSSFIYQPCQRQFNY

SEQ ID NO: 94023 - protein, 220 aa, Homo sapiens; identical to SEQ ID NO: 94022
  Payload ID: 18760
  Gene Name: tumor protein p53 inducible nuclear protein 2
  Uniprot ID: Q8IXH6
  ENSP ID: ENSP00000363943

SEQ ID NO: 94024 - protein, 88 aa, Homo sapiens
  Payload ID: 18760
  Gene Name: tumor protein p53 inducible nuclear protein 2
  ENSP ID: ENSP00000395784
MFQRLSSLFFSTPSPPEDPDCPRAFVSEEDEVDGWLIIDLPEGPGLGPARLQSSPLEDLLIEHPSMSVYVTGSTIVLEPGSPSPLPDA

SEQ ID NO: 94025 - protein, 77 aa, Homo sapiens
  Payload ID: 18760
  Gene Name: tumor protein p53 inducible nuclear protein 2
  ENSP ID: ENSP00000404410
MFQRLSSLFFSTPSPPEDPDCPRAFVSEEDEVDGWLIIDLPDSYAAPPSPGAAPAPAGRPPPAPSLMDESWFVTPPA

SEQ ID NO: 94026 - protein, 189 aa, Homo sapiens
  Payload ID: 18761
  Gene Name: tumor protein p53 inducible protein 11
  Uniprot ID: O14683
  ENSP ID: ENSP00000309532
MAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVTSKTPIRLYGGALLSISLIMWNALYTAEKVIIRWTLLTEACYFGVQFLVVTATLAETGLMSLGILLLLVSRLLFVVISIYYYYQVGRRPKKA

SEQ ID NO: 94027 - protein, 236 aa, Homo sapiens
  Payload ID: 18761
  Gene Name: tumor protein p53 inducible protein 11
  ENSP ID: ENSP00000346564
MAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVTSKTPIRLYGGALLKVETESDRGEVTCLRSQLVSGEAKIGTQAIQLGRTKDGVSETSPASALLLAFSLIQTWLQPLGWDWPPYLPFNPVLPCCQKELSRKHMSPQPSLAGTQPLQETKLPPTDHRTSKTHHRHLLLFLP

SEQ ID NO: 94028 - protein, 189 aa, Homo sapiens; identical to SEQ ID NO: 94026
  Payload ID: 18761
  Gene Name: tumor protein p53 inducible protein 11
  Uniprot ID: O14683
  ENSP ID: ENSP00000379009

SEQ ID NO: 94029 - protein, 73 aa, Homo sapiens
  Payload ID: 18761
  Gene Name: tumor protein p53 inducible protein 11
  ENSP ID: ENSP00000431556
MAAKQPPPLMKKHSQTDLVSRLKTRKILGVGGEDDDGEVHRSKISQVLGNEIKFTIREPLGLRVWQFVSAVLF

SEQ ID NO: 94030 - protein, 79 aa, Homo sapiens
  Payload ID: 18761
  Gene Name: tumor protein p53 inducible protein 11
  ENSP ID: ENSP00000432089
MAAKQPPPLMKKHSQTDLVSRLKTRKILGVGGEDDDGEVHRSKISQVLGNEIKFTIREPLGLRVWQFVSAVLFSGIAIM

SEQ ID NO: 94031 - protein, 62 aa, Homo sapiens
  Payload ID: 18761
  Gene Name: tumor protein p53 inducible protein 11
  ENSP ID: ENSP00000432926
MAAKQPPPLMKKHSQTDLVSRLKTRKILGVGGEDDDGEVHRSKISQVLGNEIKFTIREPLGL

SEQ ID NO: 94032 - protein, 158 aa, Homo sapiens
  Payload ID: 18761
  Gene Name: tumor protein p53 inducible protein 11
  ENSP ID: ENSP00000433454
MAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVTSKTPIRLYGGALLSISLIMWNALYTAEKVIIRWTLLTEACYFGVQFLVVTATLAETGLMS

SEQ ID NO: 94033 - protein, 189 aa, Homo sapiens; identical to SEQ ID NO: 94026
  Payload ID: 18761
  Gene Name: tumor protein p53 inducible protein 11
  Uniprot ID: O14683
  ENSP ID: ENSP00000433474

SEQ ID NO: 94034 - protein, 98 aa, Homo sapiens
  Payload ID: 18761
  Gene Name: tumor protein p53 inducible protein 11
  ENSP ID: ENSP00000434461
MAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVT

SEQ ID NO: 94035 - protein, 123 aa, Homo sapiens
  Payload ID: 18761
  Gene Name: tumor protein p53 inducible protein 11
  ENSP ID: ENSP00000435739
MPPSCHLLCPDLSPSSAHPSAEAGLEEKMAAKQPPPLMKKHSQTDLVSRLKTRKILGVGGEDDDGEVHRSKISQVLGNEIKFTIREPLGLRVWQFVSAVLFSGIAIMALAFPDQLYDAVFDGA

SEQ ID NO: 94036 - protein, 126 aa, Homo sapiens
  Payload ID: 18761
  Gene Name: tumor protein p53 inducible protein 11
  ENSP ID: ENSP00000435800
MAAKQPPPLMKKHSQTDLVSRLKTRKILGVGGEDDDGEVHRSKISQVLGNEIKFTIREPLGLRVWQFVSAVLFSGIAIMVSPHPQPLRSGPVWLPQPFSGSPEVPPPSWPLVQGPICQALGLPPRT

SEQ ID NO: 94037 - protein, 189 aa, Homo sapiens; identical to SEQ ID NO: 94026
  Payload ID: 18761
  Gene Name: tumor protein p53 inducible protein 11
  Uniprot ID: O14683
  ENSP ID: ENSP00000436152

SEQ ID NO: 94038 - protein, 64 aa, Homo sapiens
  Payload ID: 18761
  Gene Name: tumor protein p53 inducible protein 11
  ENSP ID: ENSP00000437243
MAAKQPPPLMKKHSQTDLVSRLKTRKILGVGGEDDDGEVHRSKGLAVRLCCALLRHCHHGACLP

SEQ ID NO: 94039 - protein, 91 aa, Homo sapiens
  Payload ID: 18761
  Gene Name: tumor protein p53 inducible protein 11
  ENSP ID: ENSP00000437258
MAAKQPPPLMKKHSQTDLVSRLKTRKILGVGGEDDDGEVHRSKGLAVRLCCALLRHCHHGISLIMWNALYTAEKVIIRWTLLTEACYFGVQ

SEQ ID NO: 94040 - protein, 93 aa, Homo sapiens
  Payload ID: 18761
  Gene Name: tumor protein p53 inducible protein 11
  ENSP ID: ENSP00000437284
MAAKQPPPLMKKHSQTDLVSRLKTRKILGVGGEDDDGEVHRSKISQVLGNEIKFTIREPLGLRVWQFVSAVLFSGIAIMALAFPDQLYDAVFD

SEQ ID NO: 94041 - protein, 154 aa, Homo sapiens
  Payload ID: 18761
  Gene Name: tumor protein p53 inducible protein 11
  ENSP ID: ENSP00000475501
MAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVTSKTPIRLYGGALLNAAPTPRPLMKLSAGDVLPSCGHWWNTPSGLELAVATICKERS

SEQ ID NO: 94042 - protein, 189 aa, Homo sapiens; identical to SEQ ID NO: 94026
  Payload ID: 18761
  Gene Name: tumor protein p53 inducible protein 11
  Uniprot ID: O14683
  ENSP ID: ENSP00000481456

SEQ ID NO: 94043 - protein, 64 aa, Homo sapiens; identical to SEQ ID NO: 94038
  Payload ID: 18761
  Gene Name: tumor protein p53 inducible protein 11
  ENSP ID: ENSP00000486799

SEQ ID NO: 94044 - protein, 393 aa, Homo sapiens
  Payload ID: 18762
  Gene Name: tumor protein p53 inducible protein 13
  Uniprot ID: Q8NBR0
  ENSP ID: ENSP00000301057
MAPPPPSPQLLLLAALARLLGPSEVMAGPAEEAGAHCPESLWPLPPQVSPRVTYTRVSPGQAEDVTFLYHPCAHPWLKLQLALLAYACMANPSLTPDFSLTQDRPLVLTAWGLALEMAWVEPAWAAHWLMRRRRRKQRKKKAWIYCESLSGPAPSEPTPGRGRLCRRGCVQALALAFALRSWRPPGTEVTSQGPRQPSSSGAKRRRLRAALGPQPTRSALRFPSASPGSLKAKQSMAGIPGRESNAPSVPTVSLLPGAPGGNASSRTEAQVPNGQGSPGGCVCSSQASPAPRAAAPPRAARGPTPRTEEAAWAAMALTFLLVLLTLATLCTRLHRNFRRGESIYWGPTADSQDTVAAVLKRRLLQPSRRVKRSRRRPLLPPTPDSGPEGESSE

SEQ ID NO: 94045 - protein, 112 aa, Homo sapiens
  Payload ID: 18762
  Gene Name: tumor protein p53 inducible protein 13
  ENSP ID: ENSP00000368095
EAQVPNGQGSPGGCVCSSQASPAPRAAAPPRAARGPTPRTEEAAWAAMALTFLLVLLTLATLCTRLHRNFRRGESIYWGPRPLPRGPRAGRSLVAMARHWPSTAGAFLLVGC

SEQ ID NO: 94046 - protein, 92 aa, Homo sapiens
  Payload ID: 18762
  Gene Name: tumor protein p53 inducible protein 13
  ENSP ID: ENSP00000462026
  MOD_RES (1)..(1): Any amino acid
XLTFPASGLRRVMAGPAEEAGAHCPESLWPLPPQVSPRVTYTRVSPGQAEDVTFLYHPCAHPWLKLQLALLAYACMANPSLTPDFSLTQDRL

SEQ ID NO: 94047 - protein, 156 aa, Homo sapiens
  Payload ID: 18762
  Gene Name: tumor protein p53 inducible protein 13
  ENSP ID: ENSP00000462693
MAGPAEEAGAHCPESLWPLPPQVSPRVTYTRVSPGQAEDVTFLYHPCAHPWLKLQLALLAYACMANPSLTPDFSLTQDRPLVLTAWGLALEMAWVEPAWAAHWLMRRRRRKQRKKKAWIYCESLSGPAPSEPTPGRGRLCRRGCVQALALAFALRS

SEQ ID NO: 94048 - protein, 175 aa, Homo sapiens
  Payload ID: 18762
  Gene Name: tumor protein p53 inducible protein 13
  ENSP ID: ENSP00000465112
MAGPAEEAGAHCPESLWPLPPQVSPRVTYTRVSPGQAEDVTFLYHPCAHPWLKLQLALLAYACMANPSLTPDFSLTQDRPLVLTAWGLALEMAWVEPAWAAHWLMRRRRRKQRKKKAWIYCESLSGPAPSEPTPGRGRLCRRGCVQALALAFALRSWRPPGTEVTSQGPRQPSSS

SEQ ID NO: 94049 - protein, 73 aa, Homo sapiens
  Payload ID: 18762
  Gene Name: tumor protein p53 inducible protein 13
  ENSP ID: ENSP00000465824
MAGPAEEAGAHCPESLWPLPPQVSPRVTYTRVSPGQAEDVTFLYHPCAHPWLKLQLALLAYACMANPSLTPDF

SEQ ID NO: 94050 - protein, 185 aa, Homo sapiens
  Payload ID: 18762
  Gene Name: tumor protein p53 inducible protein 13
  ENSP ID: ENSP00000466027
MAGPAEEAGAHCPESLWPLPPQVSPRVTYTRVSPGQAEDVTFLYHPCAHPWLKLQLALLAYACMANPSLTPDFSLTQDRPLVLTAWGLALEMAWVEPAWAAHWLMRRRRRKQRKKKAWIYCESLSGPAPSEPTPGRGRLCRRGCVQALALAFALRSWRPPGTEVTSQGPRQPSSSGAKRRRLRAA

SEQ ID NO: 94051 - protein, 195 aa, Homo sapiens
  Payload ID: 18762
  Gene Name: tumor protein p53 inducible protein 13
  ENSP ID: ENSP00000468265
MAGPAEEAGAHCPESLWPLPPQVSPRVTYTRVSPGQAEDVTFLYHPCAHPWLKLQLALLAYACMANPSLTPDFSLTQDRPLVLTAWGLALEMAWVEPAWAAHWLMRRRRRKQRKKKAWIYCESLSGPAPSEPTPGRGRLCRRGCVQALALAFALRSWRPPGTEVTSQGPRQPSSSGAKRRRLRAALGPQPTRSAL

SEQ ID NO: 94052 - protein, 332 aa, Homo sapiens
  Payload ID: 18763
  Gene Name: tumor protein p53 inducible protein 3
  Uniprot ID: Q53FA7
  ENSP ID: ENSP00000238721
MLAVHFDKPGGPENLYVKEVAKPSPGEGEVLLKVAASALNRADLMQRQGQYDPPPGASNILGLEASGHVAELGPGCQGHWKIGDTAMALLPGGGQAQYVTVPEGLLMPIPEGLTLTQAAAIPEAWLTAFQLLHLVGNVQAGDYVLIHAGLSGVGTAAIQLTRMAGAIPLVTAGSQKKLQMAEKLGAAAGFNYKKEDFSEATLKFTKGAGVNLILDCIGGSYWEKNVNCLALDGRWVLYGLMGGGDINGPLFSKLLFKRGSLITSLLRSRDNKYKQMLVNAFTEQILPHFSTEGPQRLLPVLDRIYPVTEIQEAHKYMEANKNIGKIVLELPQ

SEQ ID NO: 94053 - protein, 332 aa, Homo sapiens; identical to SEQ ID NO: 94052
  Payload ID: 18763
  Gene Name: tumor protein p53 inducible protein 3
  Uniprot ID: Q53FA7
  ENSP ID: ENSP00000337834

SEQ ID NO: 94054 - protein, 248 aa, Homo sapiens
  Payload ID: 18763
  Gene Name: tumor protein p53 inducible protein 3
  Uniprot ID: Q53FA7
  ENSP ID: ENSP00000384414
MLAVHFDKPGGPENLYVKEVAKPSPGEGEVLLKVAASALNRADLMQRQGQYDPPPGASNILGLEASGHVAELGPGCQGHWKIGDTAMALLPGGGQAQYVTVPEGLLMPIPEGLTLTQAAAIPEAWLTAFQLLHLVGNVQAGDYVLIHAGLSGVGTAAIQLTRMAGAIPLVTAGSQKKLQMAEKLGAAAGFNYKKEDFSEATLKFTKVQANAGECFHGANSASLLHGGPPTSAAGSGQNLPSDRNPGGP

SEQ ID NO: 94055 - protein, 216 aa, Homo sapiens
  Payload ID: 18763
  Gene Name: tumor protein p53 inducible protein 3
  ENSP ID: ENSP00000389620
FDKPGGPENLYVKEVAKPSPGEGEVLLKVAASALNRADLMQRQGQYDPPPGASNILGLEASGHVAELGPGCQGHWKIGDTAMALLPGGGQAQYVTVPEGLLMPIPEGLTLTQAAAIPEAWLTAFQLLHLVGNVQAGDYVLIHAGLSGVGTAAIQLTRMAGAIPLVTAGSQKKLQMAEKLGAAAGFNYKKEDFSEATLKFTKGKQLLLQFSRNLRDD

SEQ ID NO: 94056 - protein, 86 aa, Homo sapiens
  Payload ID: 18764
  Gene Name: tumor protein p53 regulated apoptosis inducing protein 1
  Uniprot ID: Q9HCN2
  ENSP ID: ENSP00000390694
MGSSSEASFRSAQASCSGARRQGLGRGDQNLSVMPPNGRAQTHTPGWVSDPLVLGAQVHGGCRGIEALSVSSGSWSSATVWILTVQ

SEQ ID NO: 94057 - protein, 124 aa, Homo sapiens
  Payload ID: 18764
  Gene Name: tumor protein p53 regulated apoptosis inducing protein 1
  Uniprot ID: Q9HCN2
  ENSP ID: ENSP00000432743
MGSSSEASFRSAQASCSGARRQGLGRGDQNLSVMPPNGRAQTHTPGWVSDPLVLGAQVHGGCRGIEALSVSSGSWSSATVWILTGLGLGLSRPFLPGATVLRDRPLGSAFELSYDQKKAPLRLQ

SEQ ID NO: 94058 - protein, 120 aa, Homo sapiens
  Payload ID: 18764
  Gene Name: tumor protein p53 regulated apoptosis inducing protein 1
  Uniprot ID: Q9HCN2
  ENSP ID: ENSP00000432908
MGSSSEASFRSAQASCSGARRQGLGRGDQNLSVMPPNGRAQTHTPGWVSDPLVLGAQVHGGCRGIEALSVSSGSWSSATVWILTGLSRPFLPGATVLRDRPLGSAFELSYDQKKAPLRLQ

SEQ ID NO: 94059 - protein, 108 aa, Homo sapiens
  Payload ID: 18764
  Gene Name: tumor protein p53 regulated apoptosis inducing protein 1
  Uniprot ID: Q9HCN2
  ENSP ID: ENSP00000435175
MGSSSEASFRSAQASCSGARRQGLGRGDQNLSVMPPNGRAQTHTPGWVSPCSENRDGLLPATAPGRLCSHRGADIPSFQTHQDPVTASGSSELHADCPQFRALDRAGN

SEQ ID NO: 94060 - protein, 108 aa, Homo sapiens; identical to SEQ ID NO: 94059
  Payload ID: 18764
  Gene Name: tumor protein p53 regulated apoptosis inducing protein 1
  Uniprot ID: Q9HCN2
  ENSP ID: ENSP00000473353

SEQ ID NO: 94061 - protein, 86 aa, Homo sapiens; identical to SEQ ID NO: 94056
  Payload ID: 18764
  Gene Name: tumor protein p53 regulated apoptosis inducing protein 1
  Uniprot ID: Q9HCN2
  ENSP ID: ENSP00000479350

SEQ ID NO: 94062 - protein, 680 aa, Homo sapiens
  Payload ID: 18765
  Gene Name: tumor protein p63
  Uniprot ID: Q9H3D4
  ENSP ID: ENSP00000264731
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 94063 - protein, 510 aa, Homo sapiens
  Payload ID: 18765
  Gene Name: tumor protein p63
  Uniprot ID: Q9H3D4
  ENSP ID: ENSP00000317510
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANRSGKSENP

SEQ ID NO: 94064 - protein, 586 aa, Homo sapiens
  Payload ID: 18765
  Gene Name: tumor protein p63
  Uniprot ID: Q9H3D4
  ENSP ID: ENSP00000346614
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 94065 - protein, 555 aa, Homo sapiens
  Payload ID: 18765
  Gene Name: tumor protein p63
  Uniprot ID: Q9H3D4
  ENSP ID: ENSP00000376253
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVRIWQV

SEQ ID NO: 94066 - protein, 416 aa, Homo sapiens
  Payload ID: 18765
  Gene Name: tumor protein p63
  Uniprot ID: Q9H3D4
  ENSP ID: ENSP00000376254
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANRSGKSENP

SEQ ID NO: 94067 - protein, 461 aa, Homo sapiens
  Payload ID: 18765
  Gene Name: tumor protein p63
  Uniprot ID: Q9H3D4
  ENSP ID: ENSP00000376256
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVRIWQV

SEQ ID NO: 94068 - protein, 501 aa, Homo sapiens
  Payload ID: 18765
  Gene Name: tumor protein p63
  Uniprot ID: Q9H3D4
  ENSP ID: ENSP00000387839
MLYLENNAQTQFSEYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 94069 - protein, 582 aa, Homo sapiens
  Payload ID: 18765
  Gene Name: tumor protein p63
  Uniprot ID: Q9H3D4
  ENSP ID: ENSP00000389485
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDAFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 94070 - protein, 393 aa, Homo sapiens
  Payload ID: 18765
  Gene Name: tumor protein p63
  Uniprot ID: Q9H3D4
  ENSP ID: ENSP00000392488
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKHLLSACFRNELVEPRRETPKQSDVFFRHSKPPNRSVYP

SEQ ID NO: 94071 - protein, 676 aa, Homo sapiens
  Payload ID: 18765
  Gene Name: tumor protein p63
  Uniprot ID: Q9H3D4
  ENSP ID: ENSP00000394337
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDAFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 94072 - protein, 183 aa, Homo sapiens
  Payload ID: 18765
  Gene Name: tumor protein p63
  ENSP ID: ENSP00000401661
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTSLALSPRLECNGMISAHCNLHLLGSSGSPFSASQVGGITGTRHHAQLIFGTTSAHCNLRLLDSSDSPFSASQYSTELKKLYCQI

SEQ ID NO: 94073 - protein, 487 aa, Homo sapiens
  Payload ID: 18765
  Gene Name: tumor protein p63
  Uniprot ID: Q9H3D4
  ENSP ID: ENSP00000407144
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKHLLSACFRNELVEPRRETPKQSDVFFRHSKPPNRSVYP

SEQ ID NO: 94074 - protein, 275 aa, Homo sapiens
  Payload ID: 18766
  Gene Name: tumor protein p63 regulated 1
  Uniprot ID: Q6ZUI0
  ENSP ID: ENSP00000341031
MSTIGSFEGFQAVSLKQEGDDQPSETDHLSMEEEDPMPRQISRQSSVTESTLYPNPYHQPYISRKYFATRPGAIETAMEDLKGHVAETSGETIQGFWLLTKIDHWNNEKERILLVTDKTLLICKYDFIMLSCVQLQRIPLSAVYRICLGKFTFPGMSLDKRQGEGLRIYWGSPEEQSLLSRWNPWSTEVPYATFTEHPMKYTSEKFLEICKLSGFMSKLVPAIQNAHKNSTGSGRGKKLMVLTEPILIETYTGLMSFIGNRNKLGYSLARGSIGF

SEQ ID NO: 94075 - protein, 133 aa, Homo sapiens
  Payload ID: 18766
  Gene Name: tumor protein p63 regulated 1
  ENSP ID: ENSP00000399133
MSTIGSFEGFQAVSLKQEGDDQPSETDHLSMEEEDPMPRQISRQSSVTESTLYPNPYHQPYISRKYFATRPGAIETAMEDLKGHVAETSGETIQGFWLLTKTDPLSQHQGEHLDTLWNFKKYDMMAIKWLFSR

SEQ ID NO: 94076 - protein, 150 aa, Homo sapiens
  Payload ID: 18766
  Gene Name: tumor protein p63 regulated 1
  ENSP ID: ENSP00000400171
  MOD_RES (1)..(1): Any amino acid
XIETAMEDLKGHVAETSGETIQGFWLLTKIDHWNNEKERILLVTDKTLLICKYDFIMLSCVQLQRIPLSAVYRICLGKFTFPGMSLDKRQGEGLRIYWGSPEEQSLLSRWNPWSTEVPYATFTEHPMKYTSEKFLEICKYAETTAGKDEY

SEQ ID NO: 94077 - protein, 275 aa, Homo sapiens; identical to SEQ ID NO: 94074
  Payload ID: 18766
  Gene Name: tumor protein p63 regulated 1
  Uniprot ID: Q6ZUI0
  ENSP ID: ENSP00000412547

SEQ ID NO: 94078 - protein, 100 aa, Homo sapiens
  Payload ID: 18766
  Gene Name: tumor protein p63 regulated 1
  ENSP ID: ENSP00000415413
MSTIGSFEGFQAVSLKQEGDDQPSETDHLSMEEEDPMPRQISRQSSVTESTLYPNPYHQPYISRKYFATRPGAIETAMEDLKGHVAETSGETIQGFWLLT

SEQ ID NO: 94079 - protein, 213 aa, Homo sapiens
  Payload ID: 18767
  Gene Name: tumor protein p63 regulated 1-like
  Uniprot ID: Q5T0D9
  ENSP ID: ENSP00000339714
MLQLRDSVDSAGTSPTAVLAAGEEVGAGGGPGGGRPGAGTPLRQTLWPLSIHDPTRRARVKEYFVFRPGSIEQAVEEIRVVVRPVEDGEIQGVWLLTEREGFGIRIQWDKQSRPSFINRWNPWSTNVPYATFTEHPMAGADEKTASLCQLESFKALLIQAVKKAQKESPLPGQANGVLILERPLLIETYVGLMSFINNEAKLGYSMTRGKIGF

SEQ ID NO: 94080 - protein, 272 aa, Homo sapiens
  Payload ID: 18767
  Gene Name: tumor protein p63 regulated 1-like
  Uniprot ID: Q5T0D9
  ENSP ID: ENSP00000367595
MLQLRDSVDSAGTSPTAVLAAGEEVGAGGGPGGGRPGAGTPLRQTLWPLSIHDPTRRARVKEYFVFRPGSIEQAVEEIRVVVRPVEDGEIQGVWLLTEVDHWNNEKERLVLVTEQSLLICKYDFISLQCQQVVRIALNAVDTISYGEFQFPPKSLNKREGFGIRIQWDKQSRPSFINRWNPWSTNVPYATFTEHPMAGADEKTASLCQLESFKALLIQAVKKAQKESPLPGQANGVLILERPLLIETYVGLMSFINNEAKLGYSMTRGKIGF

SEQ ID NO: 94081 - protein, 540 aa, Homo sapiens
  Payload ID: 18768
  Gene Name: tumor protein p73
  Uniprot ID: O15350
  ENSP ID: ENSP00000340740
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 94082 - protein, 499 aa, Homo sapiens
  Payload ID: 18768
  Gene Name: tumor protein p73
  Uniprot ID: O15350
  ENSP ID: ENSP00000346423
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVRTWGP

SEQ ID NO: 94083 - protein, 555 aa, Homo sapiens
  Payload ID: 18768
  Gene Name: tumor protein p73
  Uniprot ID: O15350
  ENSP ID: ENSP00000350366
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPPRDAQQPWPRSASQRRDEQQPQRPVHGLGVPLHSATPLPRRPQPRQDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 94084 - protein, 426 aa, Homo sapiens
  Payload ID: 18768
  Gene Name: tumor protein p73
  ENSP ID: ENSP00000367529
MLYVGDPARHLATAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPPRDAQQPWPRSASQRRDEQQPQRPVHGLGVPLHSATPLPRRPQPRQFFNRIGVSKLHRVFHLPRVTEHLPPAEPDH

SEQ ID NO: 94085 - protein, 450 aa, Homo sapiens
  Payload ID: 18768
  Gene Name: tumor protein p73
  Uniprot ID: O15350
  ENSP ID: ENSP00000367534
MLYVGDPARHLATAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVRTWGP

SEQ ID NO: 94086 - protein, 587 aa, Homo sapiens
  Payload ID: 18768
  Gene Name: tumor protein p73
  Uniprot ID: O15350
  ENSP ID: ENSP00000367537
MLYVGDPARHLATAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVSFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 94087 - protein, 565 aa, Homo sapiens
  Payload ID: 18768
  Gene Name: tumor protein p73
  Uniprot ID: O15350
  ENSP ID: ENSP00000367539
MDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVSFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 94088 - protein, 636 aa, Homo sapiens
  Payload ID: 18768
  Gene Name: tumor protein p73
  Uniprot ID: O15350
  ENSP ID: ENSP00000367545
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVSFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 94089 - protein, 540 aa, Homo sapiens; identical to SEQ ID NO: 94081
  Payload ID: 18768
  Gene Name: tumor protein p73
  Uniprot ID: O15350
  ENSP ID: ENSP00000474322

SEQ ID NO: 94090 - protein, 555 aa, Homo sapiens; identical to SEQ ID NO: 94083
  Payload ID: 18768
  Gene Name: tumor protein p73
  Uniprot ID: O15350
  ENSP ID: ENSP00000474626

SEQ ID NO: 94091 - protein, 403 aa, Homo sapiens
  Payload ID: 18768
  Gene Name: tumor protein p73
  Uniprot ID: O15350
  ENSP ID: ENSP00000475143
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPTWGP

SEQ ID NO: 94092 - protein, 188 aa, Homo sapiens
  Payload ID: 18769
  Gene Name: tumor protein, translationally-controlled 1
  ENSP ID: ENSP00000339051
MIIYRDLISHDEMFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKCVSTRKWVKINNVKKTF

SEQ ID NO: 94093 - protein, 138 aa, Homo sapiens
  Payload ID: 18769
  Gene Name: tumor protein, translationally-controlled 1
  Uniprot ID: P13693
  ENSP ID: ENSP00000368344
MVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKC

SEQ ID NO: 94094 - protein, 138 aa, Homo sapiens; identical to SEQ ID NO: 94093
  Payload ID: 18769
  Gene Name: tumor protein, translationally-controlled 1
  Uniprot ID: P13693
  ENSP ID: ENSP00000368345

SEQ ID NO: 94095 - protein, 160 aa, Homo sapiens
  Payload ID: 18769
  Gene Name: tumor protein, translationally-controlled 1
  ENSP ID: ENSP00000368350
MFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKC

SEQ ID NO: 94096 - protein, 172 aa, Homo sapiens
  Payload ID: 18769
  Gene Name: tumor protein, translationally-controlled 1
  Uniprot ID: P13693
  ENSP ID: ENSP00000431872
MIIYRDLISHDEMFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKC

SEQ ID NO: 94097 - protein, 77 aa, Homo sapiens
  Payload ID: 18769
  Gene Name: tumor protein, translationally-controlled 1
  ENSP ID: ENSP00000432457
  MOD_RES (1)..(1): Any amino acid
XIKHILANFKNYQFFIGENMNPDGMVALLDYREDGVTPYMIFFKDGLEMEKCDAKERNPCAFCLSLWRPRLNWGIHL

SEQ ID NO: 94098 - protein, 77 aa, Homo sapiens; identical to SEQ ID NO: 94097
  Payload ID: 18769
  Gene Name: tumor protein, translationally-controlled 1
  ENSP ID: ENSP00000433091
  MOD_RES (1)..(1): Any amino acid

SEQ ID NO: 94099 - protein, 162 aa, Homo sapiens
  Payload ID: 18769
  Gene Name: tumor protein, translationally-controlled 1
  ENSP ID: ENSP00000433738
MGGSVYPADDEMFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFF

SEQ ID NO: 94100 - protein, 197 aa, Homo sapiens
  Payload ID: 18769
  Gene Name: tumor protein, translationally-controlled 1
  ENSP ID: ENSP00000477781
MIIYRDLISHDEMFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKCDAKERNPCAFCLSLWRPRLNWGIHL

SEQ ID NO: 94101 - protein, 387 aa, Homo sapiens
  Payload ID: 18770
  Gene Name: tumor suppressing subtransferable candidate 1
  Uniprot ID: Q53HC9
  ENSP ID: ENSP00000371559
MEDDAPVIYGLEFQARALTPQTAETDAIRFLVGTQSLKYDNQIHIIDFDDENNIINKNVLLHQAGEIWHISASPADRGVLTTCYNRTSDSKVLTCAAVWRMPKELESGSHESPDDSSSTAQTLELLCHLDNTAHGNMACVVWEPMGDGKKIISLADNHILLWDLQESSSQAVLASSASLEGKGQLKFTSGRWSPHHNCTQVATANDTTLRGWDTRSMSQIYCIENAHGQLVRDLDFNPNKQYYLASCGDDCKVKFWDTRNVTEPVKTLEEHSHWVWNVRYNHSHDQLVLTGSSDSRVILSNMVSISSEPFGHLVDDDDISDQEDHRSEEKSKEPLQDNVIATYEEHEDSVYAVDWSSADPWLFASLSYDGRLVINRVPRALKYHILL

SEQ ID NO: 94102 - protein, 414 aa, Homo sapiens
  Payload ID: 18770
  Gene Name: tumor suppressing subtransferable candidate 1
  ENSP ID: ENSP00000381652
MEDDAPVIYGLEFQARALTPQTAETDAIRFLVGTQSLKYDNQIHIIDFDDENNIINKNVLLHQAGEIWHISASPADRGVLTTCYNRTFCCVLSLDSFGALGKSAAQLFIALATSSDSKVLTCAAVWRMPKELESGSHESPDDSSSTAQTLELLCHLDNTAHGNMACVVWEPMGDGKKIISLADNHILLWDLQESSSQAVLASSASLEGKGQLKFTSGRWSPHHNCTQVATANDTTLRGWDTRSMSQIYCIENAHGQLVRDLDFNPNKQYYLASCGDDCKVKFWDTRNVTEPVKTLEEHSHWVWNVRYNHSHDQLVLTGSSDSRVILSNMVSISSEPFGHLVDDDDISDQEDHRSEEKSKEPLQDNVIATYEEHEDSVYAVDWSSADPWLFASLSYDGRLVINRVPRALKYHILL

SEQ ID NO: 94103 - protein, 87 aa, Homo sapiens
  Payload ID: 18770
  Gene Name: tumor suppressing subtransferable candidate 1
  ENSP ID: ENSP00000385756
MEDDAPVIYGLEFQARALTPQTAETDAIRFLVGTQSLKYDNQNKDWKEIGQKGLKIEPRVIFRCFSQGMCSKTTQRMPGNLDPYHRF

SEQ ID NO: 94104 - protein, 314 aa, Homo sapiens
  Payload ID: 18770
  Gene Name: tumor suppressing subtransferable candidate 1
  ENSP ID: ENSP00000389080
MEDDAPVIYGLEFQARALTPQTAETDAIRFLVGTQSLKYDNQIHIIDFDDENNIINKNVLLHQAGEIWHISASPADRGVLTTCYNRTSDSKVLTCAAVWRMPKELESGSHESPDDSSSTAQTLELLCHLDNTAHGNMACVVWEPMGDGKKIISLADNHILLWDLQESSSQAVREESEHSEGACTDPVCAIIPRLEALWGRGTLESGNRDGPRHLHLPRASLTEGGPATSLTQGRRTRHGPHSQKDPPRASRMEEGPAECFLGELGLSYDCKKSAICQAYQNAMAKFIQQTLSELTLERVIRTFPNKWSFLTIFK

SEQ ID NO: 94105 - protein, 58 aa, Homo sapiens
  Payload ID: 18770
  Gene Name: tumor suppressing subtransferable candidate 1
  ENSP ID: ENSP00000389228
MEDDAPVIYGLEFQARALTPQTAETDAIRFLVGTQSLKYDNQCRVGANGRWEENHFLG

SEQ ID NO: 94106 - protein, 178 aa, Homo sapiens
  Payload ID: 18770
  Gene Name: tumor suppressing subtransferable candidate 1
  ENSP ID: ENSP00000393350
MEDDAPVIYGLEFQESSSQAVLASSASLEGKGQLKFTSGRWSPHHNCTQVATANDTTLRGWDTRSMSQIYCIENAHGQLVRDLDFNPNKQYYLASCGDDCKVKFWDTRNVTEPVKTLEEHSHWVWNVRYNHSHDQLVLTGSSDSRVILSNMVSISSEPFGHLVDDDDISDQEDHRSEE

SEQ ID NO: 94107 - protein, 155 aa, Homo sapiens
  Payload ID: 18770
  Gene Name: tumor suppressing subtransferable candidate 1
  ENSP ID: ENSP00000400214
MEDDAPVIYGLEFQARALTPQTAETDAIRFLVGTQSLKYDNQIHIIDFDDENNIINKNVLLHQAGEIWHISASPADRGVLTTCYNRRDIIESFGILPVAQSPTIVFVNTLHQVFFRGQVAASDSKVLTCAAVWRMPKELESGSHESPDDSSSTAQ

SEQ ID NO: 94108 - protein, 132 aa, Homo sapiens
  Payload ID: 18770
  Gene Name: tumor suppressing subtransferable candidate 1
  ENSP ID: ENSP00000403043
MEDDAPVIYGLEFQARALTPQTAETDAIRFLVGTQSLKYDNQIHIIDFDDENNIINKNVLLHQAGEIWHISASPADRGVLTTCYNRMSCGSQWEMGRKSFPWLITISCCGIYRKARARLCWPAQRPWKGRDN

SEQ ID NO: 94109 - protein, 329 aa, Homo sapiens
  Payload ID: 18771
  Gene Name: tumor suppressing subtransferable candidate 4
  Uniprot ID: Q9Y5U2
  ENSP ID: ENSP00000331087
MAEAGTGEPSPSVEGEHGTEYDTLPSDTVSLSDSDSDLSLPGGAEVEALSPMGLPGEEDSGPDEPPSPPSGLLPATVQPFHLRGMSSTFSQRSRDIFDCLEGAARRAPSSVAHTSMSDNGGFKRPLAPSGRSPVEGLGRAHRSPASPRVPPVPDYVAHPERWTKYSLEDVTEVSEQSNQATALAFLGSQSLAAPTDCVSSFNQDPSSCGEGRVIFTKPVRGVEARHERKRVLGKVGEPGRGGLGNPATDRGEGPVELAHLAGPGSPEAEEWGSHHGGLQEVEALSGSVHSGSVPGLPPVETVGFHGSRKRSRDHFRNKSSSPEDPGAEV

SEQ ID NO: 94110 - protein, 127 aa, Homo sapiens
  Payload ID: 18771
  Gene Name: tumor suppressing subtransferable candidate 4
  ENSP ID: ENSP00000370380
MAEAGTGLLPATVQPFHLRGMSSTFSQRSRDIFDCLEGAARRAPSSVAHTSMSDNGGFKRPLAPSGRSPVEGLGRAHRSPASPRVPPVPDYVAHPERWTKYSLEDVTEEAESRPLPEQEQQPRGPRC

SEQ ID NO: 94111 - protein, 265 aa, Homo sapiens
  Payload ID: 18771
  Gene Name: tumor suppressing subtransferable candidate 4
  Uniprot ID: Q9Y5U2
  ENSP ID: ENSP00000370384
MAEAGTGLLPATVQPFHLRGMSSTFSQRSRDIFDCLEGAARRAPSSVAHTSMSDNGGFKRPLAPSGRSPVEGLGRAHRSPASPRVPPVPDYVAHPERWTKYSLEDVTEVSEQSNQATALAFLGSQSLAAPTDCVSSFNQDPSSCGEGRVIFTKPVRGVEARHERKRVLGKVGEPGRGGLGNPATDRGEGPVELAHLAGPGSPEAEEWGSHHGGLQEVEALSGSVHSGSVPGLPPVETVGFHGSRKRSRDHFRNKSSSPEDPGAEV

SEQ ID NO: 94112 - protein, 203 aa, Homo sapiens
  Payload ID: 18771
  Gene Name: tumor suppressing subtransferable candidate 4
  ENSP ID: ENSP00000396925
MAEAGTGEPSPSVEGEHGTEYDTLPSDTVSLSDSDSDLSLPGGAEVEALSPMGLPGEEDSGPDEPPSPPSGLLPATVQPFHLRGMSSTFSQRSRDIFDCLEGAARRAPSSVAHTSMSDNGGFKRPLAPSGRSPVEGLGRAHRSPASPRVPPVPDYVAHPERWTKYSLEDVTEVSEQSNQATALAFLGSQSLAAPTDCVSSFNQ

SEQ ID NO: 94113 - protein, 112 aa, Homo sapiens
  Payload ID: 18771
  Gene Name: tumor suppressing subtransferable candidate 4
  ENSP ID: ENSP00000403475
MAEAGTGEPSPSVEGEHGTEYDTLPSDTVSLSDSDSDLSLPGGAEVEALSPMGLPGEEDSGPDEPPSPPSGLLPATVQPFHLRGMSSTFSQRSRDIFDCLEGAARRAPSSVA

SEQ ID NO: 94114 - protein, 329 aa, Homo sapiens; identical to SEQ ID NO: 94109
  Payload ID: 18771
  Gene Name: tumor suppressing subtransferable candidate 4
  Uniprot ID: Q9Y5U2
  ENSP ID: ENSP00000411224

SEQ ID NO: 94115 - protein, 207 aa, Homo sapiens
  Payload ID: 18771
  Gene Name: tumor suppressing subtransferable candidate 4
  ENSP ID: ENSP00000416937
MAEAGTGLLPATVQPFHLRGMSSTFSQRSRDIFDCLEGAARRAPSSVAHTSMSDNGGFKRPLAPSGRSPVEGLGRAHRSPASPRVPPVPDYVAHPERWTKYSLEDVTEVSEQSNQATALAFLGSQSLAAPTDCVSSFNQDPSSCGEGRVIFTKPVRGVEARHERKRVLGKVGEPGRGGLGNPATDRGEGPVELAHLAGPGSPEAEEW

SEQ ID NO: 94116 - protein, 110 aa, Homo sapiens
  Payload ID: 18771
  Gene Name: tumor suppressing subtransferable candidate 4
  ENSP ID: ENSP00000431430
MAEAGTGEPSPSVEGEHGTEYDTLPSDTVSLSDSDSDLSLPGGAEVEALSPMGLPGEEDSGPDEPPSPPSGLLPATVQPFHLRGMSSTFSQRSRDIFDCLEGAARRAPSS

SEQ ID NO: 94117 - protein, 191 aa, Homo sapiens
  Payload ID: 18771
  Gene Name: tumor suppressing subtransferable candidate 4
  ENSP ID: ENSP00000435013
MAEAGTGEPSPSVEGEHGTEYDTLPSDTVSLSDSDSDLSLPGGAEVEALSPMGLPGEEDSGPDEPPSPPSGLLPATVQPFHLRGMSSTFSQRSRDIFDCLEGAARRAPSSVAHTSMSDNGGFKRPLAPSGRSPVEGLGRAHRSPASPRVPPVPDYVAHPERWTKYSLEDVTEVSEQSNQATALAFLGSQSL

SEQ ID NO: 94118 - protein, 212 aa, Homo sapiens
  Payload ID: 18772
  Gene Name: tumor suppressor candidate 1
  Uniprot ID: Q2TAM9
  ENSP ID: ENSP00000350716
MGPMWRMRGGATRRGSCCGGDGAADGRGPGRSGRARGGGSPSGGGGGVGWRGRADGARQQLEERFADLAASHLEAIRARDEWDRQNARLRQENARLRLENRRLKRENRSLFRQALRLPGEGGNGTPAEARRVPEEASTNRRARDSGREDEPGSPRALRARLEKLEAMYRRALLQLHLEQRGPRPSGDKEEQPLQEPDSGLRSRDSEPSGPWL

SEQ ID NO: 94119 - protein, 110 aa, Homo sapiens
  Payload ID: 18773
  Gene Name: tumor suppressor candidate 2
  Uniprot ID: O75896
  ENSP ID: ENSP00000232496
MGASGSKARGLWPFASAAGGGGSEAAGAEQALVRPRGRAVPPFVFTRRGSMFYDEDGDLAHEFYEETIVTKNGQKRAKLRRVHKNLIPQGIVKLDHPRIHVDFPVILYEV

SEQ ID NO: 94120 - protein, 57 aa, Homo sapiens
  Payload ID: 18773
  Gene Name: tumor suppressor candidate 2
  ENSP ID: ENSP00000394844
MGASGSKARGLWPFASAAGGGGSEAAGAEQALVRPRGRAVPPFVFTRRGLGFCYFSL

SEQ ID NO: 94121 - protein, 65 aa, Homo sapiens
  Payload ID: 18773
  Gene Name: tumor suppressor candidate 2
  ENSP ID: ENSP00000399199
MGASGSKARGLWPFASAAGGGGSEAAGAEQALVRPRGRAVPPFVFTRRGLLLFQSLTLGQQHLLE

SEQ ID NO: 94122 - protein, 65 aa, Homo sapiens; identical to SEQ ID NO: 94121
  Payload ID: 18773
  Gene Name: tumor suppressor candidate 2
  ENSP ID: ENSP00000409488

SEQ ID NO: 94123 - protein, 347 aa, Homo sapiens
  Payload ID: 18774
  Gene Name: tumor suppressor candidate 3
  Uniprot ID: Q13454
  ENSP ID: ENSP00000371450
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSFLIK

SEQ ID NO: 94124 - protein, 276 aa, Homo sapiens
  Payload ID: 18774
  Gene Name: tumor suppressor candidate 3
  ENSP ID: ENSP00000420829
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVMPLSPWGWFF

SEQ ID NO: 94125 - protein, 289 aa, Homo sapiens
  Payload ID: 18774
  Gene Name: tumor suppressor candidate 3
  ENSP ID: ENSP00000423426
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLTS

SEQ ID NO: 94126 - protein, 348 aa, Homo sapiens
  Payload ID: 18774
  Gene Name: tumor suppressor candidate 3
  Uniprot ID: Q13454
  ENSP ID: ENSP00000424544
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSDLDFE

SEQ ID NO: 94127 - protein, 314 aa, Homo sapiens
  Payload ID: 18774
  Gene Name: tumor suppressor candidate 3
  ENSP ID: ENSP00000425777
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRTF

SEQ ID NO: 94128 - protein, 302 aa, Homo sapiens
  Payload ID: 18774
  Gene Name: tumor suppressor candidate 3
  ENSP ID: ENSP00000426880
NLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSDLDFE

SEQ ID NO: 94129 - protein, 276 aa, Homo sapiens; identical to SEQ ID NO: 94124
  Payload ID: 18774
  Gene Name: tumor suppressor candidate 3
  ENSP ID: ENSP00000426973

SEQ ID NO: 94130 - protein, 177 aa, Homo sapiens
  Payload ID: 18775
  Gene Name: tumor suppressor candidate 5
  Uniprot ID: Q8IXB3
  ENSP ID: ENSP00000329548
MAHPVQSEFPSAQEPGSAAFLDLPEMEILLTKAENKDDKTLNLSKTLSGPLDLEQNSQGLPFKAISEGHLEAPLPRSPSRASSRRASSIATTSYAQDQEAPRDYLILAVVACFCPVWPLNLIPLIISIMSRSSMQQGNVDGARRLGRLARLLSITLIIMGIVIIMVAVTVNFTVQKK

SEQ ID NO: 94131 - protein, 4 aa, Homo sapiens
  Payload ID: 18775
  Gene Name: tumor suppressor candidate 5
  ENSP ID: ENSP00000486005
  MOD_RES (1)..(1): Any amino acid
XQKK

SEQ ID NO: 94132 - protein, 390 aa, Homo sapiens
  Payload ID: 18776
  Gene Name: tumor susceptibility 101
  Uniprot ID: Q99816
  ENSP ID: ENSP00000251968
MAVSESQLKKMVSKYKYRDLTVRETVNVITLYKDLKPVLDSYVFNDGSSRELMNLTGTIPVPYRGNTYNIPICLWLLDTYPYNPPICFVKPTSSMTIKTGKHVDANGKIYLPYLHEWKHPQSDLLGLIQVMIVVFGDEPPVFSRPISASYPPYQATGPPNTSYMPGMPGGISPYPSGYPPNPSGYPGCPYPPGGPYPATTSSQYPSQPPVTTVGPSRDGTISEDTIRASLISAVSDKLRWRMKEEMDRAQAELNALKRTEEDLKKGHQKLEEMVTRLDQEVAEVDKNIELLKKKDEELSSALEKMENQSENNDIDEVIIPTAPLYKQILNLYAEENAIEDTIFYLGEALRRGVIDLDVFLKHVRLLSRKQFQLRALMQKARKTAGLSDLY

SEQ ID NO: 94133 - protein, 365 aa, Homo sapiens
  Payload ID: 18776
  Gene Name: tumor susceptibility 101
  ENSP ID: ENSP00000438471
MAVSESQLKKMVSKYKYRDLTVRETVNVITLYKDLKPVLDSYVFNDGSSRELMNLTGTIPVPYRGNTYNIPICLWLLDTYPYNPPICFVKPTSSMTIKTGKHVDANGKIYLPYLHEWKHPQSDLLGLIQVMIVVFGDEPPVFSRPISASYPPYQATGPPNTSYMPGMPGGISPYPSGYPPNPSGYPGCPYPPGGPYPATTSSQYPSQPPVTTVGPSRDGTISEDTIRASLISAVSDKLRWRMKEEMDRAQAELNALKRTEEDLKKGHQKLEEMVTRLDQEVAEVDKNIELLKKKDEELSSALEKMENQSENNDIDEVIIPTAPLYKQILNLYAEENAIEDTIFYLGEALRRGVIDLDVFLKTSVP

SEQ ID NO: 94134 - protein, 77 aa, Homo sapiens
  Payload ID: 18776
  Gene Name: tumor susceptibility 101
  ENSP ID: ENSP00000463213
  MOD_RES (1)..(1): Any amino acid
XDEVIIPTAPLYKQILNLYAEENAIEDTIFYLGEALRRGVIDLDVFLKHVRLLSRKQFQLRALMQKARKTAGLSDLY

SEQ ID NO: 94135 - protein, 63 aa, Homo sapiens
  Payload ID: 18776
  Gene Name: tumor susceptibility 101
  ENSP ID: ENSP00000464386
ILNLYAEENAIEDTIFYLGEALRRGVIDLDVFLKHVRLLSRKQFQLRALMQKARKTAGLSDLY

SEQ ID NO: 94136 - protein, 323 aa, Homo sapiens
  Payload ID: 18777
  Gene Name: tumor-associated calcium signal transducer 2
  Uniprot ID: P09758
  ENSP ID: ENSP00000360269
MARGPGLAPPPLRLPLLLLVLAAVTGHTAAQDNCTCPTNKMTVCSPDGPGGRCQCRALGSGMAVDCSTLTSKCLLLKARMSAPKNARTLVRPSEHALVDNDGLYDPDCDPEGRFKARQCNQTSVCWCVNSVGVRRTDKGDLSLRCDELVRTHHILIDLRHRPTAGAFNHSDLDAELRRLFRERYRLHPKFVAAVHYEQPTIQIELRQNTSQKAAGDVDIGDAAYYFERDIKGESLFQGRGGLDLRVRGEPLQVERTLIYYLDEIPPKFSMKRLTAGLIAVIVVVVVALVAGMAVLVITNRRKSGKYKKVEIKELGELRKEPSL

SEQ ID NO: 94137 - protein, 37 aa, Homo sapiens; identical to SEQ ID NO: 90263
  Payload ID: 18778
  Gene Name: TVP23C-CDRT4 readthrough
  ENSP ID: ENSP00000423249

SEQ ID NO: 94138 - protein, 164 aa, Homo sapiens
  Payload ID: 18778
  Gene Name: TVP23C-CDRT4 readthrough
  ENSP ID: ENSP00000429865
MLQQDSNDDTEDVSLFDAEEETTNRPRKAKIRHPVASFFHLFFRVSAIIVCLLCELLSSSFITCMVTIILLLSCDFWAVKNVTGRLMVGLRWWNHIDEDGKSHWVFESRKESSQENKTVSEAESRIFWLGLIACSVLWVIFAFSALFSFTVKWLESEPVMLRNQ

SEQ ID NO: 94139 - protein, 53 aa, Homo sapiens; identical to SEQ ID NO: 90273
  Payload ID: 18778
  Gene Name: TVP23C-CDRT4 readthrough
  ENSP ID: ENSP00000430143

SEQ ID NO: 94140 - protein, 37 aa, Homo sapiens; identical to SEQ ID NO: 90263
  Payload ID: 18778
  Gene Name: TVP23C-CDRT4 readthrough
  ENSP ID: ENSP00000450826

SEQ ID NO: 94141 - protein, 451 aa, Homo sapiens
  Payload ID: 18779
  Gene Name: tweety family member 1
  Uniprot ID: Q9H313
  ENSP ID: ENSP00000301194
MGAPPGYRPSAWVHLLHQLPRADFQLRPVPSVFAPQEQEYQQALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPSDDYDDTDDDDPFNPQQESKRFVQWQSSI

SEQ ID NO: 94142 - protein, 450 aa, Homo sapiens
  Payload ID: 18779
  Gene Name: tweety family member 1
  Uniprot ID: Q9H313
  ENSP ID: ENSP00000365713
MGAPPGYRPSAWVHLLHQLPRADFQLRPVPSVFAPQEQEYQQALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPSDDYDDTDDDDPFNPQESKRFVQWQSSI

SEQ ID NO: 94143 - protein, 460 aa, Homo sapiens
  Payload ID: 18779
  Gene Name: tweety family member 1
  Uniprot ID: Q9H313
  ENSP ID: ENSP00000365714
MGAPPGYRPSAWVHLLHQLPRADFQLRPVPSVFAPQEQEYQQALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPRNPSALCSGSRLSEPLLPAGLEPGSPLRSFPGCRRRPH

SEQ ID NO: 94144 - protein, 38 aa, Homo sapiens
  Payload ID: 18779
  Gene Name: tweety family member 1
  ENSP ID: ENSP00000375619
  MOD_RES (1)..(1): Any amino acid
XLIRFCCCRPPEPPGSKIPSPGGGCVTWSCIVALLAGW

SEQ ID NO: 94145 - protein, 157 aa, Homo sapiens
  Payload ID: 18779
  Gene Name: tweety family member 1
  ENSP ID: ENSP00000391282
MPPTPAARYLRGQQLPRADFQLRPVPSVFAPQEQEYQQALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEV

SEQ ID NO: 94146 - protein, 280 aa, Homo sapiens
  Payload ID: 18779
  Gene Name: tweety family member 1
  ENSP ID: ENSP00000393592
MGAPPGYRPSAWVHLLHQLPRADFQLRPVPSVFAPQEQEYQQDQSSLAVTQRPPPTTPLHRLRPRPRLTPALARRPPEAARGDPRPQSPPEALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFT

SEQ ID NO: 94147 - protein, 113 aa, Homo sapiens
  Payload ID: 18779
  Gene Name: tweety family member 1
  ENSP ID: ENSP00000402817
MGAPPGYRPSAWVHLLHQLPRADFQLRPVPSVFAPQEQEYQQALLLVAALAGLGLGLSLIFIAVYLIRFCCCRPPEPPGSKIPSPGGGCVTWSCIVALLAGWCWRRWRGWARR

SEQ ID NO: 94148 - protein, 451 aa, Homo sapiens; identical to SEQ ID NO: 94141
  Payload ID: 18779
  Gene Name: tweety family member 1
  Uniprot ID: Q9H313
  ENSP ID: ENSP00000479779

SEQ ID NO: 94149 - protein, 451 aa, Homo sapiens; identical to SEQ ID NO: 94141
  Payload ID: 18779
  Gene Name: tweety family member 1
  Uniprot ID: Q9H313
  ENSP ID: ENSP00000480177

SEQ ID NO: 94150 - protein, 450 aa, Homo sapiens; identical to SEQ ID NO: 94142
  Payload ID: 18779
  Gene Name: tweety family member 1
  Uniprot ID: Q9H313
  ENSP ID: ENSP00000480769

SEQ ID NO: 94151 - protein, 450 aa, Homo sapiens; identical to SEQ ID NO: 94142
  Payload ID: 18779
  Gene Name: tweety family member 1
  Uniprot ID: Q9H313
  ENSP ID: ENSP00000481138

SEQ ID NO: 94152 - protein, 105 aa, Homo sapiens
  Payload ID: 18779
  Gene Name: tweety family member 1
  ENSP ID: ENSP00000481274
MGAPPGYRPSAWVHLLHQLPRADFQLRPVPSVFAPQEQEYQQVGPASRLHNGHLQQRRSTGSGLGPDSRPLWPGDLPKPHAGIRGPSHRQRPCCWWRPWRAWAWA

SEQ ID NO: 94153 - protein, 451 aa, Homo sapiens; identical to SEQ ID NO: 94141
  Payload ID: 18779
  Gene Name: tweety family member 1
  Uniprot ID: Q9H313
  ENSP ID: ENSP00000481601

SEQ ID NO: 94154 - protein, 46 aa, Homo sapiens
  Payload ID: 18779
  Gene Name: tweety family member 1
  ENSP ID: ENSP00000482140
MGAPPGYRPSAWVHLLHQLPRADFQLRPVPSVFAPQEQEYQQDQSR

SEQ ID NO: 94155 - protein, 239 aa, Homo sapiens
  Payload ID: 18779
  Gene Name: tweety family member 1
  Uniprot ID: Q9H313
  ENSP ID: ENSP00000482372
MWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPSDDYDDTDDDDPFNPQQESKRFVQWQSSI

SEQ ID NO: 94156 - protein, 320 aa, Homo sapiens
  Payload ID: 18779
  Gene Name: tweety family member 1
  Uniprot ID: Q9H313
  ENSP ID: ENSP00000483288
MEKVRLWRGSESRAAICTGIGIGFYGNSETSDGVSQLSSALLHANHTLSTIDHLTVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKVKPLPSQFLLPRGASVSTHRTTSSFSLDPCHCA

SEQ ID NO: 94157 - protein, 323 aa, Homo sapiens
  Payload ID: 18779
  Gene Name: tweety family member 1
  ENSP ID: ENSP00000483823
MEKVRLWRGSESRAAICTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKVKPLPSQFLLPRGASVWTHRTTSSFSLDPCHCA

SEQ ID NO: 94158 - protein, 239 aa, Homo sapiens; identical to SEQ ID NO: 94155
  Payload ID: 18779
  Gene Name: tweety family member 1
  Uniprot ID: Q9H313
  ENSP ID: ENSP00000484077

SEQ ID NO: 94159 - protein, 460 aa, Homo sapiens; identical to SEQ ID NO: 94143
  Payload ID: 18779
  Gene Name: tweety family member 1
  Uniprot ID: Q9H313
  ENSP ID: ENSP00000484548

SEQ ID NO: 94160 - protein, 450 aa, Homo sapiens; identical to SEQ ID NO: 94142
  Payload ID: 18779
  Gene Name: tweety family member 1
  Uniprot ID: Q9H313
  ENSP ID: ENSP00000484774

SEQ ID NO: 94161 - protein, 460 aa, Homo sapiens; identical to SEQ ID NO: 94143
  Payload ID: 18779
  Gene Name: tweety family member 1
  Uniprot ID: Q9H313
  ENSP ID: ENSP00000484835

SEQ ID NO: 94162 - protein, 460 aa, Homo sapiens; identical to SEQ ID NO: 94143
  Payload ID: 18779
  Gene Name: tweety family member 1
  Uniprot ID: Q9H313
  ENSP ID: ENSP00000484881

SEQ ID NO: 94163 - protein, 534 aa, Homo sapiens
  Payload ID: 18780
  Gene Name: tweety family member 2
  Uniprot ID: Q9BSA4
  ENSP ID: ENSP00000269346
MQAARVDYIAPWWVVWLHSVPHVGLRLQPVNSTFSPGDESYQESLLFLGLVAAVCLGLNLIFLVAYLVCACHCRRDDAVQTKQHHSCCITWTAVVAGLICCAAVGVGFYGNSETNDGAYQLMYSLDDANHTFSGIDALVSGTTQKMKVDLEQHLARLSEIFAARGDYLQTLKFIQQMAGSVVVQLSGLPVWREVTMELTKLSDQTGYVEYYRWLSYLLLFILDLVICLIACLGLAKRSKCLLASMLCCGALSLLLSWASLAADGSAAVATSDFCVAPDTFILNVTEGQISTEVTRYYLYCSQSGSSPFQQTLTTFQRALTTMQIQVAGLLQFAVPLFSTAEEDLLAIQLLLNSSESSLHQLTAMVDCRGLHKDYLDALAGICYDGLQGLLYLGLFSFLAALAFSTMICAGPRAWKHFTTRNRDYDDIDDDDPFNPQAWRMAAHSPPRGQLHSFCSYSSGLGSQTSLQPPAQTISNAPVSEYMNQAMLFGRNPRYENVPLIGRASPPPTYSPSMRATYLSVADEHLRHYGNQFPA

SEQ ID NO: 94164 - protein, 213 aa, Homo sapiens
  Payload ID: 18780
  Gene Name: tweety family member 2
  Uniprot ID: Q9BSA4
  ENSP ID: ENSP00000394576
MQIQVAGLLQFAVPLFSTAEEDLLAIQLLLNSSESSLHQLTAMVDCRGLHKDYLDALAGICYDGLQGLLYLGLFSFLAALAFSTMICAGPRAWKHFTTRNRDYDDIDDDDPFNPQAWRMAAHSPPRGQLHSFCSYSSGLGSQTSLQPPAQTISNAPVSEYMNQAMLFGRNPRYENVPLIGRASPPPTYSPSMRATYLSVADEHLRHYGNQFPA

SEQ ID NO: 94165 - protein, 513 aa, Homo sapiens
  Payload ID: 18780
  Gene Name: tweety family member 2
  ENSP ID: ENSP00000433089
MSVVGQDRKSGSGCYLRWLLFLSLLFLGLVAAVCLGLNLIFLVAYLVCACHCRRDDAVQTKQHHSCCITWTAVVAGLICCAAVGVGFYGNSETNDGAYQLMYSLDDANHTFSGIDALVSGTTQKMKVDLEQHLARLSEIFAARGDYLQTLKFIQQMAGSVVVQLSGLPVWREVTMELTKLSDQTGYVEYYRWLSYLLLFILDLVICLIACLGLAKRSKCLLASMLCCGALSLLLSWASLAADGSAAVATSDFCVAPDTFILNVTEGQISTEVTRYYLYCSQSGSSPFQQTLTTFQRALTTMQIQVAGLLQFAVPLFSTAEEDLLAIQLLLNSSESSLHQLTAMVDCRGLHKDYLDALAGICYDGLQGLLYLGLFSFLAALAFSTMICAGPRAWKHFTTRNRDYDDIDDDDPFNPQAWRMAAHSPPRGQLHSFCSYSSGLGSQTSLQPPAQTISNAPVSEYMNQAMLFGRNPRYENVPLIGRASPPPTYSPSMRATYLSVADEHLRHYGNQFPA

SEQ ID NO: 94166 - protein, 138 aa, Homo sapiens
  Payload ID: 18780
  Gene Name: tweety family member 2
  ENSP ID: ENSP00000462219
  MOD_RES (1)..(1): Any amino acid
XWLSYLLLFILDLVICLIACLGLAKRSKCLLASMLCCGALSLLLSWASLAADGSAAVATSDFCVAPDTFILNVTEGQISTEVTRYYLYCSQSGSSPFQQTLTTFQRALTTMQIQVAGLLQFAVPLFSTAETCLQSSSC

SEQ ID NO: 94167 - protein, 137 aa, Homo sapiens
  Payload ID: 18780
  Gene Name: tweety family member 2
  ENSP ID: ENSP00000462492
ALTTMQIQVAGLLQFAVPLFSTAEEDLLAIQLLLNSSESSLHQLTAMVDCRGLHKAKPVPFAPSSQGVLLLAILASASVPPSLVPHPATSSALFRASFLVPSSQIIWTLLLASATTASRACCTLASSPSWPPSPSPP

SEQ ID NO: 94168 - protein, 523 aa, Homo sapiens
  Payload ID: 18781
  Gene Name: tweety family member 3
  Uniprot ID: Q9C0H2
  ENSP ID: ENSP00000258796
MAGVSYAAPWWVSLLHRLPHFDLSWEATSSQFRPEDTDYQQALLLLGAAALACLALDLLFLLFYSFWLCCRRRKSEEHLDADCCCTAWCVIIATLVCSAGIAVGFYGNGETSDGIHRATYSLRHANRTVAGVQDRVWDTAVGLNHTAEPSLQTLERQLAGRPEPLRAVQRLQGLLETLLGYTAAIPFWRNTAVSLEVLAEQVDLYDWYRWLGYLGLLLLDVIICLLVLVGLIRSSKGILVGVCLLGVLALVISWGALGLELAVSVGSSDFCVDPDAYVTKMVEEYSVLSGDILQYYLACSPRAANPFQQKLSGSHKALVEMQDVVAELLRTVPWEQPATKDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSYTSSMRAKYLATSQPRPDSSGSH

SEQ ID NO: 94169 - protein, 116 aa, Homo sapiens
  Payload ID: 18781
  Gene Name: tweety family member 3
  ENSP ID: ENSP00000383227
MGPLPCSPLRNTFMVSKRGFSPPQAPNFPTRPENLRTTAGVGDPARTQALLLLGAAALACLALDLLFLLFYSFWLCCRRRKSEEHLDADCCCTAWCVIIATLVCSAGIAVGFYGNG

SEQ ID NO: 94170 - protein, 352 aa, Homo sapiens
  Payload ID: 18781
  Gene Name: tweety family member 3
  Uniprot ID: Q9C0H2
  ENSP ID: ENSP00000385015
MPSGVPGCWPQLPLKGPWRPTPRPRVPVPWRTPRFACRWLGYLGLLLLDVIICLLVLVGLIRSSKGILVGVCLLGVLALVISWGALGLELAVSVGSSDFCVDPDAYVTKMVEEYSVLSGDILQYYLACSPRAANPFQQKLSGSHKALVEMQDVVAELLRTVPWEQPATKDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSYTSSMRAKYLATSQPRPDSSGSH

SEQ ID NO: 94171 - protein, 491 aa, Homo sapiens
  Payload ID: 18781
  Gene Name: tweety family member 3
  Uniprot ID: Q9C0H2
  ENSP ID: ENSP00000385316
MAGVSYAAPWWVSLLHRLPHFDLSWEATSSQFRPEDTDYQQALLLLGAAALACLALDLLFLLFYSFWLCCRRRKSEEHLDADCCCTAWCVIIATLVCSAGIAVGFYGNGETSDGIHRATYSLRHANRTVAGVQDRVWDTAVGLNHTAEPSLQTLERQLAGRPEPLRAVQRLQGLLETLLGYTAAIPFWRNTAVSLEVLAEQVDLYDWYRVCLLGVLALVISWGALGLELAVSVGSSDFCVDPDAYVTKMVEEYSVLSGDILQYYLACSPRAANPFQQKLSGSHKALVEMQDVVAELLRTVPWEQPATKDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSYTSSMRAKYLATSQPRPDSSGSH

SEQ ID NO: 94172 - protein, 186 aa, Homo sapiens
  Payload ID: 18781
  Gene Name: tweety family member 3
  ENSP ID: ENSP00000413757
DPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSRYLAALDSGSHAGWQFKPMDSARTLW

SEQ ID NO: 94173 - protein, 350 aa, Homo sapiens
  Payload ID: 18782
  Gene Name: twinfilin actin binding protein 1
  Uniprot ID: Q12792
  ENSP ID: ENSP00000378886
MSHQTGIQASEDVKEIFARARNGKYRLLKISIENEQLVIGSYSQPSDSWDKDYDSFVLPLLEDKQPCYILFRLDSQNAQGYEWIFIAWSPDHSHVRQKMLYAATRATLKKEFGGGHIKDEVFGTVKEDVSLHGYKKYLLSQSSPAPLTAAEEELRQIKINEVQTDVGVDTKHQTLQGVAFPISREAFQALEKLNNRQLNYVQLEIDIKNEIIILANTTNTELKDLPKRIPKDSARYHFFLYKHSHEGDYLESIVFIYSMPGYTCSIRERMLYSSCKSRLLEIVERQLQMDVIRKIEIDNGDELTADFLYEEVHPKQHAHKQSFAKPKGPAGKRGIRRLIRGPAETEATTD

SEQ ID NO: 94174 - protein, 119 aa, Homo sapiens
  Payload ID: 18782
  Gene Name: twinfilin actin binding protein 1
  ENSP ID: ENSP00000446665
MSHQTGIQGNSARRDSQGRGFRESRESREGCRTGRAGVGPGAPEVGLAGRAGPRRLSALLLPGRCRPASSSSPVPAAVTLQIDPKFGGAKEIGFRGGLVEGGVPSTVPDSRPTFPLLVT

SEQ ID NO: 94175 - protein, 113 aa, Homo sapiens
  Payload ID: 18782
  Gene Name: twinfilin actin binding protein 1
  ENSP ID: ENSP00000446696
MSHQTGIQEQLVIGSYSQPSDSWDKDYDSFVLPLLEDKQPCYILFRLDSQNAQGYEWIFIAWSPDHSHVRQKMLYAATRATLKKEFGGGHIKDEVFGTVKEDVSLHGYKKYLL

SEQ ID NO: 94176 - protein, 291 aa, Homo sapiens
  Payload ID: 18782
  Gene Name: twinfilin actin binding protein 1
  ENSP ID: ENSP00000448221
MSHQTGIQDTPQGKLICMVACNACRQFNMQLYLTSIISWFEIGQPAASEDVKEIFARARNGKYRLLKISIENEQLVIGSYSQPSDSWDKDYDSFVLPLLEDKQPCYILFRLDSQNAQGYEWIFIAWSPDHSHVRQKMLYAATRATLKKEFGGGHIKDEVFGTVKEDVSLHGYKKYLLSQSSPAPLTAAEEELRQIKINEVQTDVGVDTKHQTLQGVAFPISREAFQALEKLNNRQLNYVQLEIDIKNEIIILANTTNTELKDLPKRIPKDSARYHFFLYKHSHEGDYLESI

SEQ ID NO: 94177 - protein, 15 aa, Homo sapiens
  Payload ID: 18782
  Gene Name: twinfilin actin binding protein 1
  ENSP ID: ENSP00000448230
MLYAATRATLKKEFG

SEQ ID NO: 94178 - protein, 59 aa, Homo sapiens
  Payload ID: 18782
  Gene Name: twinfilin actin binding protein 1
  ENSP ID: ENSP00000448682
MSHQTGIQASEDVKEIFARARNGKYRLLKISIENVSAPQSISNVSASISGMEITKQSNL

SEQ ID NO: 94179 - protein, 252 aa, Homo sapiens
  Payload ID: 18782
  Gene Name: twinfilin actin binding protein 1
  Uniprot ID: Q12792
  ENSP ID: ENSP00000448750
MLYAATRATLKKEFGGGHIKDEVFGTVKEDVSLHGYKKYLLSQSSPAPLTAAEEELRQIKINEVQTDVGVDTKHQTLQGVAFPISREAFQALEKLNNRQLNYVQLEIDIKNEIIILANTTNTELKDLPKRIPKDSARYHFFLYKHSHEGDYLESIVFIYSMPGYTCSIRERMLYSSCKSRLLEIVERQLQMDVIRKIEIDNGDELTADFLYEEVHPKQHAHKQSFAKPKGPAGKRGIRRLIRGPAETEATTD

SEQ ID NO: 94180 - protein, 357 aa, Homo sapiens
  Payload ID: 18782
  Gene Name: twinfilin actin binding protein 1
  Uniprot ID: Q12792
  ENSP ID: ENSP00000449428
MSHQTGIQASEDVKEIFARARNGKYRLLKISIENEQLVIGSYSQPSDSWDKDYDSFVLPLLEDKQPCYILFRLDSQNAQGYEWIFIAWSPDHSHVRQKMLYAATRATLKKEFGGGHIKDEVFGTVKEDVSLHGYKKYLLSQSSPAPLTAAEEELRQIKINESPEDHIGVQTDVGVDTKHQTLQGVAFPISREAFQALEKLNNRQLNYVQLEIDIKNEIIILANTTNTELKDLPKRIPKDSARYHFFLYKHSHEGDYLESIVFIYSMPGYTCSIRERMLYSSCKSRLLEIVERQLQMDVIRKIEIDNGDELTADFLYEEVHPKQHAHKQSFAKPKGPAGKRGIRRLIRGPAETEATTD

SEQ ID NO: 94181 - protein, 349 aa, Homo sapiens
  Payload ID: 18783
  Gene Name: twinfilin actin binding protein 2
  Uniprot ID: Q6IBS0
  ENSP ID: ENSP00000303908
MAHQTGIHATEELKEFFAKARAGSVRLIKVVIEDEQLVLGASQEPVGRWDQDYDRAVLPLLDAQQPCYLLYRLDSQNAQGFEWLFLAWSPDNSPVRLKMLYAATRATVKKEFGGGHIKDELFGTVKDDLSFAGYQKHLSSCAAPAPLTSAERELQQIRINEVKTEISVESKHQTLQGLAFPLQPEAQRALQQLKQKMVNYIQMKLDLERETIELVHTEPTDVAQLPSRVPRDAARYHFFLYKHTHEGDPLESVVFIYSMPGYKCSIKERMLYSSCKSRLLDSVEQDFHLEIAKKIEIGDGAELTAEFLYDEVHPKQHAFKQAFAKPKGPGGKRGHKRLIRGPGENGDDS

SEQ ID NO: 94182 - protein, 254 aa, Homo sapiens
  Payload ID: 18783
  Gene Name: twinfilin actin binding protein 2
  ENSP ID: ENSP00000426464
MAHQTGIHATEELKEFFAKARAGSVRLIKVVIEDEQLVLGASQEPVGRWDQDYDRAVLPLLDAQQPCYLLYRLDSQNAQGFEWLFLAWSPDNSPVRLKMLYAATRATVKKEFGGGHIKDELFGTVKDDLSFAGYQKHLSSCAAPAPLTSAERELQQIRINEVKTEISVESKHQTLQGLAFPLQPEAQRALQQLKQKMVNYIQMKLDLERETIELVHTEPTDVAQLPSRVPRDAARYHFFLYKHTHEGDPLESVD

SEQ ID NO: 94183 - protein, 202 aa, Homo sapiens
  Payload ID: 18784
  Gene Name: twist family bHLH transcription factor 1
  Uniprot ID: Q15672
  ENSP ID: ENSP00000242261
MMQDVSSSPVSPADDSLSNSEEEPDRQQPPSGKRGGRKRRSSRRSAGGGAGPGGAAGGGVGGGDEPGSPAQGKRGKKSAGCGGGGGAGGGGGSSSGGGSPQSYEELQTQRVMANVRERQRTQSLNEAFAALRKIIPTLPSDKLSKIQTLKLAARYIDFLYQVLQSDELDSKMASCSYVAHERLSYAFSVWRMEGAWSMSASH

SEQ ID NO: 94184 - protein, 135 aa, Homo sapiens
  Payload ID: 18784
  Gene Name: twist family bHLH transcription factor 1
  ENSP ID: ENSP00000346582
  MOD_RES (1)..(1): Any amino acid
XPAQGKRGKKSAGCGGGGGAGGGGGSSSGGGSPQSYEELQTQRVMANVRERQRTQSLNEAFAALRKIIPTLPSDKLSKIQTLKLAARYIDFLYQVLQSDELDSKMASCSYVAHERLSYAFSVWRMEGAWSMSASH

SEQ ID NO: 94185 - protein, 70 aa, Homo sapiens
  Payload ID: 18784
  Gene Name: twist family bHLH transcription factor 1
  ENSP ID: ENSP00000416986
  MOD_RES (1)..(1): Any amino acid
XIIPTLPSDKLSKIQTLKLAARYIDFLYQVLQSDELDSKMASCSYVAHERLSYAFSVWRMEGAWSMSASH

SEQ ID NO: 94186 - protein, 160 aa, Homo sapiens
  Payload ID: 18785
  Gene Name: twist family bHLH transcription factor 2
  Uniprot ID: Q8WVJ9
  ENSP ID: ENSP00000405176
MEEGSSSPVSPVDSLGTSEEELERQPKRFGRKRRYSKKSSEDGSPTPGKRGKKGSPSAQSFEELQSQRILANVRERQRTQSLNEAFAALRKIIPTLPSDKLSKIQTLKLAARYIDFLYQVLQSDEMDNKMTSCSYVAHERLSYAFSVWRMEGAWSMSASH

SEQ ID NO: 94187 - protein, 160 aa, Homo sapiens; identical to SEQ ID NO: 94186
  Payload ID: 18785
  Gene Name: twist family bHLH transcription factor 2
  Uniprot ID: Q8WVJ9
  ENSP ID: ENSP00000482581

SEQ ID NO: 94188 - protein, 338 aa, Homo sapiens
  Payload ID: 18786
  Gene Name: TWIST neighbor
  Uniprot ID: Q3B726
  ENSP ID: ENSP00000222567
MAAGCSEAPRPAAASDGSLVGQAGVLPCLELPTYAAACALVNSRYSCLVAGPHQRHIALSPRYLNRKRTGIREQLDAELLRYSESLLGVPIAYDNIKVVGELGDIYDDQGHIHLNIEADFVIFCPEPGQKLMGIVNKVSSSHIGCLVHGCFNASIPKPEQLSAEQWQTMEINMGDELEFEVFRLDSDAAGVFCIRGKLNITSLQFKRSEVSEEVTENGTEEAAKKPKKKKKKKDPETYEVDSGTTKLADDADDTPMEESALQNTNNANGIWEEEPKKKKKKKKHQEVQDQDPVFQGSDSSGYQSDHKKKKKKRKHSEEAEFTPPLKCSPKRKGKSNFL

SEQ ID NO: 94189 - protein, 223 aa, Homo sapiens
  Payload ID: 18787
  Gene Name: twisted gastrulation BMP signaling modulator 1
  Uniprot ID: Q9GZX9
  ENSP ID: ENSP00000262120
MKLHYVAVLTLAILMFLTWLPESLSCNKALCASDVSKCLIQELCQCRPGEGNCSCCKECMLCLGALWDECCDCVGMCNPRNYSDTPPTSKSTVEELHEPIPSLFRALTEGDTQLNWNIVSFPVAEELSHHENLVSFLETVNQPHHQNVSVPSNNVHAPYSSDKEHMCTVVYFDDCMSIHQCKISCESMGASKYRWFHNACCECIGPECIDYGSKTVKCMNCMF

SEQ ID NO: 94190 - protein, 75 aa, Homo sapiens
  Payload ID: 18787
  Gene Name: twisted gastrulation BMP signaling modulator 1
  Uniprot ID: Q9GZX9
  ENSP ID: ENSP00000463331
MKLHYVAVLTLAILMFLTWLPESLSCNKALCASDVSKCLIQELCQCRPGEGNCSCCKECMLCLGALWDECCDCVD

SEQ ID NO: 94191 - protein, 184 aa, Homo sapiens
  Payload ID: 18787
  Gene Name: twisted gastrulation BMP signaling modulator 1
  ENSP ID: ENSP00000464458
MKLHYVAVLTLAILMFLTWLPESLSCNKALCASDVSKCLIQELCQCRPGEGNCSCCKECMLCLGALWDECCDCVGMCNPRNYSDTPPTSKSTVEELHEPIPSLFRALTEGDTQLNWNIVSFPVAEELSHHENLVSFLETVNQPHHQNVSVPSNNVHAPYSSDKGNCQQLTFSIPPPHVVCPCNL

SEQ ID NO: 94192 - protein, 816 aa, Homo sapiens
  Payload ID: 18788
  Gene Name: two pore segment channel 1
  Uniprot ID: Q9ULQ1
  ENSP ID: ENSP00000335300
MAVSLDDDVPLILTLDEGGSAPLAPSNGLGQEELPSKNGGSYAIHDSQAPSLSSGGESSPSSPAHNWEMNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMASLGLTLLIFYYSFAIVGMEFFCGIVFPNCCNTSTVADAYRWRNHTVGNRTVVEEGYYYLNNFDNILNSFVTLFELTVVNNWYIIMEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQEWYEEHAREQEQQRQLSSSAAPAAQQPPGSRQRSQTVT

SEQ ID NO: 94193 - protein, 748 aa, Homo sapiens
  Payload ID: 18788
  Gene Name: two pore segment channel 1
  ENSP ID: ENSP00000376350
MNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMASLGLTLLIFYYSFAIVGMEFFCGIVFPNCCNTSTVADAYRWRNHTVGNRTVVEEGYYYLNNFDNILNSFVTLFELTVVNNWYIIMEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQEWYEEHAREQEQQRQLSSSAAPAAQQPPGSRQRSQTVT

SEQ ID NO: 94194 - protein, 888 aa, Homo sapiens
  Payload ID: 18788
  Gene Name: two pore segment channel 1
  Uniprot ID: Q9ULQ1
  ENSP ID: ENSP00000438125
MESCYIAQAGLELLGSSSSPTLTSQSAEITEDASNGGVSEQHPWPSGFERELKPETISSPGYHILRATGEENMAVSLDDDVPLILTLDEGGSAPLAPSNGLGQEELPSKNGGSYAIHDSQAPSLSSGGESSPSSPAHNWEMNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMASLGLTLLIFYYSFAIVGMEFFCGIVFPNCCNTSTVADAYRWRNHTVGNRTVVEEGYYYLNNFDNILNSFVTLFELTVVNNWYIIMEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQEWYEEHAREQEQQRQLSSSAAPAAQQPPGSRQRSQTVT

SEQ ID NO: 94195 - protein, 120 aa, Homo sapiens
  Payload ID: 18788
  Gene Name: two pore segment channel 1
  ENSP ID: ENSP00000446767
MNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAI

SEQ ID NO: 94196 - protein, 85 aa, Homo sapiens
  Payload ID: 18788
  Gene Name: two pore segment channel 1
  ENSP ID: ENSP00000447073
MAVSLDDDVPLILTLDEGGSAPLAPSNGLGQEELPSKNGGSYAIHDSQAPSLSSGGESSPSSPAHNWEMNYQEAAIYLQEGENND

SEQ ID NO: 94197 - protein, 99 aa, Homo sapiens
  Payload ID: 18788
  Gene Name: two pore segment channel 1
  ENSP ID: ENSP00000447181
MAVSLDDDVPLILTLDEGGSAPLAPSNGLGQEELPSKRRCCMLCSSKQKPWIPCRVISDVACKAASCFEGASGPCDISMWECYRVCKQMAAAMPSTTPR

SEQ ID NO: 94198 - protein, 124 aa, Homo sapiens
  Payload ID: 18788
  Gene Name: two pore segment channel 1
  ENSP ID: ENSP00000447263
MESCYIAQAGLELLGSSSSPTLTSQSAEITEDASNGGVSEQHPWPSGFERELKPETISSPGYHILRATGEENMAVSLDDDVPLILTLDEGGSAPLAPSNGLGQEELPSKNGGSYAIHDSQAPSL

SEQ ID NO: 94199 - protein, 215 aa, Homo sapiens
  Payload ID: 18788
  Gene Name: two pore segment channel 1
  ENSP ID: ENSP00000447569
MERLGTPSGLDSTKMESCYIAQAGLELLGSSSSPTLTSQSAEITEDASNGGVSEQHPWPSGFERELKPETISSPGYHILRATGEENMAVSLDDDVPLILTLDEGGSAPLAPSNGLGQEELPSKNGGSYAIHDSQAPSLSSGGESSPSSPAHNWEMNYQEAAIYLQEGENNDKFFTHPKDAKALAAYLFAHNHLFYLMELATALLLLLLSLCEAPA

SEQ ID NO: 94200 - protein, 126 aa, Homo sapiens
  Payload ID: 18788
  Gene Name: two pore segment channel 1
  ENSP ID: ENSP00000447806
MERLGTPSGLDSTNGGSYAIHDSQAPSLSSGGESSPSSPAHNWEMNYQEAAIYLQEGENNDKFFTHPKDAKALAAYLFAHNHLFYLMELATALLLLLLSLCEAPAVPALRLGIYVHATLELFALMV

SEQ ID NO: 94201 - protein, 104 aa, Homo sapiens
  Payload ID: 18788
  Gene Name: two pore segment channel 1
  ENSP ID: ENSP00000448010
  MOD_RES (1)..(1): Any amino acid
XGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMAR

SEQ ID NO: 94202 - protein, 888 aa, Homo sapiens; identical to SEQ ID NO: 94194
  Payload ID: 18788
  Gene Name: two pore segment channel 1
  Uniprot ID: Q9ULQ1
  ENSP ID: ENSP00000448083

SEQ ID NO: 94203 - protein, 145 aa, Homo sapiens
  Payload ID: 18788
  Gene Name: two pore segment channel 1
  ENSP ID: ENSP00000448561
MNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCR

SEQ ID NO: 94204 - protein, 99 aa, Homo sapiens; identical to SEQ ID NO: 94197
  Payload ID: 18788
  Gene Name: two pore segment channel 1
  ENSP ID: ENSP00000448704

SEQ ID NO: 94205 - protein, 147 aa, Homo sapiens
  Payload ID: 18788
  Gene Name: two pore segment channel 1
  ENSP ID: ENSP00000449560
MERLGTPSGLDSTKDASNGGVSEQHPWPSGFERELKPETISSPGYHILRATGEENMAVSLDDDVPLILTLDEGGSAPLAPSNGLGQEELPSKNGGSYAIHDSQAPSLSSGGESSPSSPAHNWEMNYQEAAIYLQEGENNDKFFTHPK

SEQ ID NO: 94206 - protein, 204 aa, Homo sapiens
  Payload ID: 18788
  Gene Name: two pore segment channel 1
  ENSP ID: ENSP00000449564
  MOD_RES (1)..(1): Any amino acid
XLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKVYGVELFLKVAGLGPVEYLSSGWNLFDFSVTVFAFLGLLALALNMEPFYFI

SEQ ID NO: 94207 - protein, 107 aa, Homo sapiens
  Payload ID: 18788
  Gene Name: two pore segment channel 1
  ENSP ID: ENSP00000449944
MNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMV

SEQ ID NO: 94208 - protein, 752 aa, Homo sapiens
  Payload ID: 18789
  Gene Name: two pore segment channel 2
  Uniprot ID: Q8NHX9
  ENSP ID: ENSP00000294309
MAEPQAESEPLLGGARGGGGDWPAGLTTYRSIQVGPGAAARWDLCIDQAVVFIEDAIQYRSINHRVDASSMWLYRRYYSNVCQRTLSFTIFLILFLAFIETPSSLTSTADVRYRAAPWEPPCGLTESVEVLCLLVFAADLSVKGYLFGWAHFQKNLWLLGYLVVLVVSLVDWTVSLSLVCHEPLRIRRLLRPFFLLQNSSMMKKTLKCIRWSLPEMASVGLLLAIHLCLFTMFGMLLFAGGKQDDGQDRERLTYFQNLPESLTSLLVLLTTANNPDVMIPAYSKNRAYAIFFIVFTVIGSLFLMNLLTAIIYSQFRGYLMKSLQTSLFRRRLGTRAAFEVLSSMVGEGGAFPQAVGVKPQNLLQVLQKVQLDSSHKQAMMEKVRSYGSVLLSAEEFQKLFNELDRSVVKEHPPRPEYQSPFLQSAQFLFGHYYFDYLGNLIALANLVSICVFLVLDADVLPAERDDFILGILNCVFIVYYLLEMLLKVFALGLRGYLSYPSNVFDGLLTVVLLVLEISTLAVYRLPHPGWRPEMVGLLSLWDMTRMLNMLIVFRFLRIIPSMKLMAVVASTVLGLVQNMRAFGGILVVVYYVFAIIGINLFRGVIVALPGNSSLAPANGSAPCGSFEQLEYWANNFDDFAAALVTLWNLMVVNNWQVFLDAYRRYSGPWSKIYFVLWWLVSSVIWVNLFLALILENFLHKWDPRSHLQPLAGTPEATYQMTVELLFRDILEEPGEDELTERLSQHPHLWLCR

SEQ ID NO: 94209 - protein, 570 aa, Homo sapiens
  Payload ID: 18789
  Gene Name: two pore segment channel 2
  ENSP ID: ENSP00000445551
MAEPQAESEPLLGGARGGGGDWPAGLTTYRSIQVGPGAAARWDLCIDQAVVFIEDAIQYRSINHRVDASSMWLYRRYYSNVCQRTLSFTIFLILFLAFIETPSSLTSTADVRYRAAPWEPPCGLTESVEVLCLLVFAADLSVKGYLFGWAHFQKNLWLLGYLVVLVVSLVDWTVSLSLVCHEPLRIRRLLRPFFLLQNSSMMKKTLKCIRWSLPEMASVGLLLAIHLCLFTMFGMLLFAGGKQDDGQDRERLTYFQNLPESLTSLLVLLTTANNPDVMIPAYSKNRAYAIFFIVFTVIGSLFLMNLLTAIIYSQFRGYLMKSLQTSLFRRRLGTRAAFEVLSSMVGEGGAFPQAVGVKPQNLLQVLQKVQLDSSHKQAMMEKVRSYGSVLLSAEEFQKLFNELDRSVVKEHPPRPEYQSPFLQSAQFLFGHYYFDYLGNLIALANLVSICVFLVLDADVLPAERDDFILGILNCVFIVYYLLEMLLKVFALGLRGYLSYPSNVFDGLLTVVLLNFLHKWDPRSHLQPLAGTPEATYQMTVELLFRDILEEPGEDELTERLSQHPHLWLCR

SEQ ID NO: 94210 - protein, 527 aa, Homo sapiens
  Payload ID: 18790
  Gene Name: TXK tyrosine kinase
  Uniprot ID: P42681
  ENSP ID: ENSP00000264316
MILSSYNTIQSVFCCCCCCSVQKRQMRTQISLSTDEELPEKYTQRRRPWLSQLSNKKQSNTGRVQPSKRKPLPPLPPSEVAEEKIQVKALYDFLPREPCNLALRRAEEYLILEKYNPHWWKARDRLGNEGLIPSNYVTENKITNLEIYEWYHRNITRNQAEHLLRQESKEGAFIVRDSRHLGSYTISVFMGARRSTEAAIKHYQIKKNDSGQWYVAERHAFQSIPELIWYHQHNAAGLMTRLRYPVGLMGSCLPATAGFSYEKWEIDPSELAFIKEIGSGQFGVVHLGEWRSHIQVAIKAINEGSMSEEDFIEEAKVMMKLSHSKLVQLYGVCIQRKPLYIVTEFMENGCLLNYLRENKGKLRKEMLLSVCQDICEGMEYLERNGYIHRDLAARNCLVSSTCIVKISDFGMTRYVLDDEYVSSFGAKFPIKWSPPEVFLFNKYSSKSDVWSFGVLMWEVFTEGKMPFENKSNLQVVEAISEGFRLYRPHLAPMSIYEVMYSCWHEKPEGRPTFAELLRAVTEIAETW

SEQ ID NO: 94211 - protein, 82 aa, Homo sapiens
  Payload ID: 18790
  Gene Name: TXK tyrosine kinase
  ENSP ID: ENSP00000422139
MENGCLLNYLRENKGKLRKEMLLSVCQDICEGMEYLERNGYIHRDLAARNCLVSSTCIVKISDFGMTRSFNVGSFYRRKNAF

SEQ ID NO: 94212 - protein, 138 aa, Homo sapiens
  Payload ID: 18790
  Gene Name: TXK tyrosine kinase
  ENSP ID: ENSP00000422798
MICFSDNTIQSVFCCCCCCSVQKRQMRTQISLSTDEELPEKYTQRRRPWLSQLSNKKQSNTGRVQPSKRKPLPPLPPSEVAEEKIQVKALYDFLPREPCNLALRRAEEYLILEKYNPHWWKARDRLGNEGLIPSNYVT

SEQ ID NO: 94213 - protein, 182 aa, Homo sapiens
  Payload ID: 18790
  Gene Name: TXK tyrosine kinase
  ENSP ID: ENSP00000423481
MENGCLLNYLRENKGKLRKEMLLSVCQDICEGMEYLERNGYIHRDLAARNCLVSSTCIVKISDFGMTRYVLDDEYVSSFGAKFPIKWSPPEVFLFNKYSSKSDVWSFGVLMWEVFTEGKMPFENKSNLQVVEAISEGFRLYRPHLAPMSIYEVMYSCWHEKPEGRPTFAELLRAVTEIAETW

SEQ ID NO: 94214 - protein, 48 aa, Homo sapiens
  Payload ID: 18790
  Gene Name: TXK tyrosine kinase
  ENSP ID: ENSP00000424070
MENGCLLNYLRENKGKLRKEMLLSVCQDICEGMEYLERNGYIHRDLEF

SEQ ID NO: 94215 - protein, 113 aa, Homo sapiens
  Payload ID: 18791
  Gene Name: TYRO protein tyrosine kinase binding protein
  Uniprot ID: O43914
  ENSP ID: ENSP00000262629
MGGLEPCSRLLLLPLLLAVSGLRPVQAQAQSDCSCSTVSPGVLAGIVMGDLVLTVLIALAVYFLGRLVPRGRGAAEAATRKQRITETESPYQELQGQRSDVYSDLNTQRPYYK

SEQ ID NO: 94216 - protein, 101 aa, Homo sapiens
  Payload ID: 18791
  Gene Name: TYRO protein tyrosine kinase binding protein
  ENSP ID: ENSP00000402371
MGGLEPCSRLLLLPLLLAVSDCSCSTVSPGVLAGIVMGDLVLTVLIALAVYFLGRLVPRGRGAAEATRKQRITETESPYQELQGQRSDVYSDLNTQRPYYK

SEQ ID NO: 94217 - protein, 102 aa, Homo sapiens
  Payload ID: 18791
  Gene Name: TYRO protein tyrosine kinase binding protein
  Uniprot ID: O43914
  ENSP ID: ENSP00000445332
MGGLEPCSRLLLLPLLLAVSDCSCSTVSPGVLAGIVMGDLVLTVLIALAVYFLGRLVPRGRGAAEAATRKQRITETESPYQELQGQRSDVYSDLNTQRPYYK

SEQ ID NO: 94218 - protein, 35 aa, Homo sapiens
  Payload ID: 18791
  Gene Name: TYRO protein tyrosine kinase binding protein
  ENSP ID: ENSP00000465081
MGGLEPCSRLLLLPLLLAVSVLSRPRPRAIAVALR

SEQ ID NO: 94219 - protein, 35 aa, Homo sapiens; identical to SEQ ID NO: 94218
  Payload ID: 18791
  Gene Name: TYRO protein tyrosine kinase binding protein
  ENSP ID: ENSP00000465656

SEQ ID NO: 94220 - protein, 112 aa, Homo sapiens
  Payload ID: 18791
  Gene Name: TYRO protein tyrosine kinase binding protein
  Uniprot ID: O43914
  ENSP ID: ENSP00000468447
MGGLEPCSRLLLLPLLLAVSGLRPVQAQAQSDCSCSTVSPGVLAGIVMGDLVLTVLIALAVYFLGRLVPRGRGAAEATRKQRITETESPYQELQGQRSDVYSDLNTQRPYYK

SEQ ID NO: 94221 - protein, 144 aa, Homo sapiens
  Payload ID: 18791
  Gene Name: TYRO protein tyrosine kinase binding protein
  ENSP ID: ENSP00000468608
MGGLEPCSRLLLLPLLLAVSGLRPVQAQAQSDCSCSTVSPGVLAGIVMGDLVLTVLIALAVYFLGRLVPRGRGAAEGMVMEVLIWNDKTPSTHHSACLCTPQHPSPPAATRKQRITETESPYQELQGQRSDVYSDLNTQRPYYK

SEQ ID NO: 94222 - protein, 890 aa, Homo sapiens
  Payload ID: 18792
  Gene Name: TYRO3 protein tyrosine kinase
  Uniprot ID: Q06418
  ENSP ID: ENSP00000263798
MALRRSMGRPGLPPLPLPPPPRLGLLLAALASLLLPESAAAGLKLMGAPVKLTVSQGQPVKLNCSVEGMEEPDIQWVKDGAVVQNLDQLYIPVSEQHWIGFLSLKSVERSDAGRYWCQVEDGGETEISQPVWLTVEGVPFFTVEPKDLAVPPNAPFQLSCEAVGPPEPVTIVWWRGTTKIGGPAPSPSVLNVTGVTQSTMFSCEAHNLKGLASSRTATVHLQALPAAPFNITVTKLSSSNASVAWMPGADGRALLQSCTVQVTQAPGGWEVLAVVVPVPPFTCLLRDLVPATNYSLRVRCANALGPSPYADWVPFQTKGLAPASAPQNLHAIRTDSGLILEWEEVIPEAPLEGPLGPYKLSWVQDNGTQDELTVEGTRANLTGWDPQKDLIVRVCVSNAVGCGPWSQPLVVSSHDRAGQQGPPHSRTSWVPVVLGVLTALVTAAALALILLRKRRKETRFGQAFDSVMARGEPAVHFRAARSFNRERPERIEATLDSLGISDELKEKLEDVLIPEQQFTLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYSGDYYRQGCASKLPVKWLALESLADNLYTVQSDVWAFGVTMWEIMTRGQTPYAGIENAEIYNYLIGGNRLKQPPECMEDVYDLMYQCWSADPKQRPSFTCLRMELENILGQLSVLSASQDPLYINIERAEEPTAGGSLELPGRDQPYSGAGDGSGMGAVGGTPSDCRYILTPGGLAEQPGQAEHQPESPLNETQRLLLLQQGLLPHSSC

SEQ ID NO: 94223 - protein, 21 aa, Homo sapiens
  Payload ID: 18792
  Gene Name: TYRO3 protein tyrosine kinase
  ENSP ID: ENSP00000452995
VKMLKGAHLVLFPPSPSPSPS

SEQ ID NO: 94224 - protein, 121 aa, Homo sapiens
  Payload ID: 18792
  Gene Name: TYRO3 protein tyrosine kinase
  ENSP ID: ENSP00000453835
  MOD_RES (1)..(1): Any amino acid
XWEVLAVVVPVPPFTCLLRDLVPATNYSLRVRCANALGPSPYADWVPFQTKGLAPASAPQNLHAIRTDSGLILEWEEVIPEAPLEGPLGPYKLSWVQDNGTQASRALLTAAHPGYLWSLVC

SEQ ID NO: 94225 - protein, 845 aa, Homo sapiens
  Payload ID: 18792
  Gene Name: TYRO3 protein tyrosine kinase
  ENSP ID: ENSP00000454050
MGAPVKLTVSQGQPVKLNCSVEGMEEPDIQWVKDGAVVQNLDQLYIPVSEQHWIGFLSLKSVERSDAGRYWCQVEDGGETEISQPVWLTVEGVPFFTVEPKDLAVPPNAPFQLSCEAVGPPEPVTIVWWRGTTKIGGPAPSPSVLNVTGVTQSTMFSCEAHNLKGLASSRTATVHLQALPAAPFNITVTKLSSSNASVAWMPGADGRALLQSCTVQVTQAPGGWEVLAVVVPVPPFTCLLRDLVPATNYSLRVRCANALGPSPYADWVPFQTKGLAPASAPQNLHAIRTDSGLILEWEEVIPEAPLEGPLGPYKLSWVQDNGTQDELTVEGTRANLTGWDPQKDLIVRVCVSNAVGCGPWSQPLVVSSHDRAGQQGPPHSRTSWVPVVLGVLTALVTAAALALILLRKRRKETRFGQAFDSVMARGEPAVHFRAARSFNRERPERIEATLDSLGISDELKEKLEDVLIPEQQFTLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYSGDYYRQGCASKLPVKWLALESLADNLYTVQSDVWAFGVTMWEIMTRGQTPYAGIENAEIYNYLIGGNRLKQPPECMEDVYDLMYQCWSADPKQRPSFTCLRMELENILGQLSVLSASQDPLYINIERAEEPTAGGSLELPGRDQPYSGAGDGSGMGAVGGTPSDCRYILTPGGLAEQPGQAEHQPESPLNETQRLLLLQQGLLPHSSC

SEQ ID NO: 94226 - protein, 286 aa, Homo sapiens
  Payload ID: 18792
  Gene Name: TYRO3 protein tyrosine kinase
  ENSP ID: ENSP00000455441
  MOD_RES (1)..(1): Any amino acid
XLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFTLIRFMVDIACGMEYLSSRNFIHRDLAARNCMLAEDMTVCVADFGLSRKIYSGDYYRQGCASKLPVKWLALESLADNLYTVQSDVWAFGVTMWEIMTRGQTPYAGIENAEIYNYLIGGNRLKQPPECMEDVLTLPLHPSQGLPRPSDNLLYDLMYQCWSADPKQRPSFTCLRMELENIL

SEQ ID NO: 94227 - protein, 529 aa, Homo sapiens [sequence omitted]

SEQ ID NO: 94228 - protein, 247 aa, Homo sapiens
  Payload ID: 18794
  Gene Name: tyrosinase-related protein 1
  ENSP ID: ENSP00000370528
MAQVPPPASGERHAGTEDGPIRRNPAGNVARPMVQRLPEPQDVAQCLEVGLFDTPPFYSNSTNSFRNTVEGYSDPTGKYDPAVRSLHNLAHLFLNGTGGQTHLSPNDPIFVLLHTFTDAVFDEWLRRYNADISTFPLENAPIGHNRQYNMVPFWPPVTNTEMFVTAPDNLGYTYEIQWPSREFSVPEIIAIAVVGALLLVALIFGTASYLIRARRSMDEANQPLLTDQYQCYAEEYEKLQNPNQSVV

SEQ ID NO: 94229 - protein, 537 aa, Homo sapiens
  Payload ID: 18794
  Gene Name: tyrosinase-related protein 1
  Uniprot ID: P17643
  ENSP ID: ENSP00000373570
MSAPKLLSLGCIFFPLLLFQQARAQFPRQCATVEALRSGMCCPDLSPVSGPGTDRCGSSSGRGRCEAVTADSRPHSPQYPHDGRDDREVWPLRFFNRTCHCNGNFSGHNCGTCRPGWRGAACDQRVLIVRRNLLDLSKEEKNHFVRALDMAKRTTHPLFVIATRRSEEILGPDGNTPQFENISIYNYFVWTHYYSVKKTFLGVGQESFGEVDFSHEGPAFLTWHRYHLLRLEKDMQEMLQEPSFSLPYWNFATGKNVCDICTDDLMGSRSNFDSTLISPNSVFSQWRVVCDSLEDYDTLGTLCNSTEDGPIRRNPAGNVARPMVQRLPEPQDVAQCLEVGLFDTPPFYSNSTNSFRNTVEGYSDPTGKYDPAVRSLHNLAHLFLNGTGGQTHLSPNDPIFVLLHTFTDAVFDEWLRRYNADISTFPLENAPIGHNRQYNMVPFWPPVTNTEMFVTAPDNLGYTYEIQWPSREFSVPEIIAIAVVGALLLVALIFGTASYLIRARRSMDEANQPLLTDQYQCYAEEYEKLQNPNQSVV

SEQ ID NO: 94230 - protein, 102 aa, Homo sapiens
  Payload ID: 18794
  Gene Name: tyrosinase-related protein 1
  ENSP ID: ENSP00000419006
MSAPKLLSLGCIFFPLLLFQQARAQFPRQCATVEALRSGMCCPDLSPVSGPGTDRCGSSSGRGRCEAVTADSRPHSPQYPHDGRDDREVWPLRFFNRTCHCN

SEQ ID NO: 94231 - protein, 246 aa, Homo sapiens
  Payload ID: 18795
  Gene Name: tyrosine 3-monooxygenase/tryptophan 5-monooxygenase activation protein, beta
  Uniprot ID: P31946
  ENSP ID: ENSP00000300161
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVLELLDKYLIPNATQPESKVFYLKMKGDYFRYLSEVASGDNKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 94232 - protein, 246 aa, Homo sapiens; identical to SEQ ID NO: 94231
  Payload ID: 18795
  Gene Name: tyrosine 3-monooxygenase/tryptophan 5-monooxygenase activation protein, beta
  Uniprot ID: P31946
  ENSP ID: ENSP00000361930

SEQ ID NO: 94233 - protein, 74 aa, Homo sapiens
  Payload ID: 18795
  Gene Name: tyrosine 3-monooxygenase/tryptophan 5-monooxygenase activation protein, beta
  ENSP ID: ENSP00000394558
MTMDKSELVQKAKLAEQAERYDDMAAAMKAVTEQGHELSNEERNLLSVAYKNVVGARRSSWRVISSIEQKTERN

SEQ ID NO: 94234 - protein, 100 aa, Homo sapiens
  Payload ID: 18795
  Gene Name: tyrosine 3-monooxygenase/tryptophan 5-monooxygenase activation protein, beta
  ENSP ID: ENSP00000394729
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVL

SEQ ID NO: 94235 - protein, 149 aa, Homo sapiens
  Payload ID: 18795
  Gene Name: tyrosine 3-monooxygenase/tryptophan 5-monooxygenase activation protein, beta
  ENSP ID: ENSP00000487924
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVLFFRMPHSKTTLRKYCSVYEAWTPSELLLLSCWTNILFPMLHNQKVRCST

SEQ ID NO: 94236 - protein, 81 aa, Homo sapiens
  Payload ID: 18795
  Gene Name: tyrosine 3-monooxygenase/tryptophan 5-monooxygenase activation protein, beta
  ENSP ID: ENSP00000488178
  MOD_RES (1)..(1): Any amino acid
XAMKAVTEQGHELSNEERNLLSVAYKNVVGARRSSWRVISSIEQKTERNEKKQQMGKEYREKIEAELQDICNDVLVHLVFR

SEQ ID NO: 94237 - protein, 255 aa, Homo sapiens
  Payload ID: 18796
  Gene Name: tyrosine 3-monooxygenase/tryptophan 5-monooxygenase activation protein, epsilon
  Uniprot ID: P62258
  ENSP ID: ENSP00000264335
MDDREDLVYQAKLAEQAERYDEMVESMKKVAGMDVELTVEERNLLSVAYKNVIGARRASWRIISSIEQKEENKGGEDKLKMIREYRQMVETELKLICCDILDVLDKHLIPAANTGESKVFYYKMKGDYHRYLAEFATGNDRKEAAENSLVAYKAASDIAMTELPPTHPIRLGLALNFSVFYYEILNSPDRACRLAKAAFDDAIAELDTLSEESYKDSTLIMQLLRDNLTLWTSDMQGDGEEQNKEALQDVEDENQ

SEQ ID NO: 94238 - protein, 38 aa, Homo sapiens
  Payload ID: 18796
  Gene Name: tyrosine 3-monooxygenase/tryptophan 5-monooxygenase activation protein, epsilon
  ENSP ID: ENSP00000458386
MDDREDLVYQAKLAEQAERYDGEEQNKEALQDVEDENQ

SEQ ID NO: 94239 - protein, 107 aa, Homo sapiens
  Payload ID: 18796
  Gene Name: tyrosine 3-monooxygenase/tryptophan 5-monooxygenase activation protein, epsilon
  ENSP ID: ENSP00000460712
MDDREDLVYQAKLAEQAERYDEMVESMKKVAGMDVELTVEERNLLSVAYKNVIGARRASWRIISSIEQKEENKGGEDKLKMIREYRQMVKSRIKKRCRTWKTKISET

SEQ ID NO: 94240 - protein, 233 aa, Homo sapiens
  Payload ID: 18796
  Gene Name: tyrosine 3-monooxygenase/tryptophan 5-monooxygenase activation protein, epsilon
  Uniprot ID: P62258
  ENSP ID: ENSP00000461762
MVESMKKVAGMDVELTVEERNLLSVAYKNVIGARRASWRIISSIEQKEENKGGEDKLKMIREYRQMVETELKLICCDILDVLDKHLIPAANTGESKVFYYKMKGDYHRYLAEFATGNDRKEAAENSLVAYKAASDIAMTELPPTHPIRLGLALNFSVFYYEILNSPDRACRLAKAAFDDAIAELDTLSEESYKDSTLIMQLLRDNLTLWTSDMQGDGEEQNKEALQDVEDENQ

SEQ ID NO: 94241 - protein, 94 aa, Homo sapiens
  Payload ID: 18796
  Gene Name: tyrosine 3-monooxygenase/tryptophan 5-monooxygenase activation protein, epsilon
  ENSP ID: ENSP00000461766
MDDREDLVYQAKLAEQAERYDEMVESMKKVAGMDVELTVEERNLLSVAYKNVIGARRASWRIISSIEQKEENKGGEDKLKMIREYRQMVGKSSF

SEQ ID NO: 94242 - protein, 109 aa, Homo sapiens
  Payload ID: 18796
  Gene Name: tyrosine 3-monooxygenase/tryptophan 5-monooxygenase activation protein, epsilon
  ENSP ID: ENSP00000464883
  MOD_RES (1)..(1): Any amino acid
XMVESMKKVAGMDVELTVEERNLLSVAYKNVIGARRASWRIISSIEQKEENKGGEDKLKMIREYRQMVETELKLICCDILDVLDKHLIPAANTGWQKQLLMMQLQNWIR

SEQ ID NO: 94243 - protein, 115 aa, Homo sapiens
  Payload ID: 18796
  Gene Name: tyrosine 3-monooxygenase/tryptophan 5-monooxygenase activation protein, epsilon
  ENSP ID: ENSP00000466324
GDYHRYLAEFATGNDRKEAAENSLVAYKAASDIAMTELPPTHPIRLGLALNFSVFYYEILNSPDRACRLAKAAFDDAIAELDTLSEESYKDSTLIMQLLRDNLTLWTSDMQGDDS

SEQ ID NO: 94244 - protein, 233 aa, Homo sapiens; identical to SEQ ID NO: 94240
  Payload ID: 18796
  Gene Name: tyrosine 3-monooxygenase/tryptophan 5-monooxygenase activation protein, epsilon
  Uniprot ID: P62258
  ENSP ID: ENSP00000481059

SEQ ID NO: 94245 - protein, 94 aa, Homo sapiens; identical to SEQ ID NO: 94241
  Payload ID: 18796
  Gene Name: tyrosine 3-monooxygenase/tryptophan 5-monooxygenase activation protein, epsilon
  ENSP ID: ENSP00000486352

SEQ ID NO: 94246 - protein, 38 aa, Homo sapiens; identical to SEQ ID NO: 94238
  Payload ID: 18796
  Gene Name: tyrosine 3-monooxygenase/tryptophan 5-monooxygenase activation protein, epsilon
  ENSP ID: ENSP00000486697

SEQ ID NO: 94247 - protein, 109 aa, Homo sapiens; identical to SEQ ID NO: 94242
  Payload ID: 18796
  Gene Name: tyrosine 3-monooxygenase/tryptophan 5-monooxygenase activation protein, epsilon
  ENSP ID: ENSP00000487228
  MOD_RES (1)..(1): Any amino acid

SEQ ID NO: 94248 - protein, 255 aa, Homo sapiens; identical to SEQ ID NO: 94237
  Payload ID: 18796
  Gene Name: tyrosine 3-monooxygenase/tryptophan 5-monooxygenase activation protein, epsilon
  Uniprot ID: P62258
  ENSP ID: ENSP00000487356

SEQ ID NO: 94249 - protein, 115 aa, Homo sapiens; identical to SEQ ID NO: 94243
  Payload ID: 18796
  Gene Name: tyrosine 3-monooxygenase/tryptophan 5-monooxygenase activation protein, epsilon
  ENSP ID: ENSP00000487432

SEQ ID NO: 94250 - protein, 107 aa, Homo sapiens; identical to SEQ ID NO: 94239
  Payload ID: 18796
  Gene Name: tyrosine 3-monooxygenase/tryptophan 5-monooxygenase activation protein, epsilon
  ENSP ID: ENSP00000487508

SEQ ID NO: 94251 - protein, 246 aa, Homo sapiens
  Payload ID: 18797
  Gene Name: tyrosine 3-monooxygenase/tryptophan 5-monooxygenase activation protein, eta
  Uniprot ID: Q04917
  ENSP ID: ENSP00000248975
MGDREQLLQRARLAEQAERYDDMASAMKAVTELNEPLSNEDRNLLSVAYKNVVGARRSSWRVISSIEQKTMADGNEKKLEKVKAYREKIEKELETVCNDVLSLLDKFLIKNCNDFQYESKVFYLKMKGDYYRYLAEVASGEKKNSVVEASEAAYKEAFEISKEQMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 94252 - protein, 72 aa, Homo sapiens
  Payload ID: 18797
  Gene Name: tyrosine 3-monooxygenase/tryptophan 5-monooxygenase activation protein, eta
  ENSP ID: ENSP00000380629
MGDREQLLQRARLAEQAERYDDMASAMKAVAGKIPPSVQVEAACLLSQHFGAPPAPTPGCSGIPFCGGDRAE

SEQ ID NO: 94253 - protein, 162 aa, Homo sapiens
  Payload ID: 18797
  Gene Name: tyrosine 3-monooxygenase/tryptophan 5-monooxygenase activation protein, eta
  ENSP ID: ENSP00000406747
MIDVPHSTSVTWRTVLVTELNEPLSNEDRNLLSVAYKNVVGARRSSWRVISSIEQKTMADGNEKKLEKVKAYREKIEKELETVCNDVLSLLDKFLIKNCNDFQYESKVFYLKMKGDYYRYLAEVASGEKKNSVVEASEAAYKEAFEISKEQMQPTHPIRLGL

SEQ ID NO: 94254 - protein, 39 aa, Homo sapiens
  Payload ID: 18797
  Gene Name: tyrosine 3-monooxygenase/tryptophan 5-monooxygenase activation protein, eta
  ENSP ID: ENSP00000408468
MGDREQLLQRARLAEQAERYDDMASAMKAVRRICVSLHS

SEQ ID NO: 94255 - protein, 247 aa, Homo sapiens
  Payload ID: 18798
  Gene Name: tyrosine 3-monooxygenase/tryptophan 5-monooxygenase activation protein, gamma
  Uniprot ID: P61981
  ENSP ID: ENSP00000306330
MVDREQLVQKARLAEQAERYDDMAAAMKNVTELNEPLSNEERNLLSVAYKNVVGARRSSWRVISSIEQKTSADGNEKKIEMVRAYREKIEKELEAVCQDVLSLLDNYLIKNCSETQYESKVFYLKMKGDYYRYLAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 94256 - protein, 245 aa, Homo sapiens
  Payload ID: 18799
  Gene Name: tyrosine 3-monooxygenase/tryptophan 5-monooxygenase activation protein, theta
  Uniprot ID: P27348
  ENSP ID: ENSP00000238081
MEKTELIQKAKLAEQAERYDDMATCMKAVTEQGAELSNEERNLLSVAYKNVVGGRRSAWRVISSIEQKTDTSDKKLQLIKDYREKVESELRSICTTVLELLDKYLIANATNPESKVFYLKMKGDYFRYLAEVACGDDRKQTIDNSQGAYQEAFDISKKEMQPTHPIRLGLALNFSVFYYEILNNPELACTLAKTAFDEAIAELDTLNEDSYKDSTLIMQLLRDNLTLWTSDSAGEECDAAEGAEN

SEQ ID NO: 94257 - protein, 245 aa, Homo sapiens; identical to SEQ ID NO: 94256
  Payload ID: 18799
  Gene Name: tyrosine 3-monooxygenase/tryptophan 5-monooxygenase activation protein, theta
  Uniprot ID: P27348
  ENSP ID: ENSP00000371267

SEQ ID NO: 94258 - protein, 149 aa, Homo sapiens
  Payload ID: 18799
  Gene Name: tyrosine 3-monooxygenase/tryptophan 5-monooxygenase activation protein, theta
  ENSP ID: ENSP00000398990
MEKTELIQKAKLAEQAERYDDMATCMKAVTEQGAELSNEERNLLSVAYKNVVGGRRSAWRVISSIEQKTDTSDKKLQLIKDYREKVESELRSICTTVLELLDKYLIANATNPESKVFYLKMKGDYFRYLAEVACGDDRKQTIDNSQGAY

SEQ ID NO: 94259 - protein, 245 aa, Homo sapiens
  Payload ID: 18800
  Gene Name: tyrosine 3-monooxygenase/tryptophan 5-monooxygenase activation protein, zeta
  Uniprot ID: P63104
  ENSP ID: ENSP00000309503
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQAESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 94260 - protein, 168 aa, Homo sapiens
  Payload ID: 18800
  Gene Name: tyrosine 3-monooxygenase/tryptophan 5-monooxygenase activation protein, zeta
  ENSP ID: ENSP00000379278
MAREYREKIETELRDICNDVLSLLEKFLIPNASQAESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 94261 - protein, 245 aa, Homo sapiens; identical to SEQ ID NO: 94259
  Payload ID: 18800
  Gene Name: tyrosine 3-monooxygenase/tryptophan 5-monooxygenase activation protein, zeta
  Uniprot ID: P63104
  ENSP ID: ENSP00000379281

SEQ ID NO: 94262 - protein, 245 aa, Homo sapiens; identical to SEQ ID NO: 94259
  Payload ID: 18800
  Gene Name: tyrosine 3-monooxygenase/tryptophan 5-monooxygenase activation protein, zeta
  Uniprot ID: P63104
  ENSP ID: ENSP00000379283

SEQ ID NO: 94263 - protein, 245 aa, Homo sapiens; identical to SEQ ID NO: 94259
  Payload ID: 18800
  Gene Name: tyrosine 3-monooxygenase/tryptophan 5-monooxygenase activation protein, zeta
  Uniprot ID: P63104
  ENSP ID: ENSP00000379286

SEQ ID NO: 94264 - protein, 245 aa, Homo sapiens; identical to SEQ ID NO: 94259
  Payload ID: 18800
  Gene Name: tyrosine 3-monooxygenase/tryptophan 5-monooxygenase activation protein, zeta
  Uniprot ID: P63104
  ENSP ID: ENSP00000379287

SEQ ID NO: 94265 - protein, 245 aa, Homo sapiens; identical to SEQ ID NO: 94259
  Payload ID: 18800
  Gene Name: tyrosine 3-monooxygenase/tryptophan 5-monooxygenase activation protein, zeta
  Uniprot ID: P63104
  ENSP ID: ENSP00000379288

SEQ ID NO: 94266 - protein, 92 aa, Homo sapiens
  Payload ID: 18800
  Gene Name: tyrosine 3-monooxygenase/tryptophan 5-monooxygenase activation protein, zeta
  ENSP ID: ENSP00000394880
MDKNELVQKAKLAEQAERYDDMAACMKSVTEQGAELSNEERNLLSVAYKNVVGARRSSWRVVSSIEQKTEGAEKKQQMAREYREKIETELRD

SEQ ID NO: 94267 - protein, 245 aa, Homo sapiens; identical to SEQ ID NO: 94259
  Payload ID: 18800
  Gene Name: tyrosine 3-monooxygenase/tryptophan 5-monooxygenase activation protein, zeta
  Uniprot ID: P63104
  ENSP ID: ENSP00000395114

SEQ ID NO: 94268 - protein, 245 aa, Homo sapiens; identical to SEQ ID NO: 94259
  Payload ID: 18800
  Gene Name: tyrosine 3-monooxygenase/tryptophan 5-monooxygenase activation protein, zeta
  Uniprot ID: P63104
  ENSP ID: ENSP00000398599

SEQ ID NO: 94269 - protein, 98 aa, Homo sapiens
  Payload ID: 18800
  Gene Name: tyrosine 3-monooxygenase/tryptophan 5-monooxygenase activation protein, zeta
  ENSP ID: ENSP00000416551
MDKNELVQKAKLAEQAERYDDMAACMKSVTEQGAELSNEERNLLSVAYKNVVGARRSSWRVVSSIEQKTEGAEKKQQMAREYREKIETELRDICNDVL

SEQ ID NO: 94270 - protein, 75 aa, Homo sapiens
  Payload ID: 18800
  Gene Name: tyrosine 3-monooxygenase/tryptophan 5-monooxygenase activation protein, zeta
  ENSP ID: ENSP00000428381
MDKNELVQKAKLAEQAERYDDMAACMKSVTEQGAELSNEERNLLSVAYKNVVGARRSSWRVVSSIEQKTEGAEKK

SEQ ID NO: 94271 - protein, 125 aa, Homo sapiens
  Payload ID: 18800
  Gene Name: tyrosine 3-monooxygenase/tryptophan 5-monooxygenase activation protein, zeta
  ENSP ID: ENSP00000428775
MKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 94272 - protein, 130 aa, Homo sapiens
  Payload ID: 18800
  Gene Name: tyrosine 3-monooxygenase/tryptophan 5-monooxygenase activation protein, zeta
  ENSP ID: ENSP00000428860
VFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 94273 - protein, 137 aa, Homo sapiens
  Payload ID: 18800
  Gene Name: tyrosine 3-monooxygenase/tryptophan 5-monooxygenase activation protein, zeta
  ENSP ID: ENSP00000429041
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQAESKVFYLKMKGDYYRYLAEVAAGDD

SEQ ID NO: 94274 - protein, 125 aa, Homo sapiens; identical to SEQ ID NO: 94271
  Payload ID: 18800
  Gene Name: tyrosine 3-monooxygenase/tryptophan 5-monooxygenase activation protein, zeta
  ENSP ID: ENSP00000429623

SEQ ID NO: 94275 - protein, 246 aa, Homo sapiens
  Payload ID: 18800
  Gene Name: tyrosine 3-monooxygenase/tryptophan 5-monooxygenase activation protein, zeta
  ENSP ID: ENSP00000430058
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQAESKVFYLKMKGDYYRYLAEVAAGDDKKVRFGVSYPGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAE

SEQ ID NO: 94276 - protein, 170 aa, Homo sapiens
  Payload ID: 18800
  Gene Name: tyrosine 3-monooxygenase/tryptophan 5-monooxygenase activation protein, zeta
  Uniprot ID: P63104
  ENSP ID: ENSP00000430072
MSQPCRKLWRHNYETSSCIEFLKSLLEKFLIPNASQAESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 94277 - protein, 51 aa, Homo sapiens
  Payload ID: 18800
  Gene Name: tyrosine 3-monooxygenase/tryptophan 5-monooxygenase activation protein, zeta
  ENSP ID: ENSP00000430219
MDKNELVQKAKLAEQAERYDDMAACMKSVTEQGAELSNEERNLLSVAYKNV

SEQ ID NO: 94278 - protein, 454 aa, Homo sapiens [sequence omitted]

SEQ ID NO: 94279 - protein, 44 aa, Homo sapiens
  Payload ID: 18802
  Gene Name: tyrosine hydroxylase
  ENSP ID: ENSP00000325831
MPTPDATTPQAKGFRRAVSELDAKQAEAIMGHQALGAVPSCEGV

SEQ ID NO: 94280 - protein, 497 aa, Homo sapiens
  Payload ID: 18802
  Gene Name: tyrosine hydroxylase
  Uniprot ID: P07101
  ENSP ID: ENSP00000325951
MPTPDATTPQAKGFRRAVSELDAKQAEAIMSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 94281 - protein, 403 aa, Homo sapiens
  Payload ID: 18802
  Gene Name: tyrosine hydroxylase
  Uniprot ID: P07101
  ENSP ID: ENSP00000328814
MPTPDATTPQAKGFRRAVSELDAKQAEAIMSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 94282 - protein, 48 aa, Homo sapiens
  Payload ID: 18802
  Gene Name: tyrosine hydroxylase
  ENSP ID: ENSP00000370560
MPTPDATTPQAKGFRRAVSELDAKQAEAIMVRGQGHQALGAVPSCEGV

SEQ ID NO: 94283 - protein, 524 aa, Homo sapiens
  Payload ID: 18802
  Gene Name: tyrosine hydroxylase
  Uniprot ID: P07101
  ENSP ID: ENSP00000370567
MPTPDATTPQAKGFRRAVSELDAKQAEAIMGAPGPSLTGSPWPGTAAPAASYTPTPRSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 94284 - protein, 528 aa, Homo sapiens
  Payload ID: 18802
  Gene Name: tyrosine hydroxylase
  Uniprot ID: P07101
  ENSP ID: ENSP00000370571
MPTPDATTPQAKGFRRAVSELDAKQAEAIMVRGQGAPGPSLTGSPWPGTAAPAASYTPTPRSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 94285 - protein, 45 aa, Homo sapiens
  Payload ID: 18802
  Gene Name: tyrosine hydroxylase
  ENSP ID: ENSP00000403440
  MOD_RES (1)..(1): Any amino acid
XDLDHPGFSDQVYRQRRKLIAEIAFQYRHGDPIPRVEYTAEEIAT

SEQ ID NO: 94286 - protein, 116 aa, Homo sapiens
  Payload ID: 18802
  Gene Name: tyrosine hydroxylase
  ENSP ID: ENSP00000403546
  MOD_RES (1)..(1): Any amino acid
XDLDHPGFSDQVYRQRRKLIAEIAFQYRHGDPIPRVEYTAEEIATWDCCHELLGHVPMLADRTFAQFSQDIGLASLGASDEEIEKLSTLYWFTVEFGLCKQNGEVKAYGAGLLSSY

SEQ ID NO: 94287 - protein, 1187 aa, Homo sapiens
  Payload ID: 18803
  Gene Name: tyrosine kinase 2
  Uniprot ID: P29597
  ENSP ID: ENSP00000264818
MPLRHWGMARGSKPVGDGAQPMAAMGGLKVLLHWAGPGGGEPWVTFSESSLTAEEVCIHIAHKVGITPPCFNLFALFDAQAQVWLPPNHILEIPRDASLMLYFRIRFYFRNWHGMNPREPAVYRCGPPGTEASSDQTAQGMQLLDPASFEYLFEQGKHEFVNDVASLWELSTEEEIHHFKNESLGMAFLHLCHLALRHGIPLEEVAKKTSFKDCIPRSFRRHIRQHSALTRLRLRNVFRRFLRDFQPGRLSQQMVMVKYLATLERLAPRFGTERVPVCHLRLLAQAEGEPCYIRDSGVAPTDPGPESAAGPPTHEVLVTGTGGIQWWPVEEEVNKEEGSSGSSGRNPQASLFGKKAKAHKAVGQPADRPREPLWAYFCDFRDITHVVLKEHCVSIHRQDNKCLELSLPSRAAALSFVSLVDGYFRLTADSSHYLCHEVAPPRLVMSIRDGIHGPLLEPFVQAKLRPEDGLYLIHWSTSHPYRLILTVAQRSQAPDGMQSLRLRKFPIEQQDGAFVLEGWGRSFPSVRELGAALQGCLLRAGDDCFSLRRCCLPQPGETSNLIIMRGARASPRTLNLSQLSFHRVDQKEITQLSHLGQGTRTNVYEGRLRVEGSGDPEEGKMDDEDPLVPGRDRGQELRVVLKVLDPSHHDIALAFYETASLMSQVSHTHLAFVHGVCVRGPENIMVTEYVEHGPLDVWLRRERGHVPMAWKMVVAQQLASALSYLENKNLVHGNVCGRNILLARLGLAEGTSPFIKLSDPGVGLGALSREERVERIPWLAPECLPGGANSLSTAMDKWGFGATLLEICFDGEAPLQSRSPSEKEHFYQRQHRLPEPSCPQLATLTSQCLTYEPTQRPSFRTILRDLTRLQPHNLADVLTVNPDSPASDPTVFHKRYLKKIRDLGEGHFGKVSLYCYDPTNDGTGEMVAVKALKADCGPQHRSGWKQEIDILRTLYHEHIIKYKGCCEDQGEKSLQLVMEYVPLGSLRDYLPRHSIGLAQLLLFAQQICEGMAYLHAQHYIHRDLAARNVLLDNDRLVKIGDFGLAKAVPEGHEYYRVREDGDSPVFWYAPECLKEYKFYYASDVWSFGVTLYELLTHCDSSQSPPTKFLELIGIAQGQMTVLRLTELLERGERLPRPDKCPCEVYHLMKNCWETEASFRPTFENLIPILKTVHEKYQGQAPSVFSVC

SEQ ID NO: 94288 - protein, 1187 aa, Homo sapiens; identical to SEQ ID NO: 94287
  Payload ID: 18803
  Gene Name: tyrosine kinase 2
  Uniprot ID: P29597
  ENSP ID: ENSP00000431885

SEQ ID NO: 94289 - protein, 82 aa, Homo sapiens
  Payload ID: 18803
  Gene Name: tyrosine kinase 2
  ENSP ID: ENSP00000432320
  MOD_RES (1)..(1): Any amino acid
XRVEGSGDPEEGKMDDEDPLVPGRDRGQELRVVLKVLDPSHHDIALAFYETASLMSQVSHTHLAFVHGVCVRGPESSSKLLV

SEQ ID NO: 94290 - protein, 921 aa, Homo sapiens
  Payload ID: 18803
  Gene Name: tyrosine kinase 2
  ENSP ID: ENSP00000432728
MPLRHWGMARGSKPVGDGAQPMAAMGGLKVLLHWAGPGGGEPWVTFSESSLTAEEVCIHIAHKVGITPPCFNLFALFDAQAQVWLPPNHILEIPRDASLMLYFRIRFYFRNWHGMNPREPAVYRCGPPGTEASSDQTAQGMQLLDPASFEYLFEQGKHEFVNDVASLWELSTEEEIHHFKNESLGMAFLHLCHLALRHGIPLEEVAKKTSFKDCIPRSFRRHIRQHSALTRLRLRNVFRRFLRDFQPGRLSQQMVMVKYLATLERLAPRFGTERVPVCHLRLLAQAEGEPCYIRDSGVAPTDPGPESAAGPPTHEVLVTGTGGIQWWPVEEEVNKEEGSSGSSGRNPQASLFGKKAKAHKAVGQPADRPREPLWAYFCDFRDITHVVLKEHCVSIHRQDNKCLELSLPSRAAALSFVSLVDGYFRLTADSSHYLCHEVAPPRLVMSIRDGIHGPLLEPFVQAKLRPEDGLYLIHWSTSHPYRLILTVAQRSQAPDGMQSLRLRKFPIEQQDGAFVLEGWGRSFPSVRELGAALQGCLLRAGDDCFSLRRCCLPQPGETSNLIIMRGARASPRTLNLSQLSFHRVDQKEITQLSHLGQGTRTNVYEGRLRVEGSGDPEEGKMDDEDPLVPGRDRGQELRVVLKVLDPSHHDIALAFYETASLMSQVSHTHLAFVHGVCVRGPENIMVTEYVEHGPLDVWLRRERGHVPMAWKMVVAQQLASALSYLENKNLVHGNVCGRNILLARLGLAEGTSPFIKLSDPGVGLGALSREERVERIPWLAPECLPGGANSLSTAMDKWGFGATLLEICFDGEAPLQSRSPSEVCLGDPWALPAVGAPPRNPEDRIRAQSCIPSGLVTSSLSGLPAGGPLAGAQCSPSLFRSLWKSLVPGTQKASKRLDFSFRQSDQGSDGRRPGCRVGKKG

SEQ ID NO: 94291 - protein, 1002 aa, Homo sapiens
  Payload ID: 18803
  Gene Name: tyrosine kinase 2
  ENSP ID: ENSP00000433203
MAFLHLCHLALRHGIPLEEVAKKTSFKDCIPRSFRRHIRQHSALTRLRLRNVFRRFLRDFQPGRLSQQMVMVKYLATLERLAPRFGTERVPVCHLRLLAQAEGEPCYIRDSGVAPTDPGPESAAGPPTHEVLVTGTGGIQWWPVEEEVNKEEGSSGSSGRNPQASLFGKKAKAHKAVGQPADRPREPLWAYFCDFRDITHVVLKEHCVSIHRQDNKCLELSLPSRAAALSFVSLVDGYFRLTADSSHYLCHEVAPPRLVMSIRDGIHGPLLEPFVQAKLRPEDGLYLIHWSTSHPYRLILTVAQRSQAPDGMQSLRLRKFPIEQQDGAFVLEGWGRSFPSVRELGAALQGCLLRAGDDCFSLRRCCLPQPGETSNLIIMRGARASPRTLNLSQLSFHRVDQKEITQLSHLGQGTRTNVYEGRLRVEGSGDPEEGKMDDEDPLVPGRDRGQELRVVLKVLDPSHHDIALAFYETASLMSQVSHTHLAFVHGVCVRGPENIMVTEYVEHGPLDVWLRRERGHVPMAWKMVVAQQLASALSYLENKNLVHGNVCGRNILLARLGLAEGTSPFIKLSDPGVGLGALSREERVERIPWLAPECLPGGANSLSTAMDKWGFGATLLEICFDGEAPLQSRSPSEKEHFYQRQHRLPEPSCPQLATLTSQCLTYEPTQRPSFRTILRDLTRLQPHNLADVLTVNPDSPASDPTVFHKRYLKKIRDLGEGHFGKVSLYCYDPTNDGTGEMVAVKALKADCGPQHRSGWKQEIDILRTLYHEHIIKYKGCCEDQGEKSLQLVMEYVPLGSLRDYLPRHSIGLAQLLLFAQQICEGMAYLHAQHYIHRDLAARNVLLDNDRLVKIGDFGLAKAVPEGHEYYRVREDGDSPVFWYAPECLKEYKFYYASDVWSFGVTLYELLTHCDSSQSPPTKFLELIGIAQGQMTVLRLTELLERGERLPRPDKCPCEVYHLMKNCWETEASFRPTFENLIPILKTVHEKYQGQAPSVFSVC

SEQ ID NO: 94292 - protein, 64 aa, Homo sapiens
  Payload ID: 18803
  Gene Name: tyrosine kinase 2
  ENSP ID: ENSP00000434831
  MOD_RES (1)..(1): Any amino acid
XGVTLYELLTHCDSSQSPPTVYHLMKNCWETEASFRPTFENLIPILKTVHEKYQGQAPSVFSVC

SEQ ID NO: 94293 - protein, 194 aa, Homo sapiens
  Payload ID: 18803
  Gene Name: tyrosine kinase 2
  ENSP ID: ENSP00000434931
  MOD_RES (1)..(1): Any amino acid
XIRQHSALTRLRLRNVFRRFLRDFQPGRLSQQMVMVKYLATLERLAPRFGTERVPVCHLRLLAQAEGEPCYIRDSGVAPTDPGPESAAGPPTHEVLVTGTGGIQWWPVEEEVNKEEELSLPSRAAALSFVSLVDGYFRLTADSSHYLCHEVAPPRLVMSIRDGIHGPLLEPFVQAKLRPEDGLYLIHWSTSHPY

SEQ ID NO: 94294 - protein, 129 aa, Homo sapiens
  Payload ID: 18803
  Gene Name: tyrosine kinase 2
  ENSP ID: ENSP00000436155
MEYVPLGSLRDYLPRHSIGLAQLLLFAQQICEGMAYLHAQHYIHRDLAARNVLLDNDRLVKIGDFGLAKAVPEGHEYYRVREDGDSPVFWYAPECLKEYKFYYASDVWSFGVTLYELLTHCDSSQSPPT

SEQ ID NO: 94295 - protein, 118 aa, Homo sapiens
  Payload ID: 18803
  Gene Name: tyrosine kinase 2
  ENSP ID: ENSP00000436175
MPLRHWGMARGSKPVGDGAQPMAAMGGLKVLLHWAGPGGGEPWVTFSESSLTAEEVCIHIAHKVGITPPCFNLFALFDAQAQVWLPPNHILEIPRDASLMLYFRIRFYFRNWHGMNPR

SEQ ID NO: 94296 - protein, 134 aa, Homo sapiens
  Payload ID: 18803
  Gene Name: tyrosine kinase 2
  ENSP ID: ENSP00000436826
MPLRHWGMARGSKPVGDGAQPMAAMGGLKVLLHWAGPGGGEPWVTFSESSLTAEEVCIHIAHKVVETGFHHVSQDGLDLLTSWSAHLSLPKCWDYRREPLRPADRYHSSLLQSLCPLRCSGPSLVAPKPHPRDP

SEQ ID NO: 94297 - protein, 142 aa, Homo sapiens
  Payload ID: 18803
  Gene Name: tyrosine kinase 2
  ENSP ID: ENSP00000465291
SFRTILRDLTRLQPHNLADVLTVNPDSPASDPTVFHKRYLKKIRDLGEGHFGKVSLYCYDPTNDGTGEMVAVKALKADCGPQHRSGWKQEIDILRTLYHEHIIKYKGCCEDQGLSSHEELLGDRGVLSPNLREPHTHSEDSP

SEQ ID NO: 94298 - protein, 135 aa, Homo sapiens
  Payload ID: 18803
  Gene Name: tyrosine kinase 2
  ENSP ID: ENSP00000466340
  MOD_RES (1)..(1): Any amino acid
XLGEGHFGKVSLYCYDPTNDGTGEMVAVKALKADCGPQHRSGWKQEIDILRTLYHEHIIKYKGCCEDQGHGLSARAALHPPRPSRAQRAAGQRQAGQDRGLWPSQGRARRPRVLPRARGWGQPRVLVCPRVPEGV

SEQ ID NO: 94299 - protein, 103 aa, Homo sapiens
  Payload ID: 18803
  Gene Name: tyrosine kinase 2
  ENSP ID: ENSP00000467288
MYPALWPETSSAIGSILAAREAGKCSPPVRPQHGQHTHCPLPRGNVRLKLQAQVWLPPNHILEIPRDASLMLYFRIRFYFRNWHGMNPREPAVYRCGPPGTEA

SEQ ID NO: 94300 - protein, 1138 aa, Homo sapiens
  Payload ID: 18804
  Gene Name: tyrosine kinase with immunoglobulin-like and EGF-like domains 1
  Uniprot ID: P35590
  ENSP ID: ENSP00000361554
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEACAPGHFGADCRLQCQCQNGGTCDRFSGCVCPSGWHGVHCEKSDRIPQILNMASELEFNLETMPRINCAAAGNPFPVRGSIELRKPDGTVLLSTKAIVEPEKTTAEFEVPRLVLADSGFWECRVSTSGGQDSRRFKVNVKVPPVPLAAPRLLTKQSRQLVVSPLVSFSGDGPISTVRLHYRPQDSTMDWSTIVVDPSENVTLMNLRPKTGYSVRVQLSRPGEGGEGAWGPPTLMTTDCPEPLLQPWLEGWHVEGTDRLRVSWSLPLVPGPLVGDGFLLRLWDGTRGQERRENVSSPQARTALLTGLTPGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 94301 - protein, 379 aa, Homo sapiens
  Payload ID: 18804
  Gene Name: tyrosine kinase with immunoglobulin-like and EGF-like domains 1
  Uniprot ID: P35590
  ENSP ID: ENSP00000440063
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEACAPGHFGADCRLQCQCQNGGTCDRFSGCVCPSGWHGVHCEKSGWRDWVDTSTEKQNTDEGRFGGHVSAPVGAPG

SEQ ID NO: 94302 - protein, 661 aa, Homo sapiens
  Payload ID: 18805
  Gene Name: tyrosine kinase, non-receptor, 1
  Uniprot ID: Q13470
  ENSP ID: ENSP00000458834
MLPEAGSLWLLKLLRDIQLAQFYWPILEELNVTRPEHFDFVKPEDLDGIGMGRPAQRRLSEALKRLRSGPKSKNWVYKILGGFAPEHKEPTLPSDSPRHLPEPEGGLKCLIPEGAVCRGELLGSGCFGVVHRGLWTLPSGKSVPVAVKSLRVGPEGPMGTELGDFLREVSVMMNLEHPHVLRLHGLVLGQPLQMVMELAPLGSLHARLTAPAPTPPLLVALLCLFLRQLAGAMAYLGARGLVHRDLATRNLLLASPRTIKVADFGLVRPLGGARGRYVMGGPRPIPYAWCAPESLRHGAFSSASDVWMFGVTLWEMFSGGEEPWAGVPPYLILQRLEDRARLPRPPLCSRALYSLALRCWAPHPADRPSFSHLEGLLQEAGPSEACCVRDVTEPGALRMETGDPITVIEGSPDSTIWKGQNGRTFKVGSFPASAVTLADAGGLPATRPVHRGTPARGDQHPGSIDGDRKKANLWDAPPARGQRRNMPLERMKGISRSLESVLSLGPRPTGGGSSPPEIRQARAVPQGPPGLPPRPPLSSSSPQPSQPSRERLPWPKRKPPHNHPMGMPGARKAAALSGGLLSDPELQRKIMEVELSVHGVTHQECQTALGATGGDVVSAIRNLKVDQLFHLSSRSRADCWRILEHYQWDLSAASRYVLARP

SEQ ID NO: 94303 - protein, 666 aa, Homo sapiens
  Payload ID: 18805
  Gene Name: tyrosine kinase, non-receptor, 1
  Uniprot ID: Q13470
  ENSP ID: ENSP00000459799
MLPEAGSLWLLKLLRDIQLAQFYWPILEELNVTRPEHFDFVKPEDLDGIGMGRPAQRRLSEALKRLRSGPKSKNWVYKILGGFAPEHKEPTLPSDSPRHLPEPEGGLKCLIPEGAVCRGELLGSGCFGVVHRGLWTLPSGKSVPVAVKSLRVGPEGPMGTELGDFLREVSVMMNLEHPHVLRLHGLVLGQPLQMVMELAPLGSLHARLTAPAPTPPLLVALLCLFLRQLAGAMAYLGARGLVHRDLATRNLLLASPRTIKVADFGLVRPLGGARGRYVMGGPRPIPYAWCAPESLRHGAFSSASDVWMFGVTLWEMFSGGEEPWAGVPPYLILQRLEDRARLPRPPLCSRALYSLALRCWAPHPADRPSFSHLEGLLQEAGPSEACCVRDVTEPGALRMETGDPITVIEGSSSFHSPDSTIWKGQNGRTFKVGSFPASAVTLADAGGLPATRPVHRGTPARGDQHPGSIDGDRKKANLWDAPPARGQRRNMPLERMKGISRSLESVLSLGPRPTGGGSSPPEIRQARAVPQGPPGLPPRPPLSSSSPQPSQPSRERLPWPKRKPPHNHPMGMPGARKAAALSGGLLSDPELQRKIMEVELSVHGVTHQECQTALGATGGDVVSAIRNLKVDQLFHLSSRSRADCWRILEHYQWDLSAASRYVLARP

SEQ ID NO: 94304 - protein, 84 aa, Homo sapiens
  Payload ID: 18805
  Gene Name: tyrosine kinase, non-receptor, 1
  ENSP ID: ENSP00000460146
TPRKHRWRQKEGKSLGCAPSTGPEEEHAPGEDESSPQPSQPSRERLPWPKRKPPHNHPMGMPGARKAAALSGGLLSDPELQRKI

SEQ ID NO: 94305 - protein, 3 aa, Homo sapiens
  Payload ID: 18805
  Gene Name: tyrosine kinase, non-receptor, 1
  ENSP ID: ENSP00000466590
  MOD_RES (1)..(1): Any amino acid
XAW

SEQ ID NO: 94306 - protein, 77 aa, Homo sapiens
  Payload ID: 18805
  Gene Name: tyrosine kinase, non-receptor, 1
  ENSP ID: ENSP00000475164
MLPEAGSLWLLKLLRDIQLAQFYWPILEELNVTRPEHFDFVKPEDLDGIGMGRPALILASHSPAQTVRSSEKATFWA

SEQ ID NO: 94307 - protein, 1038 aa, Homo sapiens
  Payload ID: 18806
  Gene Name: tyrosine kinase, non-receptor, 2
  Uniprot ID: Q07912
  ENSP ID: ENSP00000329425
MQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMAMVHGVTTEECQAALQCHGWSVQRAAQYLKVEQLFGLGLRPRGECHKVLEMFDWNLEQAGCHLLGSWGPAHHKR

SEQ ID NO: 94308 - protein, 1086 aa, Homo sapiens
  Payload ID: 18806
  Gene Name: tyrosine kinase, non-receptor, 2
  Uniprot ID: Q07912
  ENSP ID: ENSP00000371341
MLEARPPRTQGSDAAGAAAGRGLRALLLSLTAAAGIWGSMGERSAYQRLAGGEEGPQRLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKREPPPRPPQPAFFTQKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMVEQLFGLGLRPRGECHKVLEMFDWNLEQAGCHLLGSWGPAHHKR

SEQ ID NO: 94309 - protein, 143 aa, Homo sapiens
  Payload ID: 18806
  Gene Name: tyrosine kinase, non-receptor, 2
  ENSP ID: ENSP00000390088
MRSGALGPRGRGRASALGLPVPAMASRQCWARHPRVGLCWAAFEQESGPSCHRSEVKERLGGGRMQPEEGTGWLLELLSEVQLQQYFLRLRDDLNVTRLSHFEYVKNEDLEKIGMGRPGQRRLWEAVKRRKALCKRKSWMSKV

SEQ ID NO: 94310 - protein, 242 aa, Homo sapiens
  Payload ID: 18806
  Gene Name: tyrosine kinase, non-receptor, 2
  ENSP ID: ENSP00000390435
  MOD_RES (1)..(1): Any amino acid
XLWGLLPPGPPALAWNHSTCPPCLELLRRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPP

SEQ ID NO: 94311 - protein, 290 aa, Homo sapiens
  Payload ID: 18806
  Gene Name: tyrosine kinase, non-receptor, 2
  ENSP ID: ENSP00000392253
  MOD_RES (1)..(1): Any amino acid
XPEEGTGWLLELLSEVQLQQYFLRLRDDLNVTRLSHFEYVKNEDLEKIGMGRPGQRRLWEAVKRRKALCKRKSWMSKVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMV

SEQ ID NO: 94312 - protein, 1040 aa, Homo sapiens
  Payload ID: 18806
  Gene Name: tyrosine kinase, non-receptor, 2
  ENSP ID: ENSP00000392546
MPAARRFPGLELSFPLLARLRRRLYTRLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMVEQLFGLGLRPRGECHKVLEMFDWNLEQAGCHLLGSWGPAHHKR

SEQ ID NO: 94313 - protein, 86 aa, Homo sapiens
  Payload ID: 18806
  Gene Name: tyrosine kinase, non-receptor, 2
  ENSP ID: ENSP00000393707
MQPEEGTGWLLELLSEVQLQQYFLRLRDDLNVTRLSHFEYVKNEDLEKIGMGRPGQRRLWEAVKRRKALCKRKSWMSKDEGQPTPW

SEQ ID NO: 94314 - protein, 97 aa, Homo sapiens
  Payload ID: 18806
  Gene Name: tyrosine kinase, non-receptor, 2
  ENSP ID: ENSP00000395154
MQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQST

SEQ ID NO: 94315 - protein, 528 aa, Homo sapiens
  Payload ID: 18806
  Gene Name: tyrosine kinase, non-receptor, 2
  Uniprot ID: Q07912
  ENSP ID: ENSP00000395588
MQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDECPFSAFSPGHPPAETCGQVLWTGRREACASDPRLHPVSSRTKGL

SEQ ID NO: 94316 - protein, 607 aa, Homo sapiens
  Payload ID: 18806
  Gene Name: tyrosine kinase, non-receptor, 2
  ENSP ID: ENSP00000398614
LSAQDISQPLQNSFIHTGHGDSDPRHCWGFPDRIDELYLGNPMDPPDLLSVELSTSRPPQHLGGVKREPPPRPPQPAFFTQKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMLQAMVHGVTTEECQAALQCHGWSVQRAAQYLKVEQLFGLGLRPRGECHKVLEMFDWNLEQAGCHLLGSWGPAHHKR

SEQ ID NO: 94317 - protein, 143 aa, Homo sapiens
  Payload ID: 18806
  Gene Name: tyrosine kinase, non-receptor, 2
  ENSP ID: ENSP00000409462
VFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMASVSQIASRERPEKLQDS

SEQ ID NO: 94318 - protein, 200 aa, Homo sapiens
  Payload ID: 18806
  Gene Name: tyrosine kinase, non-receptor, 2
  ENSP ID: ENSP00000415126
VGPSRWFPVAAAGGALGAPSPWATSPGLEPQHLPSVPGAAQESLNISMFVWLPPSPCLQADGSVAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARV

SEQ ID NO: 94319 - protein, 1406 aa, Homo sapiens
  Payload ID: 18807
  Gene Name: Tyrosine-protein kinase SgK223  [Source:UniProtKB/Swiss-Prot
  Acc:Q86YV5]
  Uniprot ID: Q86YV5
  ENSP ID: ENSP00000479068
MHQTLCLNPESLKMSACSDFVEHIWKPGSCKNCFCLRSDHQLVAGPPQPRAGSLPPPPRLPPRPENCRLEDEGVNSSPYSKPTIAVKPTMMSSEASDVWTEANLSAEVSQVIWRRAPGKLPLPKQEDAPVVYLGSFRGVQKPAGPSTSPDGNSRCPPAYTMVGLHNLEPRGERNIAFHPVSFPEEKAVHKEKPSFPYQDRPSTQESFRQKLAAFAGTTSGCHQGPGPLRESLPSEDDSDQRCSPSGDSEGGEYCSILDCCPGSPVAKAASQTAGSRGRHGGRDCSPTCWEQGKCSGPAEQEKRGPSFPKECCSQGPTAHPSCLGPKKLSLTSEAAISSDGLSCGSGSGSGSGASSPFVPHLESDYCSLMKEPAPEKQQDPGCPGVTPSRCLGLTGEPQPPAHPREATQPEPIYAESTKRKKAAPVPSKSQAKIEHAAAAQGQGQVCTGNAWAQKAASGWGRDSPDPTPQVSATITVMAAHPEEDHRTIYLSSPDSAVGVQWPRGPVSQNSEVGEEETSAGQGLSSRESHAHSASESKPKERPAIPPKLSKSSPVGSPVSPSAGGPPVSPLADLSDGSSGGSSIGPQPPSQGPADPAPSCRTNGVAISDPSRCPQPAASSASEQRRPRFQAGTWSRQCRIEEEEEVEQELLSHSWGRETKNGPTDHSNSTTWHRLHPTDGSSGQNSKVGTGMSKSASFAFEFPKDRSGIETFSPPPPPPKSRHLLKMNKSSSDLEKVSQGSAESLSPSFRGVHVSFTTGSTDSLASDSRTCSDGGPSSELAHSPTNSGKKLFAPVPFPSGSTEDVSPSGPQQPPPLPQKKIVSRAASSPDGFFWTQGSPKPGTASPKLNLSHSETNVHDESHFSYSLSPGNRHHPVFSSSDPLEKAFKGSGHWLPAAGLAGNRGGCGSPGLQCKGAPSASSSQLSVSSQASTGSTQLQLHGLLSNISSKEGTYAKLGGLYTQSLARLVAKCEDLFMGGQKKELHFNENNWSLFKLTCNKPCCDSGDAIYYCATCSEDPGSTYAVKICKAPEPKTVSYCSPSVPVHFNIQQDCGHFVASVPSSMLSSPDAPKDPVPALPTHPPAQEQDCVVVITREVPHQTASDFVRDSAASHQAEPEAYERRVCFLLLQLCNGLEHLKEHGIIHRDLCLENLLLVHCTLQAGPGPAPAPAPAPAPAAAAPPCSSAAPPAGGTLSPAAGPASPEGPREKQLPRLIISNFLKAKQKPGGTPNLQQKKSQARLAPEIVSASQYRKFDEFQTGILIYELLHQPNPFEVRAQLRERDYRQEDLPPLPALSLYSPGLQQLAHLLLEADPIKRIRIGEAKRVLQCLLWGPRRELVQQPGTSEEALCGTLHNWIDMKRALMMMKFAEKAVDRRRGVELEDWLCCQYLASAEPGALLQSLKLLQLL

SEQ ID NO: 94320 - protein, 1406 aa, Homo sapiens; identical to SEQ ID NO: 94319
  Payload ID: 18807
  Gene Name: Tyrosine-protein kinase SgK223  [Source:UniProtKB/Swiss-Prot
  Acc:Q86YV5]
  Uniprot ID: Q86YV5
  ENSP ID: ENSP00000481109

SEQ ID NO: 94321 - protein, 608 aa, Homo sapiens
  Payload ID: 18808
  Gene Name: tyrosyl-DNA phosphodiesterase 1
  Uniprot ID: Q9NUW8
  ENSP ID: ENSP00000337353
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGIWLSPLYPRIADGTHKSGESPTHFKADLISYLMAYNAPSLKEWIDVIHKHDLSETNVYLIGSTPGRFQGSQKDNWGHFRLKKLLKDHASSMPNAESWPVVGQFSSVGSLGADESKWLCSEFKESMLTLGKESKTPGKSSVPLYLIYPSVENVRTSLEGYPAGGSLPYSIQTAEKQNWLHSYFHKWSAETSGRSNAMPHIKTYMRPSPDFSKIAWFLVTSANLSKAAWGALEKNGTQLMIRSYELGVLFLPSAFGLDSFKVKQKFFAGSQEPMATFPVPYDLPPELYGSKDRPWIWNIPYVKAPDTHGNMWVPS

SEQ ID NO: 94322 - protein, 589 aa, Homo sapiens
  Payload ID: 18808
  Gene Name: tyrosyl-DNA phosphodiesterase 1
  ENSP ID: ENSP00000377098
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGIWLSPLYPRIADGTHKSGESPTHFKADLISYLMAYNAPSLKEWIDVIHKHDLSETNVYLIGSTPGRFQGSQKDNWGHFRLKKLLKDHASSMPNAESWPVVGQFSSVGSLGADESKWLCSEFKESMLTLGKESKTPGKSSVPLYLIYPSVENVRTSLEGYPAGGSLPYSIQTAEKQNWLHSYFHKWSAETSGRSNAMPHIKTYMRPSPDFSKIAWFLVTSANLSKAAWGALEKNGTQLMIRSYELGVLFLPSAFAPAKRIKDEVEASFSGSRQFQSETEVLRWQPGANGHLSCAI

SEQ ID NO: 94323 - protein, 608 aa, Homo sapiens; identical to SEQ ID NO: 94321
  Payload ID: 18808
  Gene Name: tyrosyl-DNA phosphodiesterase 1
  Uniprot ID: Q9NUW8
  ENSP ID: ENSP00000377099

SEQ ID NO: 94324 - protein, 298 aa, Homo sapiens
  Payload ID: 18808
  Gene Name: tyrosyl-DNA phosphodiesterase 1
  ENSP ID: ENSP00000444587
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGTHL

SEQ ID NO: 94325 - protein, 578 aa, Homo sapiens
  Payload ID: 18808
  Gene Name: tyrosyl-DNA phosphodiesterase 1
  ENSP ID: ENSP00000450628
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGIWLSPLYPRIADGTHKSGESPTHFKADLISYLMAYNAPSLKEWIDVIHKHDLSETNVYLIGSTPGRFQGSQKDNWGHFRLKKLLKDHASSMPNAESWPVVGQFSSVGSLGADESKWLCSEFKESMLTLGKESKTPGKSSVPLYLIYPSVENVRTSLEGYPAGGSLPYSIQTAEKQNWLHSYFHKWSAETSGRSNAMPHIKTYMRPSPDFSKIAWFLVTSANLSKAAWGALEKNGTQLMIRSYELGVLFLPSAFIGHGYGTFLMSKHRIRMGTCGCPPENLEAL

SEQ ID NO: 94326 - protein, 219 aa, Homo sapiens
  Payload ID: 18808
  Gene Name: tyrosyl-DNA phosphodiesterase 1
  ENSP ID: ENSP00000450708
MPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGIWLSPLYPRIADGTHKSGESPTH

SEQ ID NO: 94327 - protein, 281 aa, Homo sapiens
  Payload ID: 18808
  Gene Name: tyrosyl-DNA phosphodiesterase 1
  ENSP ID: ENSP00000450795
  MOD_RES (1)..(1): Any amino acid
XRFQGSQKDNWGHFRLKKLLKDHASSMPNAESWPVVGQFSSVGSLGADESKWLCSEFKESMLTLGKESKTPGKSSVPLYLIYPSVENVRTSLEGYPAGGSLPYSIQTAEKQNWLHSYFHKWSAETSGRSNAMPHIKTYMRPSPDFSKIAWFLVTSANLSKAAWGALEKNGTQLMIRSYELGVLFLPSAFGLDSFKVKQKFFAGSQEPMATFPVPYDLPPELYGSKGETQIKENHGWICIRKTNRAQEKPLVSVGSWLMEPSGSSSLQRALCQPVWGLVATG

SEQ ID NO: 94328 - protein, 279 aa, Homo sapiens
  Payload ID: 18808
  Gene Name: tyrosyl-DNA phosphodiesterase 1
  ENSP ID: ENSP00000450872
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVI

SEQ ID NO: 94329 - protein, 146 aa, Homo sapiens
  Payload ID: 18808
  Gene Name: tyrosyl-DNA phosphodiesterase 1
  ENSP ID: ENSP00000451358
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYE

SEQ ID NO: 94330 - protein, 51 aa, Homo sapiens
  Payload ID: 18808
  Gene Name: tyrosyl-DNA phosphodiesterase 1
  ENSP ID: ENSP00000451767
AKLDIAFGTHHTKMMLLLYEEGLRVVIHTSNLIHADWHQKTQGHFVHLCLC

SEQ ID NO: 94331 - protein, 191 aa, Homo sapiens
  Payload ID: 18808
  Gene Name: tyrosyl-DNA phosphodiesterase 1
  ENSP ID: ENSP00000452042
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKGQSYE

SEQ ID NO: 94332 - protein, 161 aa, Homo sapiens
  Payload ID: 18808
  Gene Name: tyrosyl-DNA phosphodiesterase 1
  ENSP ID: ENSP00000452183
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKG

SEQ ID NO: 94333 - protein, 151 aa, Homo sapiens
  Payload ID: 18808
  Gene Name: tyrosyl-DNA phosphodiesterase 1
  ENSP ID: ENSP00000452279
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEG

SEQ ID NO: 94334 - protein, 147 aa, Homo sapiens
  Payload ID: 18808
  Gene Name: tyrosyl-DNA phosphodiesterase 1
  ENSP ID: ENSP00000452333
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYET

SEQ ID NO: 94335 - protein, 259 aa, Homo sapiens
  Payload ID: 18808
  Gene Name: tyrosyl-DNA phosphodiesterase 1
  ENSP ID: ENSP00000452363
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQENDAAAL

SEQ ID NO: 94336 - protein, 304 aa, Homo sapiens
  Payload ID: 18809
  Gene Name: tyrosyl-DNA phosphodiesterase 2
  ENSP ID: ENSP00000345345
MATWKSPCFLYCLFILGPRLTGQNNSVDLTNEETTDSTTSKISPSEDTQQENGSMFSLITWNIDGLDLNNLSERARGVCSYLALYSPDVIFLQEVIPPYYSYLKKRSSNYEIITGHEEGYFTAIMLKKSRVKLKSQEIIPFPSTKMMRNLLCVHVNVSGNELCLMTSHLESTRGHAAERMNQLKMVLKKMQEAPESATVIFAGDTNLRDREVTRCGGLPNNIVDVWEFLGKPKHCQYTWDTQMNSNLGITAACKLRFDRIFFRAAAEEGHIIPRSLDLLGLEKLDCGRFPSDHWGLLCNLDIIL

SEQ ID NO: 94337 - protein, 362 aa, Homo sapiens
  Payload ID: 18809
  Gene Name: tyrosyl-DNA phosphodiesterase 2
  Uniprot ID: O95551
  ENSP ID: ENSP00000367440
MELGSCLEGGREAAEEEGEPEVKKRRLLCVEFASVASCDAAVAQCFLAENDWEMERALNSYFEPPVEESALERRPETISEPKTYVDLTNEETTDSTTSKISPSEDTQQENGSMFSLITWNIDGLDLNNLSERARGVCSYLALYSPDVIFLQEVIPPYYSYLKKRSSNYEIITGHEEGYFTAIMLKKSRVKLKSQEIIPFPSTKMMRNLLCVHVNVSGNELCLMTSHLESTRGHAAERMNQLKMVLKKMQEAPESATVIFAGDTNLRDREVTRCGGLPNNIVDVWEFLGKPKHCQYTWDTQMNSNLGITAACKLRFDRIFFRAAAEEGHIIPRSLDLLGLEKLDCGRFPSDHWGLLCNLDIIL

SEQ ID NO: 94338 - protein, 370 aa, Homo sapiens
  Payload ID: 18810
  Gene Name: tyrosylprotein sulfotransferase 1
  Uniprot ID: O60507
  ENSP ID: ENSP00000302413
MVGKLKQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQAFLLEIIVKHGEPAPYLCNKDPFALKSLTYLSRLFPNAKFLLMVRDGRASVHSMISRKVTIAGFDLNSYRDCLTKWNRAIETMYNQCMEVGYKKCMLVHYEQLVLHPERWMRTLLKFLQIPWNHSVLHHEEMIGKAGGVSLSKVERSTDQVIKPVNVGALSKWVGKIPPDVLQDMAVIAPMLAKLGYDPYANPPNYGKPDPKIIENTRRVYKGEFQLPDFLKEKPQTEQVE

SEQ ID NO: 94339 - protein, 140 aa, Homo sapiens
  Payload ID: 18810
  Gene Name: tyrosylprotein sulfotransferase 1
  ENSP ID: ENSP00000391338
MVGKLKQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQA

SEQ ID NO: 94340 - protein, 41 aa, Homo sapiens
  Payload ID: 18810
  Gene Name: tyrosylprotein sulfotransferase 1
  ENSP ID: ENSP00000399642
MVGKLKQNLLLACLVISSVTVFYLGQHAMECHHRIEERSQP

SEQ ID NO: 94341 - protein, 377 aa, Homo sapiens
  Payload ID: 18811
  Gene Name: tyrosylprotein sulfotransferase 2
  Uniprot ID: O60704
  ENSP ID: ENSP00000339813
MRLSVRRVLLAAGCALVLVLAVQLGQQVLECRAVLAGLRSPRGAMRPEQEELVMVGTNHVEYRYGKAMPLIFVGGVPRSGTTLMRAMLDAHPEVRCGEETRIIPRVLAMRQAWSKSGREKLRLDEAGVTDEVLDAAMQAFILEVIAKHGEPARVLCNKDPFTLKSSVYLSRLFPNSKFLLMVRDGRASVHSMITRKVTIAGFDLSSYRDCLTKWNKAIEVMYAQCMEVGKEKCLPVYYEQLVLHPRRSLKLILDFLGIAWSDAVLHHEDLIGKPGGVSLSKIERSTDQVIKPVNLEALSKWTGHIPGDVVRDMAQIAPMLAQLGYDPYANPPNYGNPDPFVINNTQRVLKGDYKTPANLKGYFQVNQNSTSSHLGSS

SEQ ID NO: 94342 - protein, 377 aa, Homo sapiens; identical to SEQ ID NO: 94341
  Payload ID: 18811
  Gene Name: tyrosylprotein sulfotransferase 2
  Uniprot ID: O60704
  ENSP ID: ENSP00000381180

SEQ ID NO: 94343 - protein, 377 aa, Homo sapiens; identical to SEQ ID NO: 94341
  Payload ID: 18811
  Gene Name: tyrosylprotein sulfotransferase 2
  Uniprot ID: O60704
  ENSP ID: ENSP00000385192

SEQ ID NO: 94344 - protein, 120 aa, Homo sapiens
  Payload ID: 18811
  Gene Name: tyrosylprotein sulfotransferase 2
  ENSP ID: ENSP00000400357
MRLSVRRVLLAAGCALVLVLAVQLGQQVLECRAVLAGLRSPRGAMRPEQEELVMVGTNHVEYRYGKAMPLIFVGGVPRSGTTLMRAMLDAHPEVRCGEETRIIPRVLAMRQAWSKSGREK

SEQ ID NO: 94345 - protein, 48 aa, Homo sapiens
  Payload ID: 18811
  Gene Name: tyrosylprotein sulfotransferase 2
  ENSP ID: ENSP00000401134
MRLSVRRVLLAAGCALVLVLAVQLGQQVLECRAVLAGLRSPRGAMRPE

SEQ ID NO: 94346 - protein, 168 aa, Homo sapiens
  Payload ID: 18811
  Gene Name: tyrosylprotein sulfotransferase 2
  ENSP ID: ENSP00000403758
DFLGIAWSDAVLHHEDLIGKPGGVSLSKIERSTDQVIKPVNLEALSKWTGHIPGDVVRDMAQIAPMLAQLGYDPYANPPNYGNPDPFVINNTQRVSVHLYLWKCTLGDMGLLQMWKLQPPEEMFSLSIPGHLICSCLMDTVNYMIACISILLGLQGSSKPTGSLSLIL

SEQ ID NO: 94347 - protein, 141 aa, Homo sapiens
  Payload ID: 18811
  Gene Name: tyrosylprotein sulfotransferase 2
  ENSP ID: ENSP00000403875
MRLSVRRVLLAAGCALVLVLAVQLGQQVLECRAVLAGLRSPRGAMRPEQEELVMVGTNHVEYRYGKAMPLIFVGGVPRSGTTLMRAMLDAHPEVRCGEETRIIPRVLAMRQAWSKSGREKLRLDEAGVTDEVLDAAMQAFI

SEQ ID NO: 94348 - protein, 47 aa, Homo sapiens
  Payload ID: 18811
  Gene Name: tyrosylprotein sulfotransferase 2
  ENSP ID: ENSP00000414809
MRLSVRRVLLAAGCALVLVLAVQLGQQVLECRAVLAGLRSPRGAMRP

SEQ ID NO: 94349 - protein, 64 aa, Homo sapiens
  Payload ID: 18811
  Gene Name: tyrosylprotein sulfotransferase 2
  ENSP ID: ENSP00000416791
MRLSVRRVLLAAGCALVLVLAVQLGQQVLECRAVLAGLRSPRGAMRPEQEELVMVGTNHVEYRY

SEQ ID NO: 94350 - protein, 528 aa, Homo sapiens
  Payload ID: 18812
  Gene Name: tyrosyl-tRNA synthetase
  Uniprot ID: P54577
  ENSP ID: ENSP00000362576
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQADFKISEECIAQWKQTNFMTKLGSISCKSLKGGNIS

SEQ ID NO: 94351 - protein, 388 aa, Homo sapiens
  Payload ID: 18812
  Gene Name: tyrosyl-tRNA synthetase
  ENSP ID: ENSP00000484192
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGLPRIQNQRRSSHPGWISVWGKSSLWRSTQMQTACM

SEQ ID NO: 94352 - protein, 477 aa, Homo sapiens
  Payload ID: 18813
  Gene Name: tyrosyl-tRNA synthetase 2, mitochondrial
  Uniprot ID: Q9Y2Z4
  ENSP ID: ENSP00000320658
MAAPILRSFSWGRWSGTLNLSVLLPLGLRKAHSGAQGLLAAQKARGLFKDFFPETGTKIELPELFDRGTASFPQTIYCGFDPTADSLHVGHLLALLGLFHLQRAGHNVIALVGGATARLGDPSGRTKEREALETERVRANARALRLGLEALAANHQQLFTDGRSWGSFTVLDNSAWYQKQHLVDFLAAVGGHFRMGTLLSRQSVQLRLKSPEGMSLAEFFYQVLQAYDFYYLFQRYGCRVQLGGSDQLGNIMSGYEFINKLTGEDVFGITVPLITSTTGAKLGKSAGNAVWLNRDKTSPFELYQFFVRQPDDSVERYLKLFTFLPLPEIDHIMQLHVKEPERRGPQKRLAAEVTKLVHGREGLDSAKRCTQALYHSSIDALEVMSDQELKELFKEAPFSEFFLDPGTSVLDTCRKANAIPDGPRGYRMITEGGVSINHQQVTNPESVLIVGQHILKNGLSLLKIGKRNFYIIKWLQL

SEQ ID NO: 94353 - protein, 291 aa, Homo sapiens
  Payload ID: 18813
  Gene Name: tyrosyl-tRNA synthetase 2, mitochondrial
  ENSP ID: ENSP00000447710
GLRKAHSGAQGLLAAQKARGLFKDFFPETGTKIELPELFDRGTASFPQTIYCGFDPTADSLHVGHLLALLGLFHLQRAGHNVIALVGGATARLGDPSGRTKEREALETERVRANARALRLGLEALAANHQQLFTDGRSWGSFTVLDNSAWYQKQHLVDFLAAVGGHFRMGTLLSRQSVQLRLKSPEGMSLAEFFYQVLQAYDFYYLFQRYGCRVQLGGSDQLGNIMSGYEFINKLTGEDVFGITVPLITSTTGAKLGKSAGNAVWLNRDKTSPFELYQFFVRQPDDSVERD

SEQ ID NO: 94354 - protein, 240 aa, Homo sapiens
  Payload ID: 18814
  Gene Name: U2 small nuclear RNA auxiliary factor 1
  Uniprot ID: Q01081
  ENSP ID: ENSP00000291552
MAEYLASIFGTEKDKVNCSFYFKIGACRHGDRCSRLHNKPTFSQTIALLNIYRNPQNSSQSADGLRCAVSDVEMQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 94355 - protein, 240 aa, Homo sapiens
  Payload ID: 18814
  Gene Name: U2 small nuclear RNA auxiliary factor 1
  Uniprot ID: Q01081
  ENSP ID: ENSP00000369629
MAEYLASIFGTEKDKVNCSFYFKIGACRHGDRCSRLHNKPTFSQTILIQNIYRNPQNSAQTADGSHCAVSDVEMQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 94356 - protein, 167 aa, Homo sapiens
  Payload ID: 18814
  Gene Name: U2 small nuclear RNA auxiliary factor 1
  Uniprot ID: Q01081
  ENSP ID: ENSP00000381205
MQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 94357 - protein, 167 aa, Homo sapiens; identical to SEQ ID NO: 94356
  Payload ID: 18814
  Gene Name: U2 small nuclear RNA auxiliary factor 1
  Uniprot ID: Q01081
  ENSP ID: ENSP00000418705

SEQ ID NO: 94358 - protein, 75 aa, Homo sapiens
  Payload ID: 18814
  Gene Name: U2 small nuclear RNA auxiliary factor 1
  Uniprot ID: Q01081
  ENSP ID: ENSP00000420672
MAEYLASIFGTEKDKVNCSFYFKIGACRHGDRCSRLHNKPTFSQTILIQNIYRNPQNSAQTADGSHYHCPLEHLP

SEQ ID NO: 94359 - protein, 202 aa, Homo sapiens
  Payload ID: 18815
  Gene Name: U2 small nuclear RNA auxiliary factor 1-like 4
  Uniprot ID: Q8WU68
  ENSP ID: ENSP00000292879
MAEYLASIFGTEKDKVNCSFYFKIGVCRHGDRCSRLHNKPTFSQEVFTELQEKYGEIEEMNVCDNLGDHLVGNVYVKFRREEDGERAVAELSNRWFNGQAVHGNVPEVASATSCICGPFPRTSRGSSMGGDPGAGHPRGSILATIPERGTIGVPLITGMAASEALAPLPFTPNRDRCSWQDLSSKPPSLSCPILPRLPGSIM

SEQ ID NO: 94360 - protein, 181 aa, Homo sapiens
  Payload ID: 18815
  Gene Name: U2 small nuclear RNA auxiliary factor 1-like 4
  Uniprot ID: Q8WU68
  ENSP ID: ENSP00000368258
MAEYLASIFGTEKDKVNCSFYFKIGVCRHGDRCSRLHNKPTFSQEVFTELQEKYGEIEEMNVCDNLGDHLVGNVYVKFRREEDGERAVAELSNRWFNGQAVHGELSPVTDFRESCCRQYEMGECTRGGFCNFMHLRPISQNLQRQLYGRGPRRRSPPRFHTGHHPRERNHRCSPDHWHGRF

SEQ ID NO: 94361 - protein, 220 aa, Homo sapiens
  Payload ID: 18815
  Gene Name: U2 small nuclear RNA auxiliary factor 1-like 4
  Uniprot ID: Q8WU68
  ENSP ID: ENSP00000397645
MAEYLASIFGTEKDKVNCSFYFKIGVCRHGDRCSRLHNKPTFSQTIVLLNLYRNPQNTAQTADGSHCHVSDVEVQEHYDSFFEEVFTELQEKYGEIEEMNVCDNLGDHLVGNVYVKFRREEDGERAVAELSNRWFNGQAVHGELSPVTDFRESCCRQYEMGECTRGGFCNFMHLRPISQNLQRQLYGRGPRRRSPPRFHTGHHPRERNHRCSPDHWHGRF

SEQ ID NO: 94362 - protein, 39 aa, Homo sapiens
  Payload ID: 18815
  Gene Name: U2 small nuclear RNA auxiliary factor 1-like 4
  ENSP ID: ENSP00000465170
MAEYLASIFGTEKDKSGSAGTGTGAPGFTTSRHSASPAL

SEQ ID NO: 94363 - protein, 51 aa, Homo sapiens
  Payload ID: 18815
  Gene Name: U2 small nuclear RNA auxiliary factor 1-like 4
  ENSP ID: ENSP00000465242
MAEYLASIFGTEKDKSGSAGTGTGAPGFTTSRHSARRCSQNCRRSMGRLKR

SEQ ID NO: 94364 - protein, 10 aa, Homo sapiens
  Payload ID: 18815
  Gene Name: U2 small nuclear RNA auxiliary factor 1-like 4
  ENSP ID: ENSP00000467441
MNVCDNLGDH

SEQ ID NO: 94365 - protein, 66 aa, Homo sapiens
  Payload ID: 18815
  Gene Name: U2 small nuclear RNA auxiliary factor 1-like 4
  ENSP ID: ENSP00000469891
MAEYLASIFGTEKDKVNCSFYFKIGVCRHGDRCSRLHNKPTFSQTIVLLNLYRNPQNTAQTADGSH

SEQ ID NO: 94366 - protein, 33 aa, Homo sapiens
  Payload ID: 18815
  Gene Name: U2 small nuclear RNA auxiliary factor 1-like 4
  ENSP ID: ENSP00000471804
SRLHNKPTFSQTIVLLNLYRNPQNTAQTADGSH

SEQ ID NO: 94367 - protein, 36 aa, Homo sapiens
  Payload ID: 18815
  Gene Name: U2 small nuclear RNA auxiliary factor 1-like 4
  ENSP ID: ENSP00000473940
SAAQPVPESTEHSPNCRRITLRCSQNCRRSMGRLKR

SEQ ID NO: 94368 - protein, 71 aa, Homo sapiens
  Payload ID: 18815
  Gene Name: U2 small nuclear RNA auxiliary factor 1-like 4
  ENSP ID: ENSP00000474493
  MOD_RES (1)..(1): Any amino acid
XRHGDRCSRLHNKPTFSQPCPLSSGPAPFKFCADHSAAQPVPESTEHSPNCRRITLRCSQNCRRSMGRLKR

SEQ ID NO: 94369 - protein, 40 aa, Homo sapiens
  Payload ID: 18815
  Gene Name: U2 small nuclear RNA auxiliary factor 1-like 4
  ENSP ID: ENSP00000475046
CADHSAAQPVPESTEHSPNCRRITLRCSQNCRRSMGRLKR

SEQ ID NO: 94370 - protein, 75 aa, Homo sapiens; identical to SEQ ID NO: 94358
  Payload ID: 18816
  Gene Name: U2 small nuclear RNA auxiliary factor 1-like 5
  ENSP ID: ENSP00000480611

SEQ ID NO: 94371 - protein, 240 aa, Homo sapiens; identical to SEQ ID NO: 94355
  Payload ID: 18816
  Gene Name: U2 small nuclear RNA auxiliary factor 1-like 5
  ENSP ID: ENSP00000482964

SEQ ID NO: 94372 - protein, 240 aa, Homo sapiens; identical to SEQ ID NO: 94354
  Payload ID: 18816
  Gene Name: U2 small nuclear RNA auxiliary factor 1-like 5
  ENSP ID: ENSP00000485022

SEQ ID NO: 94373 - protein, 167 aa, Homo sapiens; identical to SEQ ID NO: 94356
  Payload ID: 18816
  Gene Name: U2 small nuclear RNA auxiliary factor 1-like 5
  ENSP ID: ENSP00000485382

SEQ ID NO: 94374 - protein, 475 aa, Homo sapiens
  Payload ID: 18817
  Gene Name: U2 small nuclear RNA auxiliary factor 2
  Uniprot ID: P26368
  ENSP ID: ENSP00000307863
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEEAMMDFFNAQMRLGGLTQAPGNPVLAVQINQDKNFAFLEFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQAIAGLNGMQLGDKKLLVQRASVGAKNATLVSPPSTINQTPVTLQVPGLMSSQVQMGGHPTEVLCLMNMVLPEELLDDEEYEEIVEDVRDECSKYGLVKSIEIPRPVDGVEVPGCGKIFVEFTSVFDCQKAMQGLTGRKFANRVVVTKYCDPDSYHRRDFW

SEQ ID NO: 94375 - protein, 471 aa, Homo sapiens
  Payload ID: 18817
  Gene Name: U2 small nuclear RNA auxiliary factor 2
  Uniprot ID: P26368
  ENSP ID: ENSP00000388475
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEEAMMDFFNAQMRLGGLTQAPGNPVLAVQINQDKNFAFLEFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQAIAGLNGMQLGDKKLLVQRASVGAKNATLSTINQTPVTLQVPGLMSSQVQMGGHPTEVLCLMNMVLPEELLDDEEYEEIVEDVRDECSKYGLVKSIEIPRPVDGVEVPGCGKIFVEFTSVFDCQKAMQGLTGRKFANRVVVTKYCDPDSYHRRDFW

SEQ ID NO: 94376 - protein, 86 aa, Homo sapiens
  Payload ID: 18817
  Gene Name: U2 small nuclear RNA auxiliary factor 2
  ENSP ID: ENSP00000466167
  MOD_RES (1)..(1): Any amino acid
XRSPRHEKKKKVRKYWDVPPPGFEHITPMQYKAMQAAGQIPATALLPTMTPDGLAVTPTPVPVVGSQMTRQARRLYVGNIPFGITE

SEQ ID NO: 94377 - protein, 307 aa, Homo sapiens
  Payload ID: 18817
  Gene Name: U2 small nuclear RNA auxiliary factor 2
  ENSP ID: ENSP00000466935
MMDFFNAQMRLGGLTQAPGNPVLAVQINQDKNFAFLEFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQAIAGLNGMQLGDKKLLVQRASVGAKNATLSTINQTPVTLQVPGLMSSQVQMGGHPTEVLCLMNMVLPEELLDDEEYEEIVEDVRDECSKYGLVKSIEIPRPVDGVEVPGCGKIFVEFTSVFDCQKAMQGLTGRKFANRVVVTKYCDPDSYHRRDFW

SEQ ID NO: 94378 - protein, 51 aa, Homo sapiens
  Payload ID: 18817
  Gene Name: U2 small nuclear RNA auxiliary factor 2
  ENSP ID: ENSP00000470020
  MOD_RES (1)..(1): Any amino acid
XDFDEFERQLNENKQASSPAPLRDDPGVRPLSPRGGPGASLLCLLWLPSSS

SEQ ID NO: 94379 - protein, 290 aa, Homo sapiens
  Payload ID: 18818
  Gene Name: U2 snRNP-associated SURP domain containing
  ENSP ID: ENSP00000418220
  MOD_RES (1)..(1): Any amino acid
XIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERSPSGSRTPKRSRRSRSRSPKKSGKKSRSQSRSPHRSHKKSKKNKH

SEQ ID NO: 94380 - protein, 161 aa, Homo sapiens
  Payload ID: 18818
  Gene Name: U2 snRNP-associated SURP domain containing
  ENSP ID: ENSP00000418465
MADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPS

SEQ ID NO: 94381 - protein, 1029 aa, Homo sapiens
  Payload ID: 18818
  Gene Name: U2 snRNP-associated SURP domain containing
  Uniprot ID: O15042
  ENSP ID: ENSP00000418563
MADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 94382 - protein, 439 aa, Homo sapiens
  Payload ID: 18818
  Gene Name: U2 snRNP-associated SURP domain containing
  ENSP ID: ENSP00000420210
LKMADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERRNSYYCHEHWTY

SEQ ID NO: 94383 - protein, 130 aa, Homo sapiens
  Payload ID: 18818
  Gene Name: U2 snRNP-associated SURP domain containing
  ENSP ID: ENSP00000420575
MDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKP

SEQ ID NO: 94384 - protein, 1028 aa, Homo sapiens
  Payload ID: 18818
  Gene Name: U2 snRNP-associated SURP domain containing
  ENSP ID: ENSP00000422011
MADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQANSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 94385 - protein, 425 aa, Homo sapiens
  Payload ID: 18818
  Gene Name: U2 snRNP-associated SURP domain containing
  ENSP ID: ENSP00000430816
MADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKEFARPDTSNDRVCCT

SEQ ID NO: 94386 - protein, 125 aa, Homo sapiens
  Payload ID: 18818
  Gene Name: U2 snRNP-associated SURP domain containing
  ENSP ID: ENSP00000475195
MAWFYCNCKKMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAK

SEQ ID NO: 94387 - protein, 419 aa, Homo sapiens
  Payload ID: 18819
  Gene Name: U2AF homology motif (UHM) kinase 1
  Uniprot ID: Q8TAS1
  ENSP ID: ENSP00000420270
MAGSGCAWGAEPPRFLEAFGRLWQVQSRLGSGSSASVYRVRCCGNPGSPPGALKQFLPPGTTGAAASAAEYGFRKERAALEQLQGHRNIVTLYGVFTIHFSPNVPSRCLLLELLDVSVSELLLYSSHQGCSMWMIQHCARDVLEALAFLHHEGYVHADLKPRNILWSAENECFKLIDFGLSFKEGNQDVKYIQTDGYRAPEAELQNCLAQAGLQSDTECTSAVDLWSLGIILLEMFSGMKLKHTVRSQEWKANSSAIIDHIFASKAVVNAAIPAYHLRDLIKSMLHDDPSRRIPAEMALCSPFFSIPFAPHIEDLVMLPTPVLRLLNVLDDDYLENEEEYEDVVEDVKEECQKYGPVVSLLVPKENPGRGQVFVEYANAGDSKAAQKLLTGRMFDGKFVVATFYPLSAYKRGYLYQTLL

SEQ ID NO: 94388 - protein, 345 aa, Homo sapiens
  Payload ID: 18819
  Gene Name: U2AF homology motif (UHM) kinase 1
  Uniprot ID: Q8TAS1
  ENSP ID: ENSP00000441226
MFLTRPKVCVDLNRRVTLYGVFTIHFSPNVPSRCLLLELLDVSVSELLLYSSHQGCSMWMIQHCARDVLEALAFLHHEGYVHADLKPRNILWSAENECFKLIDFGLSFKEGNQDVKYIQTDGYRAPEAELQNCLAQAGLQSDTECTSAVDLWSLGIILLEMFSGMKLKHTVRSQEWKANSSAIIDHIFASKAVVNAAIPAYHLRDLIKSMLHDDPSRRIPAEMALCSPFFSIPFAPHIEDLVMLPTPVLRLLNVLDDDYLENEEEYEDVVEDVKEECQKYGPVVSLLVPKENPGRGQVFVEYANAGDSKAAQKLLTGRMFDGKFVVATFYPLSAYKRGYLYQTLL

SEQ ID NO: 94389 - protein, 344 aa, Homo sapiens
  Payload ID: 18819
  Gene Name: U2AF homology motif (UHM) kinase 1
  Uniprot ID: Q8TAS1
  ENSP ID: ENSP00000446416
MAGSGCAWGAEPPRFLEAFGRLWQVQSRLGSGSSASVYRVRCCGNPGSPPGALKQFLPPGTTGAAASAAEYGFRKERAALEQLQGHRNIVTLYGVFTIHFSPNVPSRCLLLELLDVSVSELLLYSSHQGCSMWMIQHCARDVLEALAFLHHEGYVHADLKPRNILWSAENECFKLIDFGLSFKEGNQDVKYIQTDGYRAPEAELQNCLAQAGLQSDTECTSAVDLWSLGIILLEMFSGMKLKHTVRSQEWKANSSAIIDHIFASKAVVNAAIPAYHLRDLIKSMLHDDPSRRIPAEMALCSPFFSIPFAPHIEDLVMLPTPVLRLLNVLDDDYLENEEEYEGLC

SEQ ID NO: 94390 - protein, 177 aa, Homo sapiens [sequence omitted]

SEQ ID NO: 94391 - protein, 265 aa, Homo sapiens
  Payload ID: 18821
  Gene Name: U6 snRNA biogenesis 1
  Uniprot ID: Q9BQ65
  ENSP ID: ENSP00000219281
MSAAPLVGYSSSGSEDESEDGMRTRPGDGSHRRGQSPLPRQRFPVPDSVLNMFPGTEEGPEDDSTKHGGRVRTFPHERGNWATHVYVPYEAKEEFLDLLDVLLPHAQTYVPRLVRMKVFHLSLSQSVVLRHHWILPFVQALKARMTSFHRFFFTANQVKIYTNQEKTRTFIGLEVTSGHAQFLDLVSEVDRVMEEFNLTTFYQDPSFHLSLAWCVGDARLQLEGQCLQELQAIVDGFEDAEVLLRVHTEQVRCKSGNKFFSMPLK

SEQ ID NO: 94392 - protein, 186 aa, Homo sapiens
  Payload ID: 18821
  Gene Name: U6 snRNA biogenesis 1
  Uniprot ID: Q9BQ65
  ENSP ID: ENSP00000409792
MSAAPLVGYSSSGSEDESEDGMRTRPGDGSHRRGQSPLPRQRFPVPDSVLNMFPGTEEGPEDDSTKHGGRVRTFPHERGNWATHVYVPYEAKEEFLDLLDVLLPHAQTYVPRLVRMKVFHLSLSQSVVLRHHWILPFVQALKARMTSFHSPHPGPHCLIGTKDAPVTQEIPKDLGALRQEPGSQTR

SEQ ID NO: 94393 - protein, 247 aa, Homo sapiens
  Payload ID: 18821
  Gene Name: U6 snRNA biogenesis 1
  Uniprot ID: Q9BQ65
  ENSP ID: ENSP00000446143
MSAAPLVGYSSSGSEDESEDGMRTRPGDGSHRRGQSPLPRQRFPVPDSVLNMFPGTEEGPEDDSTKHGGRVRTFPHERGNWATHVYVPYEAKEEFLDLLDVLLPHAQTYVPRLVRMKVFHLSLSQSVVLRHHWILPFVQALKARMTSFHRTFIGLEVTSGHAQFLDLVSEVDRVMEEFNLTTFYQDPSFHLSLAWCVGDARLQLEGQCLQELQAIVDGFEDAEVLLRVHTEQVRCKSGNKFFSMPLK

SEQ ID NO: 94394 - protein, 163 aa, Homo sapiens
  Payload ID: 18821
  Gene Name: U6 snRNA biogenesis 1
  ENSP ID: ENSP00000454692
MSAAPLVGYSSSGSEDESEDGMRTRPGDGSHRRGQSPLPRQRFPVPDSVLNMFPGTEEGPEDDSTKHGGRVRTFPHERGNWATHVYVPYEAKEEFLDLLDVLLPHAQTYVPRLVRMKVFHLSLSQSVVLRHHWILPFVQALKARMTSFHRCQKPMPEAQPKVA

SEQ ID NO: 94395 - protein, 214 aa, Homo sapiens
  Payload ID: 18821
  Gene Name: U6 snRNA biogenesis 1
  ENSP ID: ENSP00000454928
MFPGTEEGPEDDSTKHGGRVRTFPHERGNWATHVYVPYEAKEEFLDLLDVLLPHAQTYVPRLVRMKVFHLSLSQSVVLRHHWILPFVQALKARMTSFHRFFFTANQVKIYTNQEKTRTFIGLEVTSGHAQFLDLVSEVDRVMEEFNLTTFYQDPSFHLSLAWCVGDARLQLEGQCLQELQAIVDGFEDAEVLLRVHTEQVRCKSGNKFFSMPLK

SEQ ID NO: 94396 - protein, 95 aa, Homo sapiens
  Payload ID: 18821
  Gene Name: U6 snRNA biogenesis 1
  ENSP ID: ENSP00000457302
MSAAPLVGYSSSGSEDESEDGMRTRPGDGSHRRGQSPLPRQRFPVPDSVLNMFPGTEEGPEDDSTKHGGRMKPRRSSWICLMCCCPMPRHMSPGW

SEQ ID NO: 94397 - protein, 182 aa, Homo sapiens
  Payload ID: 18821
  Gene Name: U6 snRNA biogenesis 1
  ENSP ID: ENSP00000457322
MSPRTGCGPGRGMGATVGEDGQSPLPRQRFPVPDSVLNMFPGTEEGPEDDSTKHGGRVRTFPHERGNWATHVYVPYEAKEEFLDLLDVLLPHAQTYVPRLVRMKVFHLSLSQSVVLRHHWILPFVQALKARMTSFHRFFFTANQVKIYTNQEKTRTFIGLEVTSGHAQFLDLVSEVDRVMEE

SEQ ID NO: 94398 - protein, 369 aa, Homo sapiens
  Payload ID: 18822
  Gene Name: U82695.5
  ENSP ID: ENSP00000488404
MALAMLRDWCRWMGANAERSLLILGIPDDCKEHEFQEAVRAALSPLGRREQPGCEEESFESWVEHAKDMLQLWCHASEREKKRWLLESLGGPALEVVSGLLEEDTNLSALDCLAALGQVFRNQDTRMTSRLKFLTCTQGPQEGLFAFVVRLEGLLQRAVEKGAVCPALANYLRLQQVLSWARPSEALQDTLRGMQLEKRPPGFLGLLRLIREMEAWAAFPARSQQGVAWAAAPVESEDPAAAQASPAQGNASEAGPGAEDAAEAASATKEAARGAPAAGEGESAPAGPEGLGQARPIEVPWGSSPARMSSAVWVFPRGLSWGPEGLIQVRGQEARKPPLEGLQTILEEPENEDEDGAGDEGQPKSSQGK

SEQ ID NO: 94399 - protein, 647 aa, Homo sapiens
  Payload ID: 18822
  Gene Name: U82695.5
  ENSP ID: ENSP00000488500
MALAMLRDWCRWMGANAERSLLILGIPDDCKEHEFQEAVRAALSPLGRYRVLTKHFRKELGAKAALVEFAEYLNRSLIPHQIPGNGGPWKVIFLPQVPVIEFQDMPSFPAQPQGQAVAKAAGEGGGAGEAGGVGEVGAAGEAGGTGEAGATGEAGAAGEAGGAGEAGGVGEAGAAGEAGGAGEAGAAGEGGAAGEAGGAGEAGGVGEAGAAGEAGGAGEAGGVGEAGAAGEAGGAGEAGAAGEAGGAGEGRAAGEAGAAGEAGAVGEAGAAGEAGAVGEAGAAGEAGAVGEAGGTNVTKAWVQPWRCTLQPVLENRAYRELRPFSRREQPGCEEESFESWVEHAKDMLQLWCHASEREKKRWLLESLGGPALEVVSGLLEEDTNLSALDCLAALGQVFRNQDTRMTSRLKFLTCTQGPQEGLFAFVVRLEGLLQRAVEKGAVCPALANYLRLQQVLSWARPSEALQDTLRGMQLEKRPPGFLGLLRLIREMEAWAAFPARSQQGVAWAAAPVESEDPAAAQASPAQGNASEAGPGAEDAAEAASATKEAARGAPAAGEGESAPAGPEGLGQARPIEVPWGSSPARMSSAVWVFPRGLSWGPEGLIQVRGQEARKPPLEGLQTILEEPENEDEDGAGDEGQPKSSQGK

SEQ ID NO: 94400 - protein, 405 aa, Homo sapiens
  Payload ID: 18823
  Gene Name: UBA domain containing 1
  Uniprot ID: Q9BSL1
  ENSP ID: ENSP00000360821
MFVQEEKIFAGKVLRLHICASDGAEWLEEATEDTSVEKLKERCLKHCAHGSLEDPKSITHHKLIHAASERVLSDARTILEENIQDQDVLLLIKKRAPSPLPKMADVSAEEKKKQDQKAPDKEAILRATANLPSYNMDRAAVQTNMRDFQTELRKILVSLIEVAQKLLALNPDAVELFKKANAMLDEDEDERVDEAALRQLTEMGFPENRATKALQLNHMSVPQAMEWLIEHAEDPTIDTPLPGQAPPEAEGATAAASEAAAGASATDEEARDELTEIFKKIRRKREFRADARAVISLMEMGFDEKEVIDALRVNNNQQNAACEWLLGDRKPSPEELDKGIDPDSPLFQAILDNPVVQLGLTNPKTLLAFEDMLENPLNSTQWMNDPETGPVMLQISRIFQTLNRT

SEQ ID NO: 94401 - protein, 204 aa, Homo sapiens
  Payload ID: 18824
  Gene Name: UBA domain containing 2
  ENSP ID: ENSP00000347928
MFTSTGSSGLYKAPLSKSLLLVPSALSLLLALLLPHCQKLFVYDLHAVKNDFQMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVAT

SEQ ID NO: 94402 - protein, 309 aa, Homo sapiens
  Payload ID: 18824
  Gene Name: UBA domain containing 2
  Uniprot ID: Q8NBM4
  ENSP ID: ENSP00000365623
MCFFFSLQEEFLDKHTLMRVLSSGGKLGSRGEGAQLCCWMLLFSWRVSGGQQTRRLCRRAFCWSPVPSPSCSPSSCLTARSSLCMTFTQSRTTSSLAPVFALFVPFYCSIPRVQVAQILGPLSITNKTLIYILGLQLFTSGSYIWIVAISGLMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVATNFLLQH

SEQ ID NO: 94403 - protein, 344 aa, Homo sapiens
  Payload ID: 18824
  Gene Name: UBA domain containing 2
  Uniprot ID: Q8NBM4
  ENSP ID: ENSP00000383911
MFTSTGSSGLYKAPLSKSLLLVPSALSLLLALLLPHCQKLFVYDLHAVKNDFQIWRLICGRIICLDLKDTFCSSLLIYNFRIFERRYGSRKFASFLLGSWVLSALFDFLLIEAMQYFFGITAASNLPSGFLAPVFALFVPFYCSIPRVQVAQILGPLSITNKTLIYILGLQLFTSGSYIWIVAISGLMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVATNFLLQH

SEQ ID NO: 94404 - protein, 135 aa, Homo sapiens
  Payload ID: 18824
  Gene Name: UBA domain containing 2
  ENSP ID: ENSP00000402249
MGTKPRRPPRPHLVSPDKAPLSKSLLLVPSALSLLLALLLPHCQKLFVYDLHAVKNDFQIWRLICGRIICLDLKDTFCSSLLIYNFRIFERRYGSRKFASFLLGSWVLSALFDFLLIEAMQYFFGITAASNLPSG

SEQ ID NO: 94405 - protein, 43 aa, Homo sapiens
  Payload ID: 18824
  Gene Name: UBA domain containing 2
  ENSP ID: ENSP00000481260
GGMINWNRLFPPLRQRQNVNYQGGRQSEPAAPPLEVSEEQTNE

SEQ ID NO: 94406 - protein, 177 aa, Homo sapiens
  Payload ID: 18825
  Gene Name: UBA-like domain containing 1
  Uniprot ID: Q8TB05
  ENSP ID: ENSP00000283474
MSVNMDELKHQVMINQFVLTAGCAADQAKQLLQAAHWQFETALSAFFQETNIPYSHHHHQMMCTPANTPATPPNFPDALTMFSRLKASESFHSGGSGSPMAATATSPPPHFPHAATSSSAASSWPTAASPPGGPQHHQPQPPLWTPTPPSPASDWPPLAPQQATSEPRAHPAMEAER

SEQ ID NO: 94407 - protein, 117 aa, Homo sapiens
  Payload ID: 18825
  Gene Name: UBA-like domain containing 1
  ENSP ID: ENSP00000464725
MMCTPANTPATPPNFPDALTMFSRLKASESFHSGGSGSPMAATATSPPPHFPHAATSSSAASSWPTAASPPGGPQHHQPQPPLWTPTPPSPASDWPPLAPQQATSEPRAHPAMEAER

SEQ ID NO: 94408 - protein, 67 aa, Homo sapiens
  Payload ID: 18825
  Gene Name: UBA-like domain containing 1
  ENSP ID: ENSP00000465041
MSVNMDELKHQRCCSLQRKGLWETPGLFPPPPSACLLGLPACLPCTWGYPHPLPFPLLTKEKNEFQT

SEQ ID NO: 94409 - protein, 212 aa, Homo sapiens
  Payload ID: 18825
  Gene Name: UBA-like domain containing 1
  Uniprot ID: Q8TB05
  ENSP ID: ENSP00000465706
MKLLTLQPPGMLWLMERGGLGKPRGPRHRGLLRVRLGRFISRLLLWEPLGGGQAWGSGEGTQSLPRMGQPRISPWEAVGAPPGRGAHPISPLFPSQMCTPANTPATPPNFPDALTMFSRLKASESFHSGGSGSPMAATATSPPPHFPHAATSSSAASSWPTAASPPGGPQHHQPQPPLWTPTPPSPASDWPPLAPQQATSEPRAHPAMEAER

SEQ ID NO: 94410 - protein, 122 aa, Homo sapiens
  Payload ID: 18825
  Gene Name: UBA-like domain containing 1
  ENSP ID: ENSP00000465745
MSVNMDELKHQVMINQFVLTAGCAADQAKQLLQAAHWQFEVRGAGAGRGPGPRAECVPRGRRAGADGVDACRLCAPSGPQTRPAFPTAVPGVRIPRARGGRRQPSAPFSRRPTSPTATITTR

SEQ ID NO: 94411 - protein, 52 aa, Homo sapiens
  Payload ID: 18825
  Gene Name: UBA-like domain containing 1
  ENSP ID: ENSP00000465847
MMCTPANTPATPPNFPDALTMFSRLKASESFHSGGSGSPMAATATSPPPHFP

SEQ ID NO: 94412 - protein, 94 aa, Homo sapiens
  Payload ID: 18825
  Gene Name: UBA-like domain containing 1
  ENSP ID: ENSP00000466361
MSVNMDELKHQVMINQFVLTAGCAADQAKQLLQAAHWQFESSQGHPQPQRSLGTRAAAGPAGAWRVSRGLSSCRQPSAPFSRRPTSPTATITTR

SEQ ID NO: 94413 - protein, 152 aa, Homo sapiens
  Payload ID: 18825
  Gene Name: UBA-like domain containing 1
  ENSP ID: ENSP00000466404
MSVNMDELKHQVMINQFVLTAGCAADQAKQLLQAAHWQFETALSAFFQETNIPYSHHHHQMASESFHSGGSGSPMAATATSPPPHFPHAATSSSAASSWPTAASPPGGPQHHQPQPPLWTPTPPSPASDWPPLAPQQATSEPRAHPAMEAER

SEQ ID NO: 94414 - protein, 156 aa, Homo sapiens
  Payload ID: 18825
  Gene Name: UBA-like domain containing 1
  ENSP ID: ENSP00000467671
MSVNMDELKHQVMINQFVLTAGCAADQAKQLLQAAHWQFEMCTPANTPATPPNFPDALTMFSRLKASESFHSGGSGSPMAATATSPPPHFPHAATSSSAASSWPTAASPPGGPQHHQPQPPLWTPTPPSPASDWPPLAPQQATSEPRAHPAMEAER

SEQ ID NO: 94415 - protein, 164 aa, Homo sapiens
  Payload ID: 18826
  Gene Name: UBA-like domain containing 2
  Uniprot ID: Q8IYN6
  ENSP ID: ENSP00000331298
MSVNMDELRHQVMINQFVLAAGCAADQAKQLLQAAHWQFETALSTFFQETNIPNSHHHHQMMCTPSNTPATPPNFPDALAMFSKLRASEGLQSSNSPMTAAACSPPANFSPFWASSPPSHQAPWIPPSSPTTFHHLHRPQPTWPPGAQQGGAQQKAMAAMDGQR

SEQ ID NO: 94416 - protein, 104 aa, Homo sapiens
  Payload ID: 18826
  Gene Name: UBA-like domain containing 2
  ENSP ID: ENSP00000466518
MMCTPSNTPATPPNFPDALAMFSKLRASEGLQSSNSPMTAAACSPPANFSPFWASSPPSHQAPWIPPSSPTTFHHLHRPQPTWPPGAQQGGAQQKAMAAMDGQR

SEQ ID NO: 94417 - protein, 64 aa, Homo sapiens
  Payload ID: 18826
  Gene Name: UBA-like domain containing 2
  ENSP ID: ENSP00000468297
MMCTPSNTPATPPNFPDALAMFSKLRASEGLQSSNSPMTAAACSPPANFSPFWASSPPSHQAPW

SEQ ID NO: 94418 - protein, 131 aa, Homo sapiens
  Payload ID: 18827
  Gene Name: UBE2F-SCLY readthrough (NMD candidate)
  ENSP ID: ENSP00000456827
MLTLASKLKRDDGLKGSRTAATASDSTRRVSVRDKLLVKEVAELEANLPCTCKVHFPDPNKLHCFQLTVTPDEGYYQGGKFQFETEVPDAYNMVDLLNFDDPLNIEAAEHHLRDKEDFRNKVDDYIKRYAR

SEQ ID NO: 94419 - protein, 73 aa, Homo sapiens
  Payload ID: 18827
  Gene Name: UBE2F-SCLY readthrough (NMD candidate)
  ENSP ID: ENSP00000457658
MLTLASKLKRDDGLKGSRTAATASDSTRRVSVRDKLLVKEVAELEANLPCTCKVHFPDPNKLHCFQLTVTPVY

SEQ ID NO: 94420 - protein, 179 aa, Homo sapiens
  Payload ID: 18828
  Gene Name: UbiA prenyltransferase domain containing 1
  Uniprot ID: Q9Y5Z9
  ENSP ID: ENSP00000366000
MAASQVLGEKINILSGETVKAGDRDPLGNDCPEQDRLPQRSWRQKCASYVLALRPWSFSASLTPVALGSALAYRSHGVLDPRLLVGCAVAVLAVHGAGNLVNTYYDFSKGIDHKKSDDRTLVDRILEPQDVVRFGVFLYTLGCVCAACLYYLSPLKLEHLALIYFGGLSGSFLYTGVLI

SEQ ID NO: 94421 - protein, 338 aa, Homo sapiens
  Payload ID: 18828
  Gene Name: UbiA prenyltransferase domain containing 1
  Uniprot ID: Q9Y5Z9
  ENSP ID: ENSP00000366006
MAASQVLGEKINILSGETVKAGDRDPLGNDCPEQDRLPQRSWRQKCASYVLALRPWSFSASLTPVALGSALAYRSHGVLDPRLLVGCAVAVLAVHGAGNLVNTYYDFSKGIDHKKSDDRTLVDRILEPQDVVRFGVFLYTLGCVCAACLYYLSPLKLEHLALIYFGGLSGSFLYTGGIGFKYVALGDLIILITFGPLAVMFAYAIQVGSLAIFPLVYAIPLALSTEAILHSNNTRDMESDREAGIVTLAILIGPTFSYILYNTLLFLPYLVFSILATHCTISLALPLLTIPMAFSLERQFRSQAFNKLPQRTAKLNLLLGLFYVFGIILAPAGSLPKI

SEQ ID NO: 94422 - protein, 77 aa, Homo sapiens
  Payload ID: 18828
  Gene Name: UbiA prenyltransferase domain containing 1
  ENSP ID: ENSP00000473453
GVFLYTLGCVCAACLYYLSPLKLEHLALIYFGGLSGSFLYTGGIGFKYVALGDLIILITFGPLAVMFAYAIQSSSSH

SEQ ID NO: 94423 - protein, 118 aa, Homo sapiens
  Payload ID: 18828
  Gene Name: UbiA prenyltransferase domain containing 1
  ENSP ID: ENSP00000473612
TLVDRILEPQDVVRFGVFLYTLGCVCAACLYYLSPLKLEHLALIYFGGLSGSFLYTGGIGFKYVALGDLIILITFGPLAVMFAYAIQAGVQWCNLSSLQPLPPGFKRFSCLSLLSSWD

SEQ ID NO: 94424 - protein, 1134 aa, Homo sapiens
  Payload ID: 18829
  Gene Name: ubinuclein 1
  Uniprot ID: Q9NPG3
  ENSP ID: ENSP00000262376
MSEPHRVQFTSLPGSLNPAFLKKSRKEEAGAGEQHQDCEPAAAAVRITLTLFEPDHKRCPEFFYPELVKNIRGKVKGLQPGDKKKDLSDPFNDEEKERHKVEALARKFEEKYGGKKRRKDRIQDLIDMGYGYDESDSFIDNSEAYDELVPASLTTKYGGFYINSGTLQFRQASESEDDFIKEKKKKSPKKRKLKEGGEKIKKKKKDDTYDKEKKSKKSKFSKAGFTALNASKEKKKKKYSGALSVKEMLKKFQKEKEAQKKREEEHKPVAVPSAEAQGLRELEGASDPLLSLFGSTSDNDLLQAATAMDSLTDLDLEHLLSESPEGSPFRDMDDGSDSLGVGLDQEFRQPSSLPEGLPAPLEKRVKELAQAARAAEGESRQKFFTQDINGILLDIEAQTRELSSQVRSGVYAYLASFLPCSKDALLKRARKLHLYEQGGRLKEPLQKLKEAIGRAMPEQMAKYQDECQAHTQAKVAKMLEEEKDKEQRDRICSDEEEDEEKGGRRIMGPRKKFQWNDEIRELLCQVVKIKLESQDLERNNKAQAWEDCVKGFLDAEVKPLWPKGWMQARTLFKESRRGHGHLTSILAKKKVMAPSKIKVKESSTKPDKKVSVPSGQIGGPIALPSDHQTGGLSIGASSRELPSQASGGLANPPPVNLEDSLDEDLIRNPASSVEAVSKELAALNSRAAGNSEFTLPAPSKAPAEKVGGVLCTEEKRNFAKPSPSAPPPASSLQSPLNFLAEQALALGQSSQEKKPESSGYKELSCQAPLNKGLPEVHQSKAKHHSLPRTSHGPQVAVPVPGPQVKVFHAGTQQQKNFTPPSPFANKLQGPKASPTQCHRSLLQLVKTAAKGQGFHPSAPATSGGLSASSSSSHKTPASSSSALSHPAKPHSVSSAGSSYKNNPFASSISKHGVSSGSSSSGGTPVQSSVSGSLVPGIQPPSVGQATSRPVPSSAGKKMPVSQKLTLVAPPGGPNGDSSGGTQGVAKLLTSPSLKPSAVSSVTSSTSLSKGASGTVLLAGSSLMASPYKSSSPKLSGAMSSNSLGIITPVPIPVHVLSFSADSSAKAGVSKDAIVTGPAPGSFHHGLGHSLLAGLHSSPPHAAPLPHAAVPTHIPQSLPGASQLHGKGPAVPRKL

SEQ ID NO: 94425 - protein, 1134 aa, Homo sapiens; identical to SEQ ID NO: 94424
  Payload ID: 18829
  Gene Name: ubinuclein 1
  Uniprot ID: Q9NPG3
  ENSP ID: ENSP00000379894

SEQ ID NO: 94426 - protein, 312 aa, Homo sapiens
  Payload ID: 18829
  Gene Name: ubinuclein 1
  ENSP ID: ENSP00000465309
  MOD_RES (1)..(1): Any amino acid
XSDEEEDEEKGGRRIMGPRKKFQWNDEIRTLFKESRRGHGHLTSILAKKKVMAPSKIKVKESSTKPDKKVSVPSGQIGGPIALPSDHQTGGLSIGASSRELPSQASGGLANPPPVNLEDSLDEDLIRNPASSVEAVSKELAALNSRAAGNSEFTLPAPSKAPAEKVGGVLCTEEKRNFAKPSPSAPPPASSLQSPLNFLAEQALALGQSSQEKKPESSGYKELSCQAPLNKGLPEVHQSKAKHHSLPRTSHGPQVAVPVPGPQVKVFHAGTQQQKNFTPPSPFANKLQGPKASPTQCHRSLLQLVKTAAKGQ

SEQ ID NO: 94427 - protein, 179 aa, Homo sapiens
  Payload ID: 18829
  Gene Name: ubinuclein 1
  ENSP ID: ENSP00000467942
MSEPHRVQFTSLPGSLNPAFLKKSRKEEAGAGEQHQDCEPAAAAVRITLTLFEPDHKRCPEFFYPELVKNIRGKVKGLQPGDKKKDLSDPFNDEEKERHKVEALARKFEEKYGGKKRRKDRIQDLIDMGYGYDESDSFIDNSEAYDELVPASLTTKYGGFYINSGTLQFRQASESEDDF

SEQ ID NO: 94428 - protein, 71 aa, Homo sapiens
  Payload ID: 18829
  Gene Name: ubinuclein 1
  ENSP ID: ENSP00000468143
KKRRKDRIQDLIDMGYGYDESDSFIDNSEALRHSCLTRGCFSMLLEVAEEHSHISLETHFAPSDCRSRTWS

SEQ ID NO: 94429 - protein, 1104 aa, Homo sapiens
  Payload ID: 18829
  Gene Name: ubinuclein 1
  Uniprot ID: Q9NPG3
  ENSP ID: ENSP00000468740
MSEPHRVQFTSLPGSLNPAFLKKSRKEEAGAGEQHQDCEPAAAAVRITLTLFEPDHKRCPEFFYPELVKNIRGKVKGLQPGDKKKDLSDPFNDEEKERHKVEALARKFEEKYGGKKRRKDRIQDLIDMGYGYDESDSFIDNSEAYDELVPASLTTKYGGFYINSGTLQFRQASESEDDFIKEKKKKSPKKRKLKEGGEKIKKKKKDDTYDKEKKSKKSKFSKAGFTALNASKEKKKKKYSGALSVKEMLKKFQKEKEAQKKREEEHKPVAVPSAEAQGLRELEGASDPLLSLFGSTSDNDLLQAATAMDSLTDLDLEHLLSESPEGSPFRDMDDGSDSLGVGLDQEFRQPSSLPEGLPAPLEKRVKELAQAARAAEGESRQKFFTQDINGILLDIEAQTRELSSQVRSGVYAYLASFLPCSKDALLKRARKLHLYEQGGRLKEPLQKLKEAIGRAMPEQMAKYQDECQAHTQAKVAKMLEEEKDKEQRDRICSDEEEDEEKGGRRIMGPRKKFQWNDEIRELLCQVVKIKLESQDLERNNKAQAWEDCVKGFLDAEVKPLWPKGWMQARTLFKESRRGHGHLTSILAKKKVMAPSKIKVKESSTKPDKKVSVPSGQIGGPIALPSDHQTGGLSIGASSRELPSQASGGLANPPPVNLEDSLDEDLIRNPASSVEAVSKELAALNSRAAGNSEFTLPAPSKAPAEKVGGVLCTEEKRNFAKPSPSAPPPASSLQSPLNFLAEQALALGQSSQEKKPESSGYKELSCQAPLNKGLPEVHQSKAKHHSLPRTSHGPQVAVPVPGPQVKVFHAGTQQQKNFTPPSPFANKLQGPKASPTQCHRSLLQLVKTAAKGQGFHPSAPATSGGLSASSSSSHKTPASSSSALSHPAKPHSVSSAGSSYKNNPFASSISKHGVSSGSSSSGGTPVQSSVSGSLVPGIQPPSVGQATSRPVPSSAGKKMPVSQKLTLVAPPGGPNGDSSGGTQGVAKLLTSPSLKPSAVSSVTSSTSLSKGASGTVLLAGSSLMASPYKSSSPKLSGAMSSNSLGIITPVPIPVHVLSFSADSSAKAGVSKDAIVTGPAPGSFHHGLGHSASQLHGKGPAVPRKL

SEQ ID NO: 94430 - protein, 56 aa, Homo sapiens
  Payload ID: 18829
  Gene Name: ubinuclein 1
  ENSP ID: ENSP00000468776
  MOD_RES (1)..(1): Any amino acid
XGKKMPVSQKLTLVAPPGGPNGDSSGGTQGVAKLLTSPSLKPSAVSSVTSSTSLSR

SEQ ID NO: 94431 - protein, 444 aa, Homo sapiens
  Payload ID: 18830
  Gene Name: ubinuclein 2
  ENSP ID: ENSP00000417846
  MOD_RES (1)..(1): Any amino acid
XKYGGFYINTGTLQFRQASDTEEDDITDNQKHKPPKVPKIKEDDIEMKKRKRKEEGEKEKKPRKKVPKQLGVVALNSHKSEKKKKRYKDSLSLAAMIRKFQKEKDALKKESNPKVPVTLSTPSLNKPPCAAAALGNDVPDLNLSSGDPDLPIFVSTNEHELFQEAENALEMLDDFDFDRLLDAASDGSPLSESGGENGTTTQPTYTSQVMPKVVPTLPEGLPVLLEKRIEDLRVAAKLFDEEGRKKFFTQDMNNILLDIELQLQELGPVIRSGVYSHLEAFVPCNKETLVKRLKKLHLNVQDDRLREPLQKLKLAVSNVMPEQLFKYQEDCQARSQAKCAKLQTDEEREKNGSEEDDDEKPGKRVIGPRKKFHWDDTIRTLLCNLVEIKLGCYELEPNKSQSAEDYLKSFMETEVKPLWPKGWMQARMLFKESRSVHNHLTSAP

SEQ ID NO: 94432 - protein, 137 aa, Homo sapiens
  Payload ID: 18830
  Gene Name: ubinuclein 2
  ENSP ID: ENSP00000417849
MLAKKFEMKYGGKPRKHRKDRLQDLIDIGFGYDETDPFIDNSEAYDELVPASLTTKYGGFYINTGTLQFRQASDTEEDDITDNQKHKPPKVPKIKEDDIEMKKRKRKEEGEKEKKPRKKVPKQLGVVALNSHKSEKK

SEQ ID NO: 94433 - protein, 1347 aa, Homo sapiens
  Payload ID: 18830
  Gene Name: ubinuclein 2
  Uniprot ID: Q6ZU65
  ENSP ID: ENSP00000418648
MAEPRRVAFISLSPVRRREAEYPGPEREPEYPREPPRLEPQPYREPARAEPPAPREPAPRSDAQPPSREKPLPQREVSRAEPPMSLQREPPRPEPPPPFPPLPLQPPPPRESASRAEQPPRPPRETVRLELVLKDPTDESCVEFSYPELLLCGEQRKKLIHTEDPFNDEHQERQEVEMLAKKFEMKYGGKPRKHRKDRLQDLIDIGFGYDETDPFIDNSEAYDELVPASLTTKYGGFYINTGTLQFRQASDTEEDDITDNQKHKPPKVPKIKEDDIEMKKRKRKEEGEKEKKPRKKVPKQLGVVALNSHKSEKKKKRYKDSLSLAAMIRKFQKEKDALKKESNPKVPVTLSTPSLNKPPCAAAALGNDVPDLNLSSGDPDLPIFVSTNEHELFQEAENALEMLDDFDFDRLLDAASDGSPLSESGGENGTTTQPTYTSQVMPKVVPTLPEGLPVLLEKRIEDLRVAAKLFDEEGRKKFFTQDMNNILLDIELQLQELGPVIRSGVYSHLEAFVPCNKETLVKRLKKLHLNVQDDRLREPLQKLKLAVSNVMPEQLFKYQEDCQARSQAKCAKLQTDEEREKNGSEEDDDEKPGKRVIGPRKKFHWDDTIRTLLCNLVEIKLGCYELEPNKSQSAEDYLKSFMETEVKPLWPKGWMQARMLFKESRSVHNHLTSAPAKKKVIPAPKPKVKEVMVKTLPLHSFPTMLKECSPKKDQKTPTSLVASVSGPPTSSSTAAIAAASSSSAPAQETICLDDSLDEDLSFHSPSLDLVSEALAVINNGNKGPPVGSRISMPTTKPRPGLREEKLASIMSKLPLATPKKLDSTQTTHSSSLIAGHTGPVPKKPQDLAHTGISSGLIAGSSIQNPKVSLEPLPARLLQQGLQRSSQIHTSSSSQTHVSSSSQAQIAASSHALGTSEAQDASSLTQVTKVHQHSAVQQNYVSPLQATISKSQTNPVVKLSNNPQLSCSSSLIKTSDKPLMYRLPLSTPSPGNGSQGSHPLVSRTVPSTTTSSNYLAKAMVSQISTQGFKSPFSMAASPKLAASPKPATSPKPLPSPKPSASPKPSLSAKPSVSTKLISKSNPTPKPTVSPSSSSPNALVAQGSHSSTNSPVHKQPSGMNISRQSPTLNLLPSSRTSGLPPTKNLQAPSKLTNSSSTGTVGKNSLSGIAMNVPASRGSNLNSSGANRTSLSGGTGSGTQGATKPLSTPHRPSTASGSSVVTASVQSTAGASLLANASPLTLMTSPLSVTNQNVTPFGMLGGLVPVTMPFQFPLEIFGFGTDTAGVTTTSGSTSAAFHHSLTQNLLKGLQPGGAQHAATLSHSPLPAHLQQAFHDGGQSKGDTKLPRKSQ

SEQ ID NO: 94434 - protein, 561 aa, Homo sapiens
  Payload ID: 18831
  Gene Name: ubiquilin 1
  Uniprot ID: Q9UMX0
  ENSP ID: ENSP00000257468
MAESGESGGPPGSQDSAAGAEGAGAPAAAASAEPKIMKVTVKTPKEKEEFAVPENSSVQQFKEEISKRFKSHTDQLVLIFAGKILKDQDTLSQHGIHDGLTVHLVIKTQNRPQDHSAQQTNTAGSNVTTSSTPNSNSTSGSATSNPFGLGGLGGLAGLSSLGLNTTNFSELQSQMQRQLLSNPEMMVQIMENPFVQSMLSNPDLMRQLIMANPQMQQLIQRNPEISHMLNNPDIMRQTLELARNPAMMQEMMRNQDRALSNLESIPGGYNALRRMYTDIQEPMLSAAQEQFGGNPFASLVSNTSSGEGSQPSRTENRDPLPNPWAPQTSQSSSASSGTASTVGGTTGSTASGTSGQSTTAPNLVPGVGASMFNTPGMQSLLQQITENPQLMQNMLSAPYMRSMMQSLSQNPDLAAQMQNPDTLSAMSNPRAMQALLQIQQGLQTLATEAPGLIPGFTPGLGALGSTGGSSGTNGSNATPSENTSPTAGTTEPGHQQFIQQMLQALAGVNPQLQNPEVRFQQQLEQLSAMGFLNREANLQALIATGGDINAAIERLLGSQPS

SEQ ID NO: 94435 - protein, 589 aa, Homo sapiens
  Payload ID: 18831
  Gene Name: ubiquilin 1
  Uniprot ID: Q9UMX0
  ENSP ID: ENSP00000365576
MAESGESGGPPGSQDSAAGAEGAGAPAAAASAEPKIMKVTVKTPKEKEEFAVPENSSVQQFKEEISKRFKSHTDQLVLIFAGKILKDQDTLSQHGIHDGLTVHLVIKTQNRPQDHSAQQTNTAGSNVTTSSTPNSNSTSGSATSNPFGLGGLGGLAGLSSLGLNTTNFSELQSQMQRQLLSNPEMMVQIMENPFVQSMLSNPDLMRQLIMANPQMQQLIQRNPEISHMLNNPDIMRQTLELARNPAMMQEMMRNQDRALSNLESIPGGYNALRRMYTDIQEPMLSAAQEQFGGNPFASLVSNTSSGEGSQPSRTENRDPLPNPWAPQTSQSSSASSGTASTVGGTTGSTASGTSGQSTTAPNLVPGVGASMFNTPGMQSLLQQITENPQLMQNMLSAPYMRSMMQSLSQNPDLAAQMMLNNPLFAGNPQLQEQMRQQLPTFLQQMQNPDTLSAMSNPRAMQALLQIQQGLQTLATEAPGLIPGFTPGLGALGSTGGSSGTNGSNATPSENTSPTAGTTEPGHQQFIQQMLQALAGVNPQLQNPEVRFQQQLEQLSAMGFLNREANLQALIATGGDINAAIERLLGSQPS

SEQ ID NO: 94436 - protein, 157 aa, Homo sapiens
  Payload ID: 18831
  Gene Name: ubiquilin 1
  ENSP ID: ENSP00000434194
AAAASAEPKIMKVTVKTPKEKEEFAVPENSSVQQTLELARNPAMMQEMMRNQDRALSNLESIPGGYNALRRMYTDIQEPMLSAAQEQFGGNPFASLVSNTSSGEGSQPSRTENRDPLPNPWAPQTSQSSSASSGTASTVGGTTGSTASGTSGQSTTA

SEQ ID NO: 94437 - protein, 158 aa, Homo sapiens
  Payload ID: 18831
  Gene Name: ubiquilin 1
  ENSP ID: ENSP00000436912
  MOD_RES (1)..(1): Any amino acid
XQQITENPQLMQNMLSAPYMRSMMQSLSQNPDLAAQLQEQMRQQLPTFLQQMQNPDTLSAMSNPRAMQALLQIQQGLQTLATEAPGLIPGFTPGLGALGSTGGSSGTNGSNATPSENTSPTAGTTEPGHQQFIQQMLQALAGVNPQLQNPEVRFQQQL

SEQ ID NO: 94438 - protein, 624 aa, Homo sapiens
  Payload ID: 18832
  Gene Name: ubiquilin 2
  Uniprot ID: Q9UHD9
  ENSP ID: ENSP00000345195
MAENGESSGPPRPSRGPAAAQGSAAAPAEPKIIKVTVKTPKEKEEFAVPENSSVQQFKEAISKRFKSQTDQLVLIFAGKILKDQDTLIQHGIHDGLTVHLVIKSQNRPQGQSTQPSNAAGTNTTSASTPRSNSTPISTNSNPFGLGSLGGLAGLSSLGLSSTNFSELQSQMQQQLMASPEMMIQIMENPFVQSMLSNPDLMRQLIMANPQMQQLIQRNPEISHLLNNPDIMRQTLEIARNPAMMQEMMRNQDLALSNLESIPGGYNALRRMYTDIQEPMLNAAQEQFGGNPFASVGSSSSSGEGTQPSRTENRDPLPNPWAPPPATQSSATTSTTTSTGSGSGNSSSNATGNTVAAANYVASIFSTPGMQSLLQQITENPQLIQNMLSAPYMRSMMQSLSQNPDLAAQMMLNSPLFTANPQLQEQMRPQLPAFLQQMQNPDTLSAMSNPRAMQALMQIQQGLQTLATEAPGLIPSFTPGVGVGVLGTAIGPVGPVTPIGPIGPIVPFTPIGPIGPIGPTGPAAPPGSTGSGGPTGPTVSSAAPSETTSPTSESGPNQQFIQQMVQALAGANAPQLPNPEVRFQQQLEQLNAMGFLNREANLQALIATGGDINAAIERLLGSQPS

SEQ ID NO: 94439 - protein, 655 aa, Homo sapiens
  Payload ID: 18833
  Gene Name: ubiquilin 3
  Uniprot ID: Q9H347
  ENSP ID: ENSP00000347997
MAKGGEALPQGSPAPVQDPHLIKVTVKTPKDKEDFSVTDTCTIQQLKEEISQRFKAHPDQLVLIFAGKILKDPDSLAQCGVRDGLTVHLVIKRQHRAMGNECPAASVPTQGPSPGSLPQPSSIYPADGPPAFSLGLLTGLSRLGLAYRGFPDQPSSLMRQHVSVPEFVTQLIDDPFIPGLLSNTGLVRQLVLDNPHMQQLIQHNPEIGHILNNPEIMRQTLEFLRNPAMMQEMIRSQDRVLSNLESIPGGYNVLCTMYTDIMDPMLNAVQEQFGGNPFATATTDNATTTTSQPSRMENCDPLPNPWTSTHGGSGSRQGRQDGDQDAPDIRNRFPNFLGIIRLYDYLQQLHENPQSLGTYLQGTASALSQSQEPPPSVNRVPPSSPSSQEPGSGQPLPEESVAIKGRSSCPAFLRYPTENSTGQGGDQDGAGKSSTGHSTNLPDLVSGLGDSANRVPFAPLSFSPTAAIPGIPEPPWLPSPAYPRSLRPDGMNPAPQLQDEIQPQLPLLMHLQAAMANPRALQALRQIEQGLQVLATEAPRLLLWFMPCLAGTGSVAGGIESREDPLMSEDPLPNPPPEVFPALDSAELGFLSPPFLHMLQDLVSTNPQQLQPEAHFQVQLEQLRSMGFLNREANLQALIATGGDVDAAVEKLRQS

SEQ ID NO: 94440 - protein, 221 aa, Homo sapiens
  Payload ID: 18833
  Gene Name: ubiquilin 3
  ENSP ID: ENSP00000412561
MAKGGEALPQGSPAPVQDPHLIKVTVKTPKDKEDFSVTDTCTIQQLKEEISQRFKAHPDQLVLIFAGKILKDPDSLAQCGVRDGLTVHLVIKRQHRAMGNECPAASVPTQGPSPGSLPQPSSIYPADGPPAFSLGLLTGLSRLGLAYRGFPDQPSSLMRQHVSVPEFVTQLIDDPFIPGLLSNTGLVRQLVLDNPHMQQLIQHNPEIGHILNNPEIMRQTL

SEQ ID NO: 94441 - protein, 601 aa, Homo sapiens
  Payload ID: 18834
  Gene Name: ubiquilin 4
  Uniprot ID: Q9NRR5
  ENSP ID: ENSP00000357292
MAEPSGAETRPPIRVTVKTPKDKEEIVICDRASVKEFKEEISRRFKAQQDQLVLIFAGKILKDGDTLNQHGIKDGLTVHLVIKTPQKAQDPAAATASSPSTPDPASAPSTTPASPATPAQPSTSGSASSDAGSGSRRSSGGGPSPGAGEGSPSATASILSGFGGILGLGSLGLGSANFMELQQQMQRQLMSNPEMLSQIMENPLVQDMMSNPDLMRHMIMANPQMQQLMERNPEISHMLNNPELMRQTMELARNPAMMQEMMRNQDRALSNLESIPGGYNALRRMYTDIQEPMFSAAREQFGNNPFSSLAGNSDSSSSQPLRTENREPLPNPWSPSPPTSQAPGSGGEGTGGSGTSQVHPTVSNPFGINAASLGSGMFNSPEMQALLQQISENPQLMQNVISAPYMRSMMQTLAQNPDFAAQMMVNVPLFAGNPQLQEQLRLQLPVFLQQMQNPESLSILTNPRAMQALLQIQQGLQTLQTEAPGLVPSLGSFGISRTPAPSAGSNAGSTPEAPTSSPATPATSSPTGASSAQQQLMQQMIQLLAGSGNSQVQTPEVRFQQQLEQLNSMGFINREANLQALIATGGDINAAIERLLGSQLS

SEQ ID NO: 94442 - protein, 475 aa, Homo sapiens
  Payload ID: 18835
  Gene Name: ubiquilin-like
  Uniprot ID: Q8IYU4
  ENSP ID: ENSP00000369531
MWHAISRTSRMSQSGCPSGLLADKNISSSATRVIVKTAGNQKDFMVADDISVRQFKEMLLAHFQCQMDQLVLVFMGCLLKDHDTLSQRGIMDGHTIYLVIKSKQGSRSLAHSFRDLPTNDPCHRDRNTKGNSSRVHQPTGMNQAPVELAHFVGSDAPKVHTQNLEVSHPECKAQMLENPSIQRLLSNMEFMWQFISEHLDTQQLMQQNPEVSRLLLDNSEILLQTLELARNLAMIQEIMQIQQPSQNLEYPLNPQPYLGLETMPGGNNALGQNYADINDQMLNSMQDPFGGNPFTALLAGQVLEQVQSSPPPPPPSQEQQDQLTQHPATRVIYNSSGGFSSNTSANDTLNKVNHTSKANTAMISTKGQSHICATRQPAWIPALPSIELTQQLQEEYKDATVSLSSSRQTLKGDLQLSDEQSSSQITGGMMQLLMNNPYLAAQIMLFTSMPQLSEQWRQQLPTFLQQTQISDLLSA

SEQ ID NO: 94443 - protein, 111 aa, Homo sapiens
  Payload ID: 18836
  Gene Name: ubiquinol-cytochrome c reductase binding protein
  Uniprot ID: P14927
  ENSP ID: ENSP00000287022
MAGKQAVSASGKWLDGIRKWYYNAAGFNKLGLMRDDTIYEDEDVKEAIRRLPENLYNDRMFRIKRALDLNLKHQILPKEQWTKYEEENFYLEPYLKEVIRERKEREEWAKK

SEQ ID NO: 94444 - protein, 161 aa, Homo sapiens
  Payload ID: 18836
  Gene Name: ubiquinol-cytochrome c reductase binding protein
  ENSP ID: ENSP00000427862
MAGKQAVSASGKWLDGIRKWYYNAAGFNKLGLMRDDTIYEDEDVKEAIRRLPENLYNDRMFRIKRALDLNLKHQILPKEQWTKYEEVFAVPALHSASYLDEKISPLSVPPDPKKSFCEANSHPLNCIETRQRPVDIHFFFFPKRLPPHNLSKQLITPSPQI

SEQ ID NO: 94445 - protein, 76 aa, Homo sapiens
  Payload ID: 18836
  Gene Name: ubiquinol-cytochrome c reductase binding protein
  ENSP ID: ENSP00000429787
MRDDTIYEDEDVKEAIRRLPENLYNDRMFRIKRALDLNLKHQILPKEQWTKYEEKKTTLSLTCEMILLKLLSKSLI

SEQ ID NO: 94446 - protein, 140 aa, Homo sapiens
  Payload ID: 18836
  Gene Name: ubiquinol-cytochrome c reductase binding protein
  Uniprot ID: P14927
  ENSP ID: ENSP00000430494
MAGKQAVSASGKWLDGIRKWYYNAAGFNKLGLMRDDTIYEDEDVKEAIRRLPENLYNDRMFRIKRALDLNLKHQILPKEQWTKYEEVFAVPALHSASYLDEKISPLSVPPDPKKSFCEANSHPLNCIETRQRKISTLNRI

SEQ ID NO: 94447 - protein, 161 aa, Homo sapiens; identical to SEQ ID NO: 94444
  Payload ID: 18836
  Gene Name: ubiquinol-cytochrome c reductase binding protein
  ENSP ID: ENSP00000430560

SEQ ID NO: 94448 - protein, 26 aa, Homo sapiens
  Payload ID: 18836
  Gene Name: ubiquinol-cytochrome c reductase binding protein
  ENSP ID: ENSP00000430672
MAGKQADIEGVLLNSRHCFCACLGTT

SEQ ID NO: 94449 - protein, 272 aa, Homo sapiens
  Payload ID: 18837
  Gene Name: ubiquinol-cytochrome c reductase complex assembly factor 1
  Uniprot ID: Q9NVA1
  ENSP ID: ENSP00000335364
MALLVRVLRNQTSISQWVPVCSRLIPVSPTQGQGDRALSRTSQWPQMSQSRACGGSEQIPGIDIQLNRKYHTTRKLSTTKDSPQPVEEKVGAFTKIIEAMGFTGPLKYRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 94450 - protein, 219 aa, Homo sapiens
  Payload ID: 18837
  Gene Name: ubiquinol-cytochrome c reductase complex assembly factor 1
  ENSP ID: ENSP00000352161
MALLVRVLRNQTSISQWVPVCSRLIPVSPTQGQGDRALSRTSQWPQMSQSRACGGSEQIPGIDIQLNRKYHTTRKLSTTKDSPQPVEEKVGAFTKIIEAMGFTGPLKYSKWVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 94451 - protein, 231 aa, Homo sapiens
  Payload ID: 18837
  Gene Name: ubiquinol-cytochrome c reductase complex assembly factor 1
  Uniprot ID: Q9NVA1
  ENSP ID: ENSP00000363501
MALLVRVLRNQTSISQWVPVCSRLIPVSPTQGQGDRALSRTSQKIKIAALRMYTSCVEKTDFEEFFLRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 94452 - protein, 273 aa, Homo sapiens
  Payload ID: 18837
  Gene Name: ubiquinol-cytochrome c reductase complex assembly factor 1
  Uniprot ID: Q9NVA1
  ENSP ID: ENSP00000363505
MALLVRVLRNQTSISQWVPVCSRLIPVSPTQGQGDRALSRTSQWPQMSQSRACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGGILSDDHGLAAALWRTFFNRKCEDPRHLELLVEYVRKQIQYLDSMNGEDLLLTGEVSWRPLVEKNPQSILKPHSPTYNDEGL

SEQ ID NO: 94453 - protein, 299 aa, Homo sapiens
  Payload ID: 18837
  Gene Name: ubiquinol-cytochrome c reductase complex assembly factor 1
  Uniprot ID: Q9NVA1
  ENSP ID: ENSP00000363506
MALLVRVLRNQTSISQWVPVCSRLIPVSPTQGQGDRALSRTSQWPQMSQSRACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 94454 - protein, 22 aa, Homo sapiens
  Payload ID: 18837
  Gene Name: ubiquinol-cytochrome c reductase complex assembly factor 1
  ENSP ID: ENSP00000363515
MALLVRVLTEFCSCCASWSAMA

SEQ ID NO: 94455 - protein, 49 aa, Homo sapiens
  Payload ID: 18837
  Gene Name: ubiquinol-cytochrome c reductase complex assembly factor 1
  ENSP ID: ENSP00000380685
MALLVRVLRNQTSISQWVPVCSRLIPVSPTQGQGDRALSRTSQTGSCSC

SEQ ID NO: 94456 - protein, 221 aa, Homo sapiens
  Payload ID: 18837
  Gene Name: ubiquinol-cytochrome c reductase complex assembly factor 1
  ENSP ID: ENSP00000380686
MALLVRVLRNQTSISQWVPVCSRLIPVSPTQGQGDRALSRTSQWPQMSQSRACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGVSECCQMLVLDNSREGFEFGVLSVVKWPCF

SEQ ID NO: 94457 - protein, 226 aa, Homo sapiens
  Payload ID: 18837
  Gene Name: ubiquinol-cytochrome c reductase complex assembly factor 1
  ENSP ID: ENSP00000380688
MSQSRACGGSEQIPGIDIQLNRKYHTTRKLSTTKDSPQPVEEKVGAFTKIIEAMGFTGPLKYRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 94458 - protein, 126 aa, Homo sapiens
  Payload ID: 18837
  Gene Name: ubiquinol-cytochrome c reductase complex assembly factor 1
  ENSP ID: ENSP00000390334
ALLVRVLRNQTSISQWVPVCSRLIPVSPTQGQGDRALSRTSQWPQMSQSRACGGSEQIPGIDIQLNRKYHTTRKLSTTKDSPQPVEEKRSWDMMRGSFQMIMGWPLPSGEPSSTGNVKTLDILNCW

SEQ ID NO: 94459 - protein, 243 aa, Homo sapiens
  Payload ID: 18837
  Gene Name: ubiquinol-cytochrome c reductase complex assembly factor 1
  ENSP ID: ENSP00000398531
MALLVRVLRNQTSISQWVPVCSRLIPVSPTQGQGDRALSRTSQVPWLETSASEWHPQWPQMSQSRACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGVNPYILKKNMILMTNHFYAAILGYDEGILSDDHGLAAA

SEQ ID NO: 94460 - protein, 249 aa, Homo sapiens
  Payload ID: 18837
  Gene Name: ubiquinol-cytochrome c reductase complex assembly factor 1
  ENSP ID: ENSP00000399713
MALLVRVLRNQTSISQWVPVCSRLIPVSPTQGQGDRALSRTSQLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEK

SEQ ID NO: 94461 - protein, 55 aa, Homo sapiens
  Payload ID: 18837
  Gene Name: ubiquinol-cytochrome c reductase complex assembly factor 1
  ENSP ID: ENSP00000411024
  MOD_RES (1)..(1): Any amino acid
XLLVRVLRNQTSISQWVPVCSRLIPVSPTQGQGDRALSRTSQGVRCLIHSIHGFL

SEQ ID NO: 94462 - protein, 124 aa, Homo sapiens
  Payload ID: 18837
  Gene Name: ubiquinol-cytochrome c reductase complex assembly factor 1
  ENSP ID: ENSP00000416246
MALLVRVLRNQTSISQWVPVCSRLIPVSPTQGQGDRALSRTSQWPQMSQSRACGGSEQIPGIDIQLNRKYHTTRKLSTTKDSPQPVEEKVGAFTKIIEAMGFTGPLKYSKWGVRCLIHSIHGFL

SEQ ID NO: 94463 - protein, 44 aa, Homo sapiens
  Payload ID: 18837
  Gene Name: ubiquinol-cytochrome c reductase complex assembly factor 1
  ENSP ID: ENSP00000420584
MALLVRVLRNQTSISQWVPVCSRLIPVSPTQGQGDRALSRTSQG

SEQ ID NO: 94464 - protein, 101 aa, Homo sapiens
  Payload ID: 18838
  Gene Name: ubiquinol-cytochrome c reductase complex assembly factor 2
  ENSP ID: ENSP00000363331
MAASRYRRFLKLCEEWPVDETKRGRDLGAYLRQRVAQAFREGENTQYPRPRDTSFSGLSLEEYKLILSTDTLEELKEIDKGMWKKLQEKFAPKGPEEDHKA

SEQ ID NO: 94465 - protein, 126 aa, Homo sapiens
  Payload ID: 18838
  Gene Name: ubiquinol-cytochrome c reductase complex assembly factor 2
  ENSP ID: ENSP00000363348
  MOD_RES (1)..(1): Any amino acid
XAASRYRRFLKLCEEWPVDETKRGRDLGAYLRQRVAQAFREGENTQVAEPEACDQMYESLARLHSNYYKHKYPRPRDTSFSGLSLEEYKLILSTDTLEELKEIDKGMWKKLQEKFAPKGPEEDHKA

SEQ ID NO: 94466 - protein, 126 aa, Homo sapiens
  Payload ID: 18838
  Gene Name: ubiquinol-cytochrome c reductase complex assembly factor 2
  Uniprot ID: Q9BRT2
  ENSP ID: ENSP00000476140
MAASRYRRFLKLCEEWPVDETKRGRDLGAYLRQRVAQAFREGENTQVAEPEACDQMYESLARLHSNYYKHKYPRPRDTSFSGLSLEEYKLILSTDTLEELKEIDKGMWKKLQEKFAPKGPEEDHKA

SEQ ID NO: 94467 - protein, 93 aa, Homo sapiens
  Payload ID: 18839
  Gene Name: ubiquinol-cytochrome c reductase complex assembly factor 3
  Uniprot ID: Q6UW78
  ENSP ID: ENSP00000367189
MDSLRKMLISVAMLGAGAGVGYALLVIVTPGERRKQEMLKEMPLQDPRSREEAARTQQLLLATLQEAATTQENVAWRKNWMVGGEGGAGGRSP

SEQ ID NO: 94468 - protein, 93 aa, Homo sapiens; identical to SEQ ID NO: 94467
  Payload ID: 18839
  Gene Name: ubiquinol-cytochrome c reductase complex assembly factor 3
  Uniprot ID: Q6UW78
  ENSP ID: ENSP00000432692

SEQ ID NO: 94469 - protein, 480 aa, Homo sapiens
  Payload ID: 18840
  Gene Name: ubiquinol-cytochrome c reductase core protein I
  Uniprot ID: P31930
  ENSP ID: ENSP00000203407
MAASVVCRAATAGAQVLLRARRSPALLRTPALRSTATFAQALQFVPETQVSLLDNGLRVASEQSSQPTCTVGVWIDVGSRFETEKNNGAGYFLEHLAFKGTKNRPGSALEKEVESMGAHLNAYSTREHTAYYIKALSKDLPKAVELLGDIVQNCSLEDSQIEKERDVILREMQENDASMRDVVFNYLHATAFQGTPLAQAVEGPSENVRKLSRADLTEYLSTHYKAPRMVLAAAGGVEHQQLLDLAQKHLGGIPWTYAEDAVPTLTPCRFTGSEIRHRDDALPFAHVAIAVEGPGWASPDNVALQVANAIIGHYDCTYGGGVHLSSPLASGAVANKLCQSFQTFSICYAETGLLGAHFVCDRMKIDDMMFVLQGQWMRLCTSATESEVARGKNILRNALVSHLDGTTPVCEDIGRSLLTYGRRIPLAEWESRIAEVDASVVREICSKYIYDQCPAVAGYGPIEQLPDYNRIRSGMFWLRF

SEQ ID NO: 94470 - protein, 68 aa, Homo sapiens
  Payload ID: 18840
  Gene Name: ubiquinol-cytochrome c reductase core protein I
  ENSP ID: ENSP00000388660
MAASVVCRAATAGAQVLLRARRSVRWWRERGASGQGFGKRTAGPAADASLAEYGNLRSGAPVRAGDAG

SEQ ID NO: 94471 - protein, 121 aa, Homo sapiens
  Payload ID: 18840
  Gene Name: ubiquinol-cytochrome c reductase core protein I
  ENSP ID: ENSP00000393696
MAASVVCRAATAGAQVLLRARRSVRWECGLMLAAVLRLRRIMGQATFWSIWLSREQRIGLAVPWRRRWRAWGPILMPTAPGSTQLTTSRRCPRICRKLWSSWVTLCRTVVWKTHRLRRNVM

SEQ ID NO: 94472 - protein, 453 aa, Homo sapiens
  Payload ID: 18841
  Gene Name: ubiquinol-cytochrome c reductase core protein II
  Uniprot ID: P22695
  ENSP ID: ENSP00000268379
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLSVTATRENMAYTVECLRGDVDILMEFLLNVTTAPEFRRWEVADLQPQLKIDKAVAFQNPQTHVIENLHAAAYRNALANPLYCPDYRIGKVTSEELHYFVQNHFTSARMALIGLGVSHPVLKQVAEQFLNMRGGLGLSGAKANYRGGEIREQNGDSLVHAAFVAESAVAGSAEANAFSVLQHVLGAGPHVKRGSNTTSHLHQAVAKATQQPFDVSAFNASYSDSGLFGIYTISQATAAGDVIKAAYNQVKTIAQGNLSNTDVQAAKNKLKAGYLMSVESSECFLEEVGSQALVAGSYMPPSTVLQQIDSVANADIINAAKKFVSGQKSMAASGNLGHTPFVDEL

SEQ ID NO: 94473 - protein, 176 aa, Homo sapiens
  Payload ID: 18841
  Gene Name: ubiquinol-cytochrome c reductase core protein II
  ENSP ID: ENSP00000455088
MKLLTRAGSFSFTKLPNGLVIASLENYSPVSRIGLFIKAGSRYEDFSNLGTTHLLRLTSSLTTKGASSFKITRGIEAVGGKLSVTATRENMAYTVECLRGDVDILMEFLLNVTTAPEFRRWEVADLQPQLKIDKAVAFQNPQTHVIENLHAAAYRNALANPLYCPDYRIGKVTSEE

SEQ ID NO: 94474 - protein, 412 aa, Homo sapiens
  Payload ID: 18841
  Gene Name: ubiquinol-cytochrome c reductase core protein II
  ENSP ID: ENSP00000456232
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLSVTATRENMAYTVECLRGDVDILMEFLLNVTTAPEFRRWEVADLQPQLKIDKAVAFQNPQTHVIENLHAAAYRNALANPLYCPDYRIGKVTSEELHYFVQNHFTSARMALIGLGVSHPVLKQVAEQFLNMRGGLGLSGAKANYRGGEIREQNGDSLVHAAFVAESAVAGSAEANAFSVLQHVLGAGPHVKRGSNTTSHLHQAVAKATQQPFDVSAFNASYSDSGLFGIYTISQATAAGDVIKAAYNQVKTIAQGNLSNTDVQAAKRQRSLFLARSQWQQVEIWDIHLLLMSCNTDAHITGES

SEQ ID NO: 94475 - protein, 336 aa, Homo sapiens
  Payload ID: 18841
  Gene Name: ubiquinol-cytochrome c reductase core protein II
  ENSP ID: ENSP00000456738
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLSVTATRENMAYTVECLRGDVDILMEFLLNVTTAPEFRRWEVADLQPQLKIDKAVAFQNPQTHVIENLHAAAYRNALANPLYCPDYRIGKVTSEELHYFVQNHFTSARMALIGLGVSHPVLKQVAEQFLNMRGGLGLSGAKANYRGGEIREQNGDSLVHAAFVAESAVAGSAEANAFSVLQHVLGAGPHVKRGSNTTSHLHQAVAKATQQPFDEQAESWIPNVSGVF

SEQ ID NO: 94476 - protein, 116 aa, Homo sapiens
  Payload ID: 18841
  Gene Name: ubiquinol-cytochrome c reductase core protein II
  ENSP ID: ENSP00000457600
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLREMGKV

SEQ ID NO: 94477 - protein, 132 aa, Homo sapiens
  Payload ID: 18841
  Gene Name: ubiquinol-cytochrome c reductase core protein II
  ENSP ID: ENSP00000457662
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLSVHSIFNQEQILSQETTLFAHP

SEQ ID NO: 94478 - protein, 70 aa, Homo sapiens
  Payload ID: 18841
  Gene Name: ubiquinol-cytochrome c reductase core protein II
  ENSP ID: ENSP00000479799
  MOD_RES (1)..(1): Any amino acid
XFIKAGSRYEDFSNLGTTHLLRLTSSLTTKGASSFKITRGIEAVGGKLSVHSIFNQEQILSQETTLFAHP

SEQ ID NO: 94479 - protein, 132 aa, Homo sapiens; identical to SEQ ID NO: 94477
  Payload ID: 18841
  Gene Name: ubiquinol-cytochrome c reductase core protein II
  ENSP ID: ENSP00000485966

SEQ ID NO: 94480 - protein, 91 aa, Homo sapiens
  Payload ID: 18842
  Gene Name: ubiquinol-cytochrome c reductase hinge protein
  Uniprot ID: P07919
  ENSP ID: ENSP00000309565
MGLEDEQKMLTESGDPEEEEEEEEELVDPLTTVREQCEQLEKCVKARERLELCDERVSSRSHTEEDCTEELFDFLHARDHCVAHKLFNNLK

SEQ ID NO: 94481 - protein, 102 aa, Homo sapiens
  Payload ID: 18842
  Gene Name: ubiquinol-cytochrome c reductase hinge protein
  ENSP ID: ENSP00000477826
MGLEDEQKMLTESGDPEEEEEEEEELVIGLRLSVHTGNLGRQECETFPYYLASELNGRPHSAISGGSVALPAGLLHGSPNNSERAMRAVGEMCKGPGAARAL

SEQ ID NO: 94482 - protein, 58 aa, Homo sapiens
  Payload ID: 18842
  Gene Name: ubiquinol-cytochrome c reductase hinge protein
  ENSP ID: ENSP00000484857
MGLEDEQKMLTESGDPEEEEEEEEELVVRTVSGSPNNSERAMRAVGEMCKGPGAARAL

SEQ ID NO: 94483 - protein, 91 aa, Homo sapiens
  Payload ID: 18843
  Gene Name: ubiquinol-cytochrome c reductase hinge protein like
  ENSP ID: ENSP00000485401
MGLEDEQKMLTESGDPEEEEEEEEELVDPLTTVREQCEQLEKCVKARERLELYDEHVSSRSHTEEDCTEELFDFLHAKDHCVAHKLFNNLK

SEQ ID NO: 94484 - protein, 82 aa, Homo sapiens
  Payload ID: 18844
  Gene Name: ubiquinol-cytochrome c reductase, complex III subunit VII, 9.5kDa
  Uniprot ID: O14949
  ENSP ID: ENSP00000367934
MGREFGNLTRMRHVISYSLSPFEQRAYPHVFTKGIPNVLRRIRESFFRVVPQFVVFYLIYTWGTEEFERSKRKNPAAYENDK

SEQ ID NO: 94485 - protein, 82 aa, Homo sapiens; identical to SEQ ID NO: 94484
  Payload ID: 18844
  Gene Name: ubiquinol-cytochrome c reductase, complex III subunit VII, 9.5kDa
  Uniprot ID: O14949
  ENSP ID: ENSP00000367936

SEQ ID NO: 94486 - protein, 82 aa, Homo sapiens; identical to SEQ ID NO: 94484
  Payload ID: 18844
  Gene Name: ubiquinol-cytochrome c reductase, complex III subunit VII, 9.5kDa
  Uniprot ID: O14949
  ENSP ID: ENSP00000367939

SEQ ID NO: 94487 - protein, 63 aa, Homo sapiens
  Payload ID: 18845
  Gene Name: ubiquinol-cytochrome c reductase, complex III subunit X
  Uniprot ID: Q9UDW1
  ENSP ID: ENSP00000332887
MAAATLTSKLYSLLFRRTSTFALTIIVGVMFFERAFDQGADAIYDHINEGKLWKHIKHKYENK

SEQ ID NO: 94488 - protein, 62 aa, Homo sapiens
  Payload ID: 18845
  Gene Name: ubiquinol-cytochrome c reductase, complex III subunit X
  Uniprot ID: Q9UDW1
  ENSP ID: ENSP00000384962
MAAATLTSKLYSLLFRRTSTFALTIIVGVMFFERAFDQGADAIYDHINEGVRACAIPDLGPA

SEQ ID NO: 94489 - protein, 132 aa, Homo sapiens
  Payload ID: 18845
  Gene Name: ubiquinol-cytochrome c reductase, complex III subunit X
  ENSP ID: ENSP00000482098
MAAATLTSKLYSLLFRRPPPSPSPSSWASCSSSAPSIKARTLSTTTSTRGSCGNTSSTSMRTSSSLEAPIQARRTRSTQQLFAQSWSLSLKMMLKVLFMDHHSLLARNGFTYKTDSLPSAVFEVCLVSMLRK

SEQ ID NO: 94490 - protein, 56 aa, Homo sapiens; identical to SEQ ID NO: 975
  Payload ID: 18846
  Gene Name: ubiquinol-cytochrome c reductase, complex III subunit XI
  Uniprot ID: O14957
  ENSP ID: ENSP00000466420

SEQ ID NO: 94491 - protein, 56 aa, Homo sapiens; identical to SEQ ID NO: 975
  Payload ID: 18846
  Gene Name: ubiquinol-cytochrome c reductase, complex III subunit XI
  Uniprot ID: O14957
  ENSP ID: ENSP00000467262

SEQ ID NO: 94492 - protein, 56 aa, Homo sapiens; identical to SEQ ID NO: 975
  Payload ID: 18846
  Gene Name: ubiquinol-cytochrome c reductase, complex III subunit XI
  Uniprot ID: O14957
  ENSP ID: ENSP00000467555

SEQ ID NO: 94493 - protein, 274 aa, Homo sapiens
  Payload ID: 18847
  Gene Name: ubiquinol-cytochrome c reductase, Rieske iron-sulfur polypeptide 1
  Uniprot ID: P47985
  ENSP ID: ENSP00000306397
MLSVASRSGPFAPVLSATSRGVAGALRPLVQATVPATPEQPVLDLKRPFLSRESLSGQAVRRPLVASVGLNVPASVCYSHTDIKVPDFSEYRRLEVLDSTKSSRESSEARKGFSYLVTGVTTVGVAYAAKNAVTQFVSSMSASADVLALAKIEIKLSDIPEGKNMAFKWRGKPLFVRHRTQKEIEQEAAVELSQLRDPQHDLDRVKKPEWVILIGVCTHLGCVPIANAGDFGGYYCPCHGSHYDASGRIRLGPAPLNLEVPTYEFTSDDMVIVG

SEQ ID NO: 94494 - protein, 128 aa, Homo sapiens
  Payload ID: 18848
  Gene Name: ubiquitin A-52 residue ribosomal protein fusion product 1
  Uniprot ID: P62987
  ENSP ID: ENSP00000388107
MQIFVKTLTGKTITLEVEPSDTIENVKAKIQDKEGIPPDQQRLIFAGKQLEDGRTLSDYNIQKESTLHLVLRLRGGIIEPSLRQLAQKYNCDKMICRKCYARLHPRAVNCRKKKCGHTNNLRPKKKVK

SEQ ID NO: 94495 - protein, 128 aa, Homo sapiens; identical to SEQ ID NO: 94494
  Payload ID: 18848
  Gene Name: ubiquitin A-52 residue ribosomal protein fusion product 1
  Uniprot ID: P62987
  ENSP ID: ENSP00000396910

SEQ ID NO: 94496 - protein, 128 aa, Homo sapiens; identical to SEQ ID NO: 94494
  Payload ID: 18848
  Gene Name: ubiquitin A-52 residue ribosomal protein fusion product 1
  Uniprot ID: P62987
  ENSP ID: ENSP00000470419

SEQ ID NO: 94497 - protein, 128 aa, Homo sapiens; identical to SEQ ID NO: 94494
  Payload ID: 18848
  Gene Name: ubiquitin A-52 residue ribosomal protein fusion product 1
  Uniprot ID: P62987
  ENSP ID: ENSP00000470507

SEQ ID NO: 94498 - protein, 128 aa, Homo sapiens; identical to SEQ ID NO: 94494
  Payload ID: 18848
  Gene Name: ubiquitin A-52 residue ribosomal protein fusion product 1
  Uniprot ID: P62987
  ENSP ID: ENSP00000471062

SEQ ID NO: 94499 - protein, 128 aa, Homo sapiens; identical to SEQ ID NO: 94494
  Payload ID: 18848
  Gene Name: ubiquitin A-52 residue ribosomal protein fusion product 1
  Uniprot ID: P62987
  ENSP ID: ENSP00000471464

SEQ ID NO: 94500 - protein, 128 aa, Homo sapiens; identical to SEQ ID NO: 94494
  Payload ID: 18848
  Gene Name: ubiquitin A-52 residue ribosomal protein fusion product 1
  Uniprot ID: P62987
  ENSP ID: ENSP00000471622

SEQ ID NO: 94501 - protein, 114 aa, Homo sapiens
  Payload ID: 18848
  Gene Name: ubiquitin A-52 residue ribosomal protein fusion product 1
  ENSP ID: ENSP00000471991
VKAKIQDKEGIPPDQQRLIFAGKQLEDGRTLSDYNIQKESTLHLVLRLRGGIIEPSLRQLAQKYNCDKMICRKSVVTPTTCVPRRRSNKVVLSLKGSLLPRPRGPGASIKCPFH

SEQ ID NO: 94502 - protein, 63 aa, Homo sapiens
  Payload ID: 18848
  Gene Name: ubiquitin A-52 residue ribosomal protein fusion product 1
  ENSP ID: ENSP00000472137
MQIFVKTLTGKTITLEVEPSDTIENVKAKIQDKEGIPPDQQRLIFAGKQLEDGRTLSDYNIQK

SEQ ID NO: 94503 - protein, 128 aa, Homo sapiens; identical to SEQ ID NO: 94494
  Payload ID: 18848
  Gene Name: ubiquitin A-52 residue ribosomal protein fusion product 1
  Uniprot ID: P62987
  ENSP ID: ENSP00000472264

SEQ ID NO: 94504 - protein, 128 aa, Homo sapiens; identical to SEQ ID NO: 94494
  Payload ID: 18848
  Gene Name: ubiquitin A-52 residue ribosomal protein fusion product 1
  Uniprot ID: P62987
  ENSP ID: ENSP00000472545

SEQ ID NO: 94505 - protein, 138 aa, Homo sapiens
  Payload ID: 18848
  Gene Name: ubiquitin A-52 residue ribosomal protein fusion product 1
  ENSP ID: ENSP00000472768
PSDTIENVKAKIQDKEGIPPDQQRLIFAGKQLEDGRTLSDYNIQKESTLHLVLRLRGGIIEPSLRQLAQKYNCDKMICRKYVCSDAWGAVGAAGVGVCPHPPLLSLCRCYARLHPRAVNCRKKKCGHTNNLRPKKKVK

SEQ ID NO: 94506 - protein, 128 aa, Homo sapiens; identical to SEQ ID NO: 94494
  Payload ID: 18848
  Gene Name: ubiquitin A-52 residue ribosomal protein fusion product 1
  Uniprot ID: P62987
  ENSP ID: ENSP00000473048

SEQ ID NO: 94507 - protein, 623 aa, Homo sapiens
  Payload ID: 18849
  Gene Name: ubiquitin associated and SH3 domain containing A
  Uniprot ID: P57075
  ENSP ID: ENSP00000291535
MAAGETQLYAKVSNKLKSRSSPSLLEPLLAMGFPVHTALKALAATGRKTAEEALAWLHDHCNDPSLDDPIPQEYALFLCPTGPLLEKLQEFWRESKRQCAKNRAHEVFPHVTLCDFFTCEDQKVECLYEALKRAGDRLLGSFPTAVPLALHSSISYLGFFVSGSPADVIREFAMTFATEASLLADCSVKPCTKQLHLTLAHKFYPHHQRTLEQLARAIPLGHSCQWTAALYSRDMRFVHYQTLRALFQYKPQNVDELTLSPGDYIFVDPTQQDEASEGWVIGISQRTGCRGFLPENYTDRASESDTWVKHRMYTFSLATDLNSRKDGEASSRCSGEFLPQTARSLSSLQALQATVARKSVLVVRHGERVDQIFGKAWLQQCSTPDGKYYRPDLNFPCSLPRRSRGIKDFENDPPLSSCGIFQSRIAGDALLDSGIRISSVFASPALRCVQTAKLILEELKLEKKIKIRVEPGIFEWTKWEAGKTTPTLMSLEELKEANFNIDTDYRPAFPLSALMPAESYQEYMDRCTASMVQIVNTCPQDTGVILIVSHGSTLDSCTRPLLGLPPRECGDFAQLVRKIPSLGMCFCEENKEEGKWELVNPPVKTLTHGANAAFNWRNWISGN

SEQ ID NO: 94508 - protein, 661 aa, Homo sapiens
  Payload ID: 18849
  Gene Name: ubiquitin associated and SH3 domain containing A
  Uniprot ID: P57075
  ENSP ID: ENSP00000317327
MAAGETQLYAKVSNKLKSRSSPSLLEPLLAMGFPVHTALKALAATGRKTAEEALAWLHDHCNDPSLDDPIPQEYALFLCPTGPLLEKLQEFWRESKRQCAKNRAHEVFPHVTLCDFFTCEDQKVECLYEALKRAGDRLLGSFPTAVPLALHSSISYLGFFVSGSPADVIREFAMTFATEASLLAGTSVSRFWIFSQVPGHGPNLRLSNLTRASFVSHYILQKYCSVKPCTKQLHLTLAHKFYPHHQRTLEQLARAIPLGHSCQWTAALYSRDMRFVHYQTLRALFQYKPQNVDELTLSPGDYIFVDPTQQDEASEGWVIGISQRTGCRGFLPENYTDRASESDTWVKHRMYTFSLATDLNSRKDGEASSRCSGEFLPQTARSLSSLQALQATVARKSVLVVRHGERVDQIFGKAWLQQCSTPDGKYYRPDLNFPCSLPRRSRGIKDFENDPPLSSCGIFQSRIAGDALLDSGIRISSVFASPALRCVQTAKLILEELKLEKKIKIRVEPGIFEWTKWEAGKTTPTLMSLEELKEANFNIDTDYRPAFPLSALMPAESYQEYMDRCTASMVQIVNTCPQDTGVILIVSHGSTLDSCTRPLLGLPPRECGDFAQLVRKIPSLGMCFCEENKEEGKWELVNPPVKTLTHGANAAFNWRNWISGN

SEQ ID NO: 94509 - protein, 526 aa, Homo sapiens
  Payload ID: 18849
  Gene Name: ubiquitin associated and SH3 domain containing A
  Uniprot ID: P57075
  ENSP ID: ENSP00000381408
MAAGETQLYAKVSNKLKSRSSPSLLEPLLAMGFPVHTALKALAATGRKTAEEALAWLHDHCNDPSLDDPIPQEYALFLCPTGPLLEKLQEFWRESKRQCAKNRAHEVFPHVTLCDFFTCEDQKVECLYEALKRAGDRLLGSFPTAVPLALHSSISYLGFFVSGSPADVIREFAMTFATEASLLADCSVKPCTKQLHLTLAHKFYPHHQRTLEQLARAIPLGHSCQWTAALYSRDMRFVHYQTLRALFQYKPQNVDELTLSPGDYIFVDPTQQDEASEGWVIGISQRTGCRGFLPENYTDRASESDTWVKHRMYTFSLATDLNSRKDGEASSRCSGEFLPQTARSLSSLQALQATVARKSVLVVRHGERVDQIFGKAWLQQCSTPDGKYYRPDLNFPCSLPRRSRGIKDFENDPPLSSCGIFQSRIAGDALLDSGIRISSVFASPALRCVQTAKLILEELKLEKKIKIRVEPGIFEWTKWEAGKTTPTLMSLEELKEANFNIDTDYRSLPWACASVKKIKRKENGSW

SEQ ID NO: 94510 - protein, 169 aa, Homo sapiens
  Payload ID: 18849
  Gene Name: ubiquitin associated and SH3 domain containing A
  ENSP ID: ENSP00000489058
MAAGETQLYAKVSNKLKSRSSPSLLEPLLAMGFPVHTALKALAATGRKTAEEALAWLHDHCNDPSLDDPIPQEYALFLCPTGPLLEKLQEFWRESKRQCAKNRAHEVFPHVTLCDFFTCEDQKVECLYEALKRAGDRLLGSFPTAVPLALHSSISYLGFFVSGSPADVI

SEQ ID NO: 94511 - protein, 451 aa, Homo sapiens
  Payload ID: 18849
  Gene Name: ubiquitin associated and SH3 domain containing A
  ENSP ID: ENSP00000489235
MAAGETQLYAKVSNKLKSRSSPSLLEPLLAMGFPVHTALKALAATGRKTAEEALAWLHDHCNDPSLDDPIPQEYALFLCPTGPLLEKLQEFWRESKRQCAKNRAHEVFPHVTLCDFFTCEDQKVECLYEALKRAGDRLLGSFPTAVPLALHSSISYLGFFVSGSPADVIREFAMTFATEASLLADCSVKPCTKQLHLTLAHKFYPHHQRTLEQLARAIPLGHSCQWTAALYSRDMRFVHYQTLRALFQYKPQNVDELTLSPGDYIFVDPTQQDEASEGWVIGISQRTGCRGFLPENYTDRASESDTWVKHRMYTFSLATDLNSRKDGEASSRCSGEFLPQTARSLSSLQALQATVARKSVLVVRHGERVDQIFGKAWLQQCSTPDGKYYRPDLNFPCSLPRRSRGIKDFENDPPLSSCGIFQSRIAGMFEDCLVGKVTITATLIMASRHPA

SEQ ID NO: 94512 - protein, 55 aa, Homo sapiens
  Payload ID: 18849
  Gene Name: ubiquitin associated and SH3 domain containing A
  ENSP ID: ENSP00000489263
MAAGETQLYAKVSNKLKSRSSPSLLEPLLAMGFPVHTALKALAATGRKTAEEALA

SEQ ID NO: 94513 - protein, 38 aa, Homo sapiens
  Payload ID: 18849
  Gene Name: ubiquitin associated and SH3 domain containing A
  ENSP ID: ENSP00000489323
MAAGETQLYAKVSNKLKSRSSPSLLEPLLAMGFPVHTA

SEQ ID NO: 94514 - protein, 521 aa, Homo sapiens
  Payload ID: 18849
  Gene Name: ubiquitin associated and SH3 domain containing A
  ENSP ID: ENSP00000489463
MAAGETQLYAKVSNKLKSRSSPSLLEPLLAMGFPVHTALKALAATGRKTAEEALAWLHDHCNDPSLDDPIPQEYALFLCPTGPLLEKLQEFWRESKRQCAKNRAHEVFPHVTLCDFFTCEDQKVECLYEALKRAGDRLLGSFPTAVPLALHSSISYLGFFVSGSPADVIREFAMTFATEASLLADCSVKPCTKQLHLTLAHKFYPHHQRTLEQLARAIPLGHSCQWTAALYSRDMRFVHYQTLRALFQYKPQNVDELTLSPGDYIFVDPTQQDEASEGWVIGISQRTGCRGFLPENYTDRASESDTWVKHRMYTFSLATDLNSRKDGEASSRCSGEFLPQTARSLSSLQALQATVARKSVLVVRHGERVDQIFGKAWLQQCSTPDGKYYRPDLNFPCSLPRRSRGIKDFENDPPLSSCGIFQSRIAGDALLDSGIRISSVFASPALRCVQTAKLILEELKLEKKIKIRVEPGIFEWTKWEAGKTTPTLMSLEELKEANFNIDTDYSFQHKTGACLLTMSLP

SEQ ID NO: 94515 - protein, 649 aa, Homo sapiens
  Payload ID: 18850
  Gene Name: ubiquitin associated and SH3 domain containing B
  Uniprot ID: Q8TF42
  ENSP ID: ENSP00000284273
MAQYGHPSPLGMAAREELYSKVTPRRNRQQRPGTIKHGSALDVLLSMGFPRARAQKALASTGGRSVQAACDWLFSHVGDPFLDDPLPREYVLYLRPTGPLAQKLSDFWQQSKQICGKNKAHNIFPHITLCQFFMCEDSKVDALGEALQTTVSRWKCKFSAPLPLELYTSSNFIGLFVKEDSAEVLKKFAADFAAEAASKTEVHVEPHKKQLHVTLAYHFQASHLPTLEKLAQNIDVKLGCDWVATIFSRDIRFANHETLQVIYPYTPQNDDELELVPGDFIFMSPMEQTSTSEGWIYGTSLTTGCSGLLPENYITKADECSTWIFHGSYSILNTSSSNSLTFGDGVLERRPYEDQGLGETTPLTIICQPMQPLRVNSQPGPQKRCLFVCRHGERMDVVFGKYWLSQCFDAKGRYIRTNLNMPHSLPQRSGGFRDYEKDAPITVFGCMQARLVGEALLESNTIIDHVYCSPSLRCVQTAHNILKGLQQENHLKIRVEPGLFEWTKWVAGSTLPAWIPPSELAAANLSVDTTYRPHIPISKLVVSESYDTYISRSFQVTKEIISECKSKGNNILIVAHASSLEACTCQLQGLSPQNSKDFVQMVRKIPYLGFCSCEELGETGIWQLTDPPILPLTHGPTGGFNWRETLLQE

SEQ ID NO: 94516 - protein, 502 aa, Homo sapiens
  Payload ID: 18851
  Gene Name: ubiquitin associated protein 1
  Uniprot ID: Q9NZ09
  ENSP ID: ENSP00000297661
MASKKLGADFHGTFSYLDDVPFKTGDKFKTPAKVGLPIGFSLPDCLQVVREVQYDFSLEKKTIEWAEEIKKIEEAEREAECKIAEAEAKVNSKSGPEGDSKMSFSKTHSTATMPPPINPILASLQHNSILTPTRVSSSATKQKVLSPPHIKADFNLADFECEEDPFDNLELKTIDEKEELRNILVGTTGPIMAQLLDNNLPRGGSGSVLQDEEVLASLERATLDFKPLHKPNGFITLPQLGNCEKMSLSSKVSLPPIPAVSNIKSLSFPKLDSDDSNQKTAKLASTFHSTSCLRNGTFQNSLKPSTQSSASELNGHHTLGLSALNLDSGTEMPALTSSQMPSLSVLSVCTEESSPPNTGPTVTPPNFSVSQVPNMPSCPQAYSELQMLSPSERQCVETVVNMGYSYECVLRAMKKKGENIEQILDYLFAHGQLCEKGFDPLLVEEALEMHQCSEEKMMEFLQLMSKFKEMGFELKDIKEVLLLHNNDQDNALEDLMARAGAS

SEQ ID NO: 94517 - protein, 502 aa, Homo sapiens; identical to SEQ ID NO: 94516
  Payload ID: 18851
  Gene Name: ubiquitin associated protein 1
  Uniprot ID: Q9NZ09
  ENSP ID: ENSP00000352541

SEQ ID NO: 94518 - protein, 441 aa, Homo sapiens
  Payload ID: 18851
  Gene Name: ubiquitin associated protein 1
  Uniprot ID: Q9NZ09
  ENSP ID: ENSP00000368484
MASKKLGADFHGTFSYLDDVPFKTGDKFKTPAKVGLPIGFSLPDCLQVVREVQYDFSLEKKTIEWAEEIKKIEEAEREAECKIAEAEAKVNSKSGPEGDSKMSFSKTHSTATMPPPINPILASLQHNSILTPTRVSSSATKQKVLSPPHIKADFNLADFECEEDPFDNLELKTIDEKEELRNILVGTTGPIMAQLLDNNLPRGGSGSVLQDEEVLASLERATLDFKPLHKPNGFITLPQLGNCEKMSLSSKVSLPPIPAVSNIKSLSFPKLDSDDSNQKTAKLASTFHSTSCLRNGTFQNSLKPSTQSSASELNGHHTLGLSALNLDSGTEMPALTSSQMPSLSVLSVCTEESSPPNTGPTILDYLFAHGQLCEKGFDPLLVEEALEMHQCSEEKMMEFLQLMSKFKEMGFELKDIKEVLLLHNNDQDNALEDLMARAGAS

SEQ ID NO: 94519 - protein, 566 aa, Homo sapiens
  Payload ID: 18851
  Gene Name: ubiquitin associated protein 1
  Uniprot ID: Q9NZ09
  ENSP ID: ENSP00000486574
MSGAVRGRRREVGLQHGGCGTGGGYGDGLARSGQSWRWWRSLSLGAVGSSAGTEPGRPAGASTFRLLRRRQQRHSGTFSYLDDVPFKTGDKFKTPAKVGLPIGFSLPDCLQVVREVQYDFSLEKKTIEWAEEIKKIEEAEREAECKIAEAEAKVNSKSGPEGDSKMSFSKTHSTATMPPPINPILASLQHNSILTPTRVSSSATKQKVLSPPHIKADFNLADFECEEDPFDNLELKTIDEKEELRNILVGTTGPIMAQLLDNNLPRGGSGSVLQDEEVLASLERATLDFKPLHKPNGFITLPQLGNCEKMSLSSKVSLPPIPAVSNIKSLSFPKLDSDDSNQKTAKLASTFHSTSCLRNGTFQNSLKPSTQSSASELNGHHTLGLSALNLDSGTEMPALTSSQMPSLSVLSVCTEESSPPNTGPTVTPPNFSVSQVPNMPSCPQAYSELQMLSPSERQCVETVVNMGYSYECVLRAMKKKGENIEQILDYLFAHGQLCEKGFDPLLVEEALEMHQCSEEKMMEFLQLMSKFKEMGFELKDIKEVLLLHNNDQDNALEDLMARAGAS

SEQ ID NO: 94520 - protein, 528 aa, Homo sapiens
  Payload ID: 18851
  Gene Name: ubiquitin associated protein 1
  ENSP ID: ENSP00000487222
EVGLQHGGCGTGGGYGDGLARSGQSWRWWRSLSLGAVGSSAGTEPGRPAGASTFRLLRRRQQRHSGSKWLLRSWVQIFMYDFSLEKKTIEWAEEIKKIEEAEREAECKIAEAEAKVNSKSGPEGDSKMSFSKTHSTATMPPPINPILASLQHNSILTPTRVSSSATKQKVLSPPHIKADFNLADFECEEDPFDNLELKTIDEKEELRNILVGTTGPIMAQLLDNNLPRGGSGSVLQDEEVLASLERATLDFKPLHKPNGFITLPQLGNCEKMSLSSKVSLPPIPAVSNIKSLSFPKLDSDDSNQKTAKLASTFHSTSCLRNGTFQNSLKPSTQSSASELNGHHTLGLSALNLDSGTEMPALTSSQMPSLSVLSVCTEESSPPNTGPTVTPPNFSVSQVPNMPSCPQAYSELQMLSPSERQCVETVVNMGYSYECVLRAMKKKGENIEQILDYLFAHGQLCEKGFDPLLVEEALEMHQCSEEKMMEFLQLMSKFKEMGFELKDIKEVLLLHNNDQDNALEDLMARAGAS

SEQ ID NO: 94521 - protein, 381 aa, Homo sapiens
  Payload ID: 18852
  Gene Name: ubiquitin associated protein 1-like
  Uniprot ID: F5GYI3
  ENSP ID: ENSP00000440243
MNALDGVPFKLPKGFVIGTEPLPGPELSVPACGEVLLGSMHDFSLERTALFWVEAAGQGPSPYQCGDPGTASAPPAWLLLVSPEHGLAPAPTTIRDPEAGHQERPEEEGEDEAEASSGSEEEPAPSSLQPGSPASPGPGRRLCSLDVLRGVRLELAGARRRLSEGKLVSRPRALLHGLRGHRALSLCPSPAQSPRSASPPGPAPQHPAAPASPPRPSTAGAIPPLRSHKPTVASLSPYTCLPPLGGAPQPLNPHKSHPDTAADLLSALSQEEQDLIGPVVALGYPLRRAIIALQKTGRQSLSQFLSYLSACDRLLRQGYEEGLVDEAMEMFQFSESQAGEFLRLWEQFSDMGFQQDRIKEVLLVHGNRREQALEELVACAQ

SEQ ID NO: 94522 - protein, 117 aa, Homo sapiens
  Payload ID: 18852
  Gene Name: ubiquitin associated protein 1-like
  ENSP ID: ENSP00000452794
MNALDGVPFKLPKGFVIGTEPLPGPELSVPACGEVLLGSMHDFSLERTALFWVEAAGQGPSPYQCGDPGTASAPPAWLLLLRPLECLSALSAAPAAPLTLPPSLPASGPVSQLPQCL

SEQ ID NO: 94523 - protein, 381 aa, Homo sapiens; identical to SEQ ID NO: 94521
  Payload ID: 18852
  Gene Name: ubiquitin associated protein 1-like
  Uniprot ID: F5GYI3
  ENSP ID: ENSP00000454012

SEQ ID NO: 94524 - protein, 1119 aa, Homo sapiens
  Payload ID: 18853
  Gene Name: ubiquitin associated protein 2
  Uniprot ID: Q5T6F2
  ENSP ID: ENSP00000354039
MMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGASLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 94525 - protein, 1119 aa, Homo sapiens; identical to SEQ ID NO: 94524
  Payload ID: 18853
  Gene Name: ubiquitin associated protein 2
  Uniprot ID: Q5T6F2
  ENSP ID: ENSP00000368540

SEQ ID NO: 94526 - protein, 358 aa, Homo sapiens
  Payload ID: 18853
  Gene Name: ubiquitin associated protein 2
  Uniprot ID: Q5T6F2
  ENSP ID: ENSP00000368541
MNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 94527 - protein, 278 aa, Homo sapiens
  Payload ID: 18853
  Gene Name: ubiquitin associated protein 2
  ENSP ID: ENSP00000412954
  MOD_RES (1)..(1): Any amino acid
XEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHL

SEQ ID NO: 94528 - protein, 412 aa, Homo sapiens
  Payload ID: 18853
  Gene Name: ubiquitin associated protein 2
  ENSP ID: ENSP00000414800
MMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKL

SEQ ID NO: 94529 - protein, 117 aa, Homo sapiens
  Payload ID: 18853
  Gene Name: ubiquitin associated protein 2
  ENSP ID: ENSP00000433983
HNRIPYQSPVSSSESAPGTIMNGHGGGRSQQTLDTPKTTGPPSALPSVSSLPSTTSCTALLPSTSQHTGDLTSSPLSQLSSMPVWRAPLPTSPQPPSPRQRPPSQVPHPQAPACPVA

SEQ ID NO: 94530 - protein, 581 aa, Homo sapiens
  Payload ID: 18853
  Gene Name: ubiquitin associated protein 2
  ENSP ID: ENSP00000439329
MMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKKHTGDLTSSPLSQLSSSLSSHQSSLSAHAALSSSTSHTHASVESASSHQSSATFSTAATSVSSSASSGASLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTSSATAEPITDPPHSPAALRESCTATWSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSPAPCSPSLKPPNLPTLSILDKLNPEERGGLGQGLSWAGENTRARIWEPSALS

SEQ ID NO: 94531 - protein, 176 aa, Homo sapiens
  Payload ID: 18853
  Gene Name: ubiquitin associated protein 2
  ENSP ID: ENSP00000486626
MRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRELASNTHNIAQDLSNKSSYGLKGAWKNSVEEWTTEDWTEDH

SEQ ID NO: 94532 - protein, 1079 aa, Homo sapiens
  Payload ID: 18854
  Gene Name: ubiquitin associated protein 2-like
  ENSP ID: ENSP00000271877
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGRECMHGALSKPAVVRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGVSVTSSNTGVPDISGSVYSKTQQSFEKQGFHSGTPAASFNLPSALGSGGPINPATAAAYPPAPFMHILTPHQQPHSQILHHHLQQDGQDILNFVDDQLGE

SEQ ID NO: 94533 - protein, 983 aa, Homo sapiens
  Payload ID: 18854
  Gene Name: ubiquitin associated protein 2-like
  Uniprot ID: Q14157
  ENSP ID: ENSP00000345308
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGRKYPPPYKHFWTAES

SEQ ID NO: 94534 - protein, 1087 aa, Homo sapiens
  Payload ID: 18854
  Gene Name: ubiquitin associated protein 2-like
  Uniprot ID: Q14157
  ENSP ID: ENSP00000355343
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGVSVTSSNTGVPDISGSVYSKTQQSFEKQGFHSGTPAASFNLPSALGSGGPINPATAAAYPPAPFMHILTPHQQPHSQILHHHLQQDGQTGSGQRSQTSSIPQKPQTNKSAYNSYSWGAN

SEQ ID NO: 94535 - protein, 350 aa, Homo sapiens
  Payload ID: 18854
  Gene Name: ubiquitin associated protein 2-like
  ENSP ID: ENSP00000357490
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGRECMHGALSKPAVVRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMV

SEQ ID NO: 94536 - protein, 280 aa, Homo sapiens
  Payload ID: 18854
  Gene Name: ubiquitin associated protein 2-like
  ENSP ID: ENSP00000389052
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQ

SEQ ID NO: 94537 - protein, 1087 aa, Homo sapiens; identical to SEQ ID NO: 94534
  Payload ID: 18854
  Gene Name: ubiquitin associated protein 2-like
  Uniprot ID: Q14157
  ENSP ID: ENSP00000389445

SEQ ID NO: 94538 - protein, 265 aa, Homo sapiens
  Payload ID: 18854
  Gene Name: ubiquitin associated protein 2-like
  ENSP ID: ENSP00000389717
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRVRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAE

SEQ ID NO: 94539 - protein, 383 aa, Homo sapiens
  Payload ID: 18854
  Gene Name: ubiquitin associated protein 2-like
  ENSP ID: ENSP00000398609
  MOD_RES (1)..(1): Any amino acid
XVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGVSVTSSNTGVPDISGSVYSKTQQSFEKQGFHSGTPAASFNLPSALGSGGPINPATAAAYPPAPFMHILTPHQQPHSQILHHHLQQDGQLPYLQMILCCQRQQEEQTGSGQRSQTSSIPQKPQTNKSAYNSYSWGAN

SEQ ID NO: 94540 - protein, 182 aa, Homo sapiens
  Payload ID: 18854
  Gene Name: ubiquitin associated protein 2-like
  ENSP ID: ENSP00000399920
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRG

SEQ ID NO: 94541 - protein, 399 aa, Homo sapiens
  Payload ID: 18854
  Gene Name: ubiquitin associated protein 2-like
  ENSP ID: ENSP00000407672
  MOD_RES (1)..(1): Any amino acid
XQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGVSVTSSNTGVPDISGSVYSKTQQSFEKQGFHSGTPAASFNLPSALGSGGPINPATAAAYPPAPFMHILTPHQQPHSQILHHHLQQDGQDILNFVDDQLGE

SEQ ID NO: 94542 - protein, 234 aa, Homo sapiens
  Payload ID: 18854
  Gene Name: ubiquitin associated protein 2-like
  ENSP ID: ENSP00000415310
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGT

SEQ ID NO: 94543 - protein, 976 aa, Homo sapiens
  Payload ID: 18854
  Gene Name: ubiquitin associated protein 2-like
  Uniprot ID: Q14157
  ENSP ID: ENSP00000478447
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRVRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGRKYPPPYKHFWTAES

SEQ ID NO: 94544 - protein, 229 aa, Homo sapiens
  Payload ID: 18855
  Gene Name: ubiquitin B
  Uniprot ID: P0CG47
  ENSP ID: ENSP00000304697
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGC

SEQ ID NO: 94545 - protein, 229 aa, Homo sapiens; identical to SEQ ID NO: 94544
  Payload ID: 18855
  Gene Name: ubiquitin B
  Uniprot ID: P0CG47
  ENSP ID: ENSP00000379178

SEQ ID NO: 94546 - protein, 229 aa, Homo sapiens; identical to SEQ ID NO: 94544
  Payload ID: 18855
  Gene Name: ubiquitin B
  Uniprot ID: P0CG47
  ENSP ID: ENSP00000379180

SEQ ID NO: 94547 - protein, 153 aa, Homo sapiens
  Payload ID: 18855
  Gene Name: ubiquitin B
  ENSP ID: ENSP00000437475
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGC

SEQ ID NO: 94548 - protein, 206 aa, Homo sapiens
  Payload ID: 18855
  Gene Name: ubiquitin B
  ENSP ID: ENSP00000463156
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGR

SEQ ID NO: 94549 - protein, 93 aa, Homo sapiens
  Payload ID: 18855
  Gene Name: ubiquitin B
  ENSP ID: ENSP00000464510
MQIFVKTLTGKTITLEVEPSDTIENVKAKIQDKEGIPPDQQRLIFAGKQLEDGRTLSDYNIQKESTLHLVLRLRGGMQIFVKTLTGKTITLEV

SEQ ID NO: 94550 - protein, 43 aa, Homo sapiens
  Payload ID: 18855
  Gene Name: ubiquitin B
  ENSP ID: ENSP00000464594
MQIFVKTLTGKTITLEVEPSDTIENVKAKIQDKEGIPPDQQRL

SEQ ID NO: 94551 - protein, 229 aa, Homo sapiens; identical to SEQ ID NO: 94544
  Payload ID: 18855
  Gene Name: ubiquitin B
  Uniprot ID: P0CG47
  ENSP ID: ENSP00000478771

SEQ ID NO: 94552 - protein, 685 aa, Homo sapiens
  Payload ID: 18856
  Gene Name: ubiquitin C
  Uniprot ID: P0CG48
  ENSP ID: ENSP00000344818
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 94553 - protein, 122 aa, Homo sapiens
  Payload ID: 18856
  Gene Name: ubiquitin C
  ENSP ID: ENSP00000437452
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFA

SEQ ID NO: 94554 - protein, 136 aa, Homo sapiens
  Payload ID: 18856
  Gene Name: ubiquitin C
  ENSP ID: ENSP00000438289
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYN

SEQ ID NO: 94555 - protein, 229 aa, Homo sapiens
  Payload ID: 18856
  Gene Name: ubiquitin C
  ENSP ID: ENSP00000438394
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 94556 - protein, 149 aa, Homo sapiens
  Payload ID: 18856
  Gene Name: ubiquitin C
  ENSP ID: ENSP00000439492
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRL

SEQ ID NO: 94557 - protein, 169 aa, Homo sapiens
  Payload ID: 18856
  Gene Name: ubiquitin C
  ENSP ID: ENSP00000440205
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEV

SEQ ID NO: 94558 - protein, 134 aa, Homo sapiens
  Payload ID: 18856
  Gene Name: ubiquitin C
  ENSP ID: ENSP00000441238
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSD

SEQ ID NO: 94559 - protein, 685 aa, Homo sapiens; identical to SEQ ID NO: 94552
  Payload ID: 18856
  Gene Name: ubiquitin C
  Uniprot ID: P0CG48
  ENSP ID: ENSP00000441543

SEQ ID NO: 94560 - protein, 61 aa, Homo sapiens
  Payload ID: 18856
  Gene Name: ubiquitin C
  ENSP ID: ENSP00000441556
MQIFVKTLTGKTITLEVEPSDTIENVKAKIQDKEGIPPDQQRLIFAGKQLEDGRTLSDYNI

SEQ ID NO: 94561 - protein, 160 aa, Homo sapiens
  Payload ID: 18856
  Gene Name: ubiquitin C
  ENSP ID: ENSP00000442800
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTL

SEQ ID NO: 94562 - protein, 305 aa, Homo sapiens
  Payload ID: 18856
  Gene Name: ubiquitin C
  ENSP ID: ENSP00000443053
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 94563 - protein, 155 aa, Homo sapiens
  Payload ID: 18856
  Gene Name: ubiquitin C
  ENSP ID: ENSP00000445337
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQI

SEQ ID NO: 94564 - protein, 223 aa, Homo sapiens [sequence omitted]

SEQ ID NO: 94565 - protein, 223 aa, Homo sapiens [sequence omitted]

SEQ ID NO: 94566 - protein, 156 aa, Homo sapiens
  Payload ID: 18857
  Gene Name: ubiquitin carboxyl-terminal esterase L1 (ubiquitin thiolesterase)
  ENSP ID: ENSP00000423348
MQLKPMEINPEMLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRMTR

SEQ ID NO: 94567 - protein, 241 aa, Homo sapiens
  Payload ID: 18857
  Gene Name: ubiquitin carboxyl-terminal esterase L1 (ubiquitin thiolesterase)
  ENSP ID: ENSP00000423623
MQLKPMEINPEMLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRVDDKVNFHFILFNNVDGHLYELDGRMPFPVNHGASSEDTLLKVIFGMHLFLMTLPRSAENSPSVSKEKSASLPWLSARQPNALWEGLC

SEQ ID NO: 94568 - protein, 69 aa, Homo sapiens
  Payload ID: 18857
  Gene Name: ubiquitin carboxyl-terminal esterase L1 (ubiquitin thiolesterase)
  ENSP ID: ENSP00000425714
MQLKPMEINPEVSARCCPGWGSPASGASWTCWGWKRSLWARCQRLPARCCCCFPSRPSMRTSGKSRLKS

SEQ ID NO: 94569 - protein, 58 aa, Homo sapiens
  Payload ID: 18857
  Gene Name: ubiquitin carboxyl-terminal esterase L1 (ubiquitin thiolesterase)
  ENSP ID: ENSP00000426634
MQLKPMEINPEMLNKVLSRLGVAGQWRFVDVLGLEEESLGSVPAPACALLLLFPLTAQ

SEQ ID NO: 94570 - protein, 207 aa, Homo sapiens
  Payload ID: 18857
  Gene Name: ubiquitin carboxyl-terminal esterase L1 (ubiquitin thiolesterase)
  ENSP ID: ENSP00000426895
MQLKPMEINPEMLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEVDDKVNFHFILFNNVDGHLYELDGRMPFPVNHGASSEDTLLKDAAKVCREFTEREQGEVRFSAVALCKAA

SEQ ID NO: 94571 - protein, 230 aa, Homo sapiens
  Payload ID: 18858
  Gene Name: ubiquitin carboxyl-terminal esterase L3 (ubiquitin thiolesterase)
  Uniprot ID: P15374
  ENSP ID: ENSP00000366819
MEGQRWLPLEANPEVTNQFLKQLGLHPNWQFVDVYGMDPELLSMVPRPVCAVLLLFPITEKYEVFRTEEEEKIKSQGQDVTSSVYFMKQTISNACGTIGLIHAIANNKDKMHFESGSTLKKFLEESVSMSPEERARYLENYDAIRVTHETSAHEGQTEAPSIDEKVDLHFIALVHVDGHLYELDGRKPFPINHGETSDETLLEDAIEVCKKFMERDPDELRFNAIALSAA

SEQ ID NO: 94572 - protein, 228 aa, Homo sapiens
  Payload ID: 18858
  Gene Name: ubiquitin carboxyl-terminal esterase L3 (ubiquitin thiolesterase)
  ENSP ID: ENSP00000398189
TEEEEKIKSQGQDVTSSVYFMKQTISNACGTIGLIHAIANNKDKMHFESGSTLKKFLEESVSMSPEERARYLENYDAIRVTHETSAHEGQTESSSPSSSQPHSSHCRTKASSLCHHASLPWVKRNHVGPAKATSPSLRLRRWRPFLRLPSLGLHSVAPSIDEKVDLHFIALVHVDGHLYELDGRKPFPINHGETSDETLLEDAIEVCKKFMERDPDELRFNAIALSAA

SEQ ID NO: 94573 - protein, 194 aa, Homo sapiens
  Payload ID: 18858
  Gene Name: ubiquitin carboxyl-terminal esterase L3 (ubiquitin thiolesterase)
  ENSP ID: ENSP00000477746
MDPELLSMVPRPVCAVLLLFPITEKYEVFRTEEEEKIKSQGQDVTSSVYFMKQTISNACGTIGLIHAIANNKDKMHFESGSTLKKFLEESVSMSPEERARYLENYDAIRVTHETSAHEGQTEAPSIDEKVDLHFIALVHVDGHLYELDGRKPFPINHGETSDETLLEDAIEVCKKFMERDPDELRFNAIALSAA

SEQ ID NO: 94574 - protein, 326 aa, Homo sapiens
  Payload ID: 18859
  Gene Name: ubiquitin carboxyl-terminal hydrolase L5
  Uniprot ID: Q9Y5K5
  ENSP ID: ENSP00000356418
MTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKFEKHFEKTLLGK

SEQ ID NO: 94575 - protein, 316 aa, Homo sapiens
  Payload ID: 18859
  Gene Name: ubiquitin carboxyl-terminal hydrolase L5
  Uniprot ID: Q9Y5K5
  ENSP ID: ENSP00000356419
MTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKGK

SEQ ID NO: 94576 - protein, 368 aa, Homo sapiens
  Payload ID: 18859
  Gene Name: ubiquitin carboxyl-terminal hydrolase L5
  ENSP ID: ENSP00000356420
ARGGSGRCVARAMTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKDGFSPCCPGWSQTPELKPSACLDLPKWYSEGEIRFNLMAIVSDRKMIYEQKIAELQRQLAEEEPMDTDQGNSMLSAIQSEVAKNQMLIEEEVQKLKRYKIENIRRKHNYLPFIMELLKTLAEHQQLIPLVEKAKEKQNAKKAQETK

SEQ ID NO: 94577 - protein, 355 aa, Homo sapiens
  Payload ID: 18859
  Gene Name: ubiquitin carboxyl-terminal hydrolase L5
  ENSP ID: ENSP00000356421
MTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKDGFSPCCPGWSQTPELKPSACLDLPKWYSEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKAKEKQNAKKAQETK

SEQ ID NO: 94578 - protein, 328 aa, Homo sapiens
  Payload ID: 18859
  Gene Name: ubiquitin carboxyl-terminal hydrolase L5
  Uniprot ID: Q9Y5K5
  ENSP ID: ENSP00000356424
MTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKAKEKQNAKKAQETK

SEQ ID NO: 94579 - protein, 329 aa, Homo sapiens
  Payload ID: 18859
  Gene Name: ubiquitin carboxyl-terminal hydrolase L5
  Uniprot ID: Q9Y5K5
  ENSP ID: ENSP00000356425
MTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEEPMDTDQGNSMLSAIQSEVAKNQMLIEEEVQKLKRYKIENIRRKHNYLPFIMELLKTLAEHQQLIPLVEKAKEKQNAKKAQETK

SEQ ID NO: 94580 - protein, 258 aa, Homo sapiens
  Payload ID: 18859
  Gene Name: ubiquitin carboxyl-terminal hydrolase L5
  ENSP ID: ENSP00000389563
MSLGWLERPPALSRAAGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEPMDTDQGNSMLSAIQSEVAKNQ

SEQ ID NO: 94581 - protein, 183 aa, Homo sapiens
  Payload ID: 18859
  Gene Name: ubiquitin carboxyl-terminal hydrolase L5
  ENSP ID: ENSP00000391153
  MOD_RES (1)..(1): Any amino acid
XQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEEPMDTDQGNSMLSAIQSEVAKNQMLIEEEVQKLKRYKIENIRRKHNYLPFIMELLKTLAEHQQLIPLVEKFEKHFEKTLLGK

SEQ ID NO: 94582 - protein, 99 aa, Homo sapiens
  Payload ID: 18859
  Gene Name: ubiquitin carboxyl-terminal hydrolase L5
  ENSP ID: ENSP00000392416
  MOD_RES (1)..(1): Any amino acid
XNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKIF

SEQ ID NO: 94583 - protein, 115 aa, Homo sapiens
  Payload ID: 18859
  Gene Name: ubiquitin carboxyl-terminal hydrolase L5
  ENSP ID: ENSP00000402847
  MOD_RES (1)..(1): Any amino acid
XEGEIRFNLMAIVSDRKMIYEQKIAELQRQLAEEPMDTDQGNSMLSAIQSEVAKNQMLIEEEVQKLKRYKIENIRRKHNYLPFIMELLKTLAEHQQLIPLVEKFEKHFEKTLLGK

SEQ ID NO: 94584 - protein, 218 aa, Homo sapiens
  Payload ID: 18859
  Gene Name: ubiquitin carboxyl-terminal hydrolase L5
  ENSP ID: ENSP00000408720
  MOD_RES (1)..(1): Any amino acid
XLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEEPMDTDQGNSMLSAIQSEVAKNQMLIEEEVQKLKRYKIENIRRKHNYLPFIMELLKTLAEHQQLIPLVEKFEKHFEKTLLGK

SEQ ID NO: 94585 - protein, 165 aa, Homo sapiens
  Payload ID: 18859
  Gene Name: ubiquitin carboxyl-terminal hydrolase L5
  ENSP ID: ENSP00000412265
MVRPGLARMSLPRCWFRYPGWTGAEAGRGRAIVSRRLPSLNPWDAGERHGGLVRICASLGPHKRLPAGLPQCPHLYLAADPLDPQRRQEKSCAALGNDKRRQPDGQRQPQQQQQPHCRRGFQAPALPNPLRVLQGLGRVSMSLGWLERPPALSRAAGCRGAQVEE

SEQ ID NO: 94586 - protein, 165 aa, Homo sapiens
  Payload ID: 18860
  Gene Name: ubiquitin D
  Uniprot ID: O15205
  ENSP ID: ENSP00000366249
MAPNASCLCVHVRSEEWDLMTFDANPYDSVKKIKEHVRSKTKVPVQDQVLLLGSKILKPRRSLSSYGIDKEKTIHLTLKVVKPSDEELPLFLVESGDEAKRHLLQVRRSSSVAQVKAMIETKTGIIPETQIVTCNGKRLEDGKMMADYGIRKGNLLFLACYCIGG

SEQ ID NO: 94587 - protein, 165 aa, Homo sapiens
  Payload ID: 18860
  Gene Name: ubiquitin D
  Uniprot ID: O15205
  ENSP ID: ENSP00000373039
MAPNASCLCVHVRSEEWDLMTFDANPYDSVKKIKEHVRSKTKVPVQDQVLLLGSKILKPRRSLSSYGIDKEKTIHLTLKVVKPSDEELPLFLVESGDEAKRHLLQVRRSSSVAQVKAMIETKTGIIPETQIVTCNGKRLEDGKMMADYGIRKGNLLFLASYCIGG

SEQ ID NO: 94588 - protein, 165 aa, Homo sapiens
  Payload ID: 18860
  Gene Name: ubiquitin D
  ENSP ID: ENSP00000373137
MAPNASCLCVHVRSEEWDLMTFDANPYDSVKKIKEHVRSKTKVPVQDQVLLLGSKILKPRRSLSSYGTDKEKTIHLTLKVVKPSDEELPLFLVESGDEAKRHLLQVRRSSSVAQVKAMIETKTGIIPETQIVTCNGKRLEDGKMMADYGIRKGNLLFLASYCIGG

SEQ ID NO: 94589 - protein, 165 aa, Homo sapiens; identical to SEQ ID NO: 94586
  Payload ID: 18860
  Gene Name: ubiquitin D
  Uniprot ID: O15205
  ENSP ID: ENSP00000396152

SEQ ID NO: 94590 - protein, 165 aa, Homo sapiens; identical to SEQ ID NO: 94588
  Payload ID: 18860
  Gene Name: ubiquitin D
  ENSP ID: ENSP00000396477

SEQ ID NO: 94591 - protein, 165 aa, Homo sapiens; identical to SEQ ID NO: 94588
  Payload ID: 18860
  Gene Name: ubiquitin D
  ENSP ID: ENSP00000398539

SEQ ID NO: 94592 - protein, 165 aa, Homo sapiens; identical to SEQ ID NO: 94587
  Payload ID: 18860
  Gene Name: ubiquitin D
  Uniprot ID: O15205
  ENSP ID: ENSP00000410416

SEQ ID NO: 94593 - protein, 227 aa, Homo sapiens
  Payload ID: 18861
  Gene Name: ubiquitin domain containing 1
  Uniprot ID: Q9HAC8
  ENSP ID: ENSP00000359698
MGNCVGRQRRERPAAPGHPRKRAGRNEPLKKERLKWKSDYPMTDGQLRSKRDEFWDTAPAFEGRKEIWDALKAAAYAAEANDHELAQAILDGASITLPHGTLCECYDELGNRYQLPIYCLSPPVNLLLEHTEEESLEPPEPPPSVRREFPLKVRLSTGKDVRLSASLPDTVGQLKRQLHAQEGIEPSWQRWFFSGKLLTDRTRLQETKIQKDFVIQVIINQPPPPQD

SEQ ID NO: 94594 - protein, 234 aa, Homo sapiens
  Payload ID: 18862
  Gene Name: ubiquitin domain containing 2
  Uniprot ID: Q8WUN7
  ENSP ID: ENSP00000377381
MGGCVGAQHDSSGSLNENSEGTGVALGRNQPLKKEKPKWKSDYPMTDGQLRSKRDEFWDTAPAFEGRKEIWDALKAAAHAFESNDHELAQAIIDGANITLPHGALTECYDELGNRYQLPVYCLAPPINMIEEKSDIETLDIPEPPPNSGYECQLRLRLSTGKDLKLVVRSTDTVFHMKRRLHAAEGVEPGSQRWFFSGRPLTDKMKFEELKIPKDYVVQVIVSQPVQNPTPVEN

SEQ ID NO: 94595 - protein, 309 aa, Homo sapiens
  Payload ID: 18863
  Gene Name: ubiquitin family domain containing 1
  Uniprot ID: O14562
  ENSP ID: ENSP00000379217
MAAAGAPDGMEEPGMDTEAETVATEAPARPVNCLEAEAAAGAAAEDSGAARGSLQPAPAQPPGDPAAQASVSNGEDAGGGAGRELVDLKIIWNKTKHDVKFPLDSTGSELKQKIHSITGLPPAMQKVMYKGLVPEDKTLREIKVTSGAKIMVVGSTINDVLAVNTPKDAAQQDAKAEENKKEPLCRQKQHRKVLDKGKPEDVMPSVKGAQERLPTVPLSGMYNKSGGKVRLTFKLEQDQLWIGTKERTEKLPMGSIKNVVSEPIEGHEDYHMMAFQLGPTEASYYWVYWVPTQYVDAIKDTVLGKWQYF

SEQ ID NO: 94596 - protein, 300 aa, Homo sapiens
  Payload ID: 18863
  Gene Name: ubiquitin family domain containing 1
  ENSP ID: ENSP00000456292
MEEPGMDTEAETVATEAPARPVNCLEAEAAAGAAAEDSGAARGSLQPAPAQPPGDPAAQASVSNGEDAGGGAGRELVDLKIIWNKTKHDVKFPLDSTGSELKQKIHSITGLPPAMQKVMYKGLVPEDKTLREIKVTSGAKIMVVGSTINDVLAVNTPKDAAQQDAKAEENKKEPLCRQKQHRKVLDKGKPEDVMPSVKGAQERLPTVPLSGMYNKSGGKVRLTFKLEQDQLWIGTKERTEKLPMGSIKNVVSEPIEGHEDYHMMAFQLGPTEASYYWVYWVPTQYVDAIKDTVLGKWQYF

SEQ ID NO: 94597 - protein, 190 aa, Homo sapiens
  Payload ID: 18863
  Gene Name: ubiquitin family domain containing 1
  ENSP ID: ENSP00000457713
MAAAGAPDGMEEPGMDTEAETVATEAPARPVNCLEAEAAAGAAAEDSGAARGSLQPAPAQPPGDPAAQASVSNGEDAGGGAGRELVDLKIIWNKTKHDVKFPLDSTGSELKQKIHSITGLPPAMQKVMYKGLVPEDKTLREIKVTSGAKIMVVGSTINDVLAVNTPKDAAQQDAKAEENKKEPLCRQKGP

SEQ ID NO: 94598 - protein, 307 aa, Homo sapiens
  Payload ID: 18864
  Gene Name: ubiquitin fusion degradation 1 like (yeast)
  Uniprot ID: Q92890
  ENSP ID: ENSP00000263202
MFSFNMFDHPIPRVFQNRFSTQYRCFSVSMLAGPNDRSDVEKGGKIIMPPSALDQLSRLNITYPMLFKLTNKNSDRMTHCGVLEFVADEGICYLPHWMMQNLLLEEGGLVQVESVNLQVATYSKFQPQSPDFLDITNPKAVLENALRNFACLTTGDVIAINYNEKIYELRVMETKPDKAVSIIECDMNVDFDAPLGYKEPERQVQHEESTEGEADHSGYAGELGFRAFSGSGNRLDGKKKGVEPSPSPIKPGDIKRGIPNYEFKLGKITFIRNSRPLVKKVEEDEAGGRFVAFSGEGQSLRKKGRKP

SEQ ID NO: 94599 - protein, 266 aa, Homo sapiens
  Payload ID: 18864
  Gene Name: ubiquitin fusion degradation 1 like (yeast)
  Uniprot ID: Q92890
  ENSP ID: ENSP00000382439
MFSFNMFDHPIPRVFQNRFSTQYRCFSVSMLAGPNDRSDVEKGGKIIMPPSALDQLSRLNITYPMLFKLTNKNSDRMTHCGVLEFVADEGICYLPHWMMQNLLLEEGGLVQVESVNLQVATYSKFQPQSPDFLDITNPKAVLENALRNFACLTTGDVIAINYNEKIYELRVMETKPDKAVSIIECDMNVDFDAPLGYKEPERQVQHEESTEGEADHSGYAGELGFRAFSGSGNRLDGKKKGVEPSPSPIKPGDIKRGIPNYEFKLG

SEQ ID NO: 94600 - protein, 159 aa, Homo sapiens
  Payload ID: 18864
  Gene Name: ubiquitin fusion degradation 1 like (yeast)
  ENSP ID: ENSP00000402136
MMMQNLLLEEGGLVQVESVNLQVATYSKFQPQSPDFLDITNPKAVLENALRNFACLTTGDVIAINYNEKIYELRVMETKPDKAVSIIECDMNVDFDAPLGYKEPERQVQHEESTEGEADHSGYAGELGFRAFSGSGNRLDGKKKGVEPSPSPIKPGDIK

SEQ ID NO: 94601 - protein, 190 aa, Homo sapiens
  Payload ID: 18864
  Gene Name: ubiquitin fusion degradation 1 like (yeast)
  ENSP ID: ENSP00000406680
MFSFNMFDHPIPRVFQNRFSTQYRCFSVSMLAGPNDRSDVEKGGKSRLNITYPMLFKLTNKNSDRMTHCGVLEFVADEGICYLPHWMMQNLLLEEGGLVQVESVNLQVATYSKFQPQSPDFLDITNPKAVLENALRNFACLTTGDVIAINYNEKIYELRVMETKPDKAVSIIECDMNVDFDAPLGYKEPE

SEQ ID NO: 94602 - protein, 69 aa, Homo sapiens
  Payload ID: 18864
  Gene Name: ubiquitin fusion degradation 1 like (yeast)
  ENSP ID: ENSP00000418295
MLFKLTNKNSDRMTHCGVLEFVADEGICYLPHWMMQNLLLEEGGLVQVESVNLQVATYSKFQPQSPDFL

SEQ ID NO: 94603 - protein, 135 aa, Homo sapiens
  Payload ID: 18864
  Gene Name: ubiquitin fusion degradation 1 like (yeast)
  ENSP ID: ENSP00000418390
MFDHPIPRVFQNRFSTQYRCFSVSMLAGPNDRSDVEKGGKIIMPPSALDQLSRLNITYPMLFKLTNKNSDRMTHCGVLEFVADEGICYLPHWMMQNLLLEEGGLVQVESVNLQVATYSKFQPQSPDFLDITNPKA

SEQ ID NO: 94604 - protein, 719 aa, Homo sapiens
  Payload ID: 18865
  Gene Name: ubiquitin interaction motif containing 1
  Uniprot ID: Q96RL1
  ENSP ID: ENSP00000366434
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQESTGRGSAFLKAVQGSGDTSRHCLPTLADAKGLQDTGGTVNYFWGIPFCPDGVDPNQYTKVILCQLEVYQKSLKMAQRQLLNKKGFGEPVLPRPPSLIQNECGQGEQASEKNECISEDMGDEDKEERQESRASDWHSKTKDFQESSIKSLKEKLLLEEEPTTSHGQSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 94605 - protein, 719 aa, Homo sapiens; identical to SEQ ID NO: 94604
  Payload ID: 18865
  Gene Name: ubiquitin interaction motif containing 1
  Uniprot ID: Q96RL1
  ENSP ID: ENSP00000421926

SEQ ID NO: 94606 - protein, 31 aa, Homo sapiens
  Payload ID: 18865
  Gene Name: ubiquitin interaction motif containing 1
  ENSP ID: ENSP00000423534
MPRRKKKVKEVSESRNLEKKDVETTSSVSVK

SEQ ID NO: 94607 - protein, 349 aa, Homo sapiens
  Payload ID: 18865
  Gene Name: ubiquitin interaction motif containing 1
  Uniprot ID: Q96RL1
  ENSP ID: ENSP00000423717
MLPLPDLDLWPLDRLPSPIKRKPQTLGSLKSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 94608 - protein, 157 aa, Homo sapiens
  Payload ID: 18865
  Gene Name: ubiquitin interaction motif containing 1
  ENSP ID: ENSP00000423885
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGIW

SEQ ID NO: 94609 - protein, 89 aa, Homo sapiens
  Payload ID: 18865
  Gene Name: ubiquitin interaction motif containing 1
  ENSP ID: ENSP00000425163
MPRRKKKVKEVSESRNLEKKDVETTSSVSVKRKRRLEDAFIVISDSDGEEPKEENGLQKTKTKQSNRAKCLAKRKIAQMTEEEQFALAL

SEQ ID NO: 94610 - protein, 166 aa, Homo sapiens
  Payload ID: 18865
  Gene Name: ubiquitin interaction motif containing 1
  ENSP ID: ENSP00000425566
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGMHMAAGTSITV

SEQ ID NO: 94611 - protein, 553 aa, Homo sapiens
  Payload ID: 18865
  Gene Name: ubiquitin interaction motif containing 1
  Uniprot ID: Q96RL1
  ENSP ID: ENSP00000427480
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 94612 - protein, 1749 aa, Homo sapiens
  Payload ID: 18866
  Gene Name: ubiquitin protein ligase E3 component n-recognin 1
  Uniprot ID: Q8IWV7
  ENSP ID: ENSP00000290650
MADEEAGGTERMEISAELPQTPQRLASWWDQQVDFYTAFLHHLAQLVPEIYFAEMDPDLEKQEESVQMSIFTPLEWYLFGEDPDICLEKLKHSGAFQLCGRVFKSGETTYSCRDCAIDPTCVLCMDCFQDSVHKNHRYKMHTSTGGGFCDCGDTEAWKTGPFCVNHEPGRAGTIKENSRCPLNEEVIVQARKIFPSVIKYVVEMTIWEEEKELPPELQIREKNERYYCVLFNDEHHSYDHVIYSLQRALDCELAEAQLHTTAIDKEGRRAVKAGAYAACQEAKEDIKSHSENVSQHPLHVEVLHSEIMAHQKFALRLGSWMNKIMSYSSDFRQIFCQACLREEPDSENPCLISRLMLWDAKLYKGARKILHELIFSSFFMEMEYKKLFAMEFVKYYKQLQKEYISDDHDRSISITALSVQMFTVPTLARHLIEEQNVISVITETLLEVLPEYLDRNNKFNFQGYSQDKLGRVYAVICDLKYILISKPTIWTERLRMQFLEGFRSFLKILTCMQGMEEIRRQVGQHIEVDPDWEAAIAIQMQLKNILLMFQEWCACDEELLLVAYKECHKAVMRCSTSFISSSKTVVQSCGHSLETKSYRVSEDLVSIHLPLSRTLAGLHVRLSRLGAVSRLHEFVSFEDFQVEVLVEYPLRCLVLVAQVVAEMWRRNGLSLISQVFYYQDVKCREEMYDKDIIMLQIGASLMDPNKFLLLVLQRYELAEAFNKTISTKDQDLIKQYNTLIEEMLQVLIYIVGERYVPGVGNVTKEEVTMREIIHLLCIEPMPHSAIAKNLPENENNETGLENVINKVATFKKPGVSGHGVYELKDESLKDFNMYFYHYSKTQHSKAEHMQKKRRKQENKDEALPPPPPPEFCPAFSKVINLLNCDIMMYILRTVFERAIDTDSNLWTEGMLQMAFHILALGLLEEKQQLQKAPEEEVTFDFYHKASRLGSSAMNIQMLLEKLKGIPQLEGQKDMITWILQMFDTVKRLREKSCLIVATTSGSESIKNDEITHDKEKAERKRKAEAARLHRQKIMAQMSALQKNFIETHKLMYDNTSEMPGKEDSIMEEESTPAVSDYSRIALGPKRGPSVTEKEVLTCILCQEEQEVKIENNAMVLSACVQKSTALTQHRGKPIELSGEALDPLFMDPDLAYGTYTGSCGHVMHAVCWQKYFEAVQLSSQQRIHVDLFDLESGEYLCPLCKSLCNTVIPIIPLQPQKINSENADALAQLLTLARWIQTVLARISGYNIRHAKGENPIPIFFNQGMGDSTLEFHSILSFGVESSIKYSNSIKEMVILFATTIYRIGLKVPPDERDPRVPMLTWSTCAFTIQAIENLLGDEGKPLFGALQNRQHNGLKALMQFAVAQRITCPQVLIQKHLVRLLSVVLPNIKSEDTPCLLSIDLFHVLVGAVLAFPSLYWDDPVDLQPSSVSSSYNHLYLFHLITMAHMLQILLTVDTGLPLAQVQEDSEEAHSASSFFAEISQYTSGSIGCDIPGWYLWVSLKNGITPYLRCAALFFHYLLGVTPPEELHTNSAEGEYSALCSYLSLPTNLFLLFQEYWDTVRPLLQRWCADPALLNCLKQKNTVVRYPRKRNSLIELPDDYSCLLNQASHFRCPRSADDERKHPVLCLFCGAILCSQNICCQEIVNGEEVGACIFHALHCGAGVCIFLKIRECRVVLVEGKARGCAYPAPYLDEYGETDPGLKRGNPLHLSRERYRKLHLVWQQHCIIEEIARSQETNQMLFGFNWQLL

SEQ ID NO: 94613 - protein, 62 aa, Homo sapiens
  Payload ID: 18866
  Gene Name: ubiquitin protein ligase E3 component n-recognin 1
  ENSP ID: ENSP00000454962
MADEEAGGTERMEISAELPQTPQRLASMGSHCVAQAGVQWHDLRSLTSPSLTQAILPPQPPE

SEQ ID NO: 94614 - protein, 72 aa, Homo sapiens
  Payload ID: 18866
  Gene Name: ubiquitin protein ligase E3 component n-recognin 1
  ENSP ID: ENSP00000455759
QHPLHVEVLHSEIMAHQKFALRLGSWMNKIMSYSSDFRQIFCQACLREEPDSENPCLISRLMLWDAKLYKVL

SEQ ID NO: 94615 - protein, 148 aa, Homo sapiens
  Payload ID: 18866
  Gene Name: ubiquitin protein ligase E3 component n-recognin 1
  ENSP ID: ENSP00000456327
VAQVVAEMWRRNGLSLISQVFYYQDVKCREEMYDKDIIMLQIGASLMDPNKFLLLVLQRYELAEAFNKTISTKDQDLIKQYNTLIEEMLQVLIYIVGERYVPGVGNVTKEEVTMREIIHLLCIEPMPHSAIAKNLPENETRCIRPWSL

SEQ ID NO: 94616 - protein, 31 aa, Homo sapiens
  Payload ID: 18866
  Gene Name: ubiquitin protein ligase E3 component n-recognin 1
  ENSP ID: ENSP00000456502
MADEEAGGTERMEISAELPQTPQRLASGLCN

SEQ ID NO: 94617 - protein, 172 aa, Homo sapiens
  Payload ID: 18866
  Gene Name: ubiquitin protein ligase E3 component n-recognin 1
  ENSP ID: ENSP00000457573
  MOD_RES (1)..(1): Any amino acid
XKPGVSGHGVYELKDESLKDFNMYFYHYSKTQHSKAEHMQKKRRKQENKDEALPPPPPPEFCPAFSKVINLLNCDIMMYILRTVFERAIDTDSNLWTEGMLQMAFHILALGLLEEKQQLQKAPEEEVTFDFYHKASRLGSSAMNIQMLLEKLKGIPQLEGQKDMITWILQVN

SEQ ID NO: 94618 - protein, 71 aa, Homo sapiens
  Payload ID: 18866
  Gene Name: ubiquitin protein ligase E3 component n-recognin 1
  ENSP ID: ENSP00000457879
  MOD_RES (1)..(1): Any amino acid
XNVINKVATFKKPGVSGHGVYELKDESLKDFNMYFYHYSKTQHSKAEHMQKKRRKQENKDEGKNIAATTTS

SEQ ID NO: 94619 - protein, 1070 aa, Homo sapiens
  Payload ID: 18866
  Gene Name: ubiquitin protein ligase E3 component n-recognin 1
  ENSP ID: ENSP00000477932
MADEEAGGTERMEISAELPQTPQRLASWWDQQVDFYTAFLHHLAQLVPEIYFAEMDPDLEKQEESVQMSIFTPLEWYLFGEDPDICLEKLKHSGAFQLCGRVFKSGETTYSCRDCAIDPTCVLCMDCFQDSVHKNHRYKMHTSTGGGFCDCGDTEAWKTGPFCVNHEPGRAGTIKENSRCPLNEEVIVQARKIFPSVIKYVVEMTIWEEEKELPPELQIREKNERYYCVLFNDEHHSYDHVIYSLQRALDCELAEAQLHTTAIDKEGRRAVKAGAYAACQEAKEDIKSHSENVSQHPLHVEVLHSEIMAHQKFALRLGSWMNKIMSYSSDFRQIFCQACLREEPDSENPCLISRLMLWDAKLYKGARKILHELIFSSFFMEMEYKKLFAMEFVKYYKQLQKEYISDDHDRSISITALSVQMFTVPTLARHLIEEQNVISVITETLLEVLPEYLDRNNKFNFQGYSQDKLGRVYAVICDLKYILISKPTIWTERLRMQFLEGFRSFLKILTCMQGMEEIRRQVGQHIEVDPDWEAAIAIQMQLKNILLMFQEWCACDEELLLVAYKECHKAVMRCSTSFISSSKTVVQSCGHSLETKSYRVSEDLVSIHLPLSRTLAGLHVRLSRLGAVSRLHEFVSFEDFQVEVLVEYPLRCLVLVAQVVAEMWRRNGLSLISQVFYYQDVKCREEMYDKDIIMLQIGASLMDPNKFLLLVLQRYELAEAFNKTISTKDQDLIKQYNTLIEEMLQVLIYIVGERYVPGVGNVTKEEVTMREIIHLLCIEPMPHSAIAKNLPENENNETGLENVINKVATFKKPGVSGHGVYELKDESLKDFNMYFYHYSKTQHSKAEHMQKKRRKQENKDEALPPPPPPEFCPAFSKVINLLNCDIMMYILRTVFERAIDTDSNLWTEGMLQMAFHILALGLLEEKQQLQKAPEEEVTFDFYHKASRLGSSAMNIQMLLEKLKGIPQLEGQKDMITWILQMFDTVKRLREKSCLIVATTSGSESIKNDEITHDKEKAERKRKAEAARLHRQKIMAQMSALQKNFIETHKLMYDNTSEMPGKEDSIMEEER

SEQ ID NO: 94620 - protein, 62 aa, Homo sapiens; identical to SEQ ID NO: 94613
  Payload ID: 18866
  Gene Name: ubiquitin protein ligase E3 component n-recognin 1
  ENSP ID: ENSP00000486206

SEQ ID NO: 94621 - protein, 1755 aa, Homo sapiens
  Payload ID: 18867
  Gene Name: ubiquitin protein ligase E3 component n-recognin 2
  Uniprot ID: Q8IWV8
  ENSP ID: ENSP00000361990
MASELEPEVQAIDRSLLECSAEEIAGKWLQATDLTREVYQHLAHYVPKIYCRGPNPFPQKEDMLAQHVLLGPMEWYLCGEDPAFGFPKLEQANKPSHLCGRVFKVGEPTYSCRDCAVDPTCVLCMECFLGSIHRDHRYRMTTSGGGGFCDCGDTEAWKEGPYCQKHELNTSEIEEEEDPLVHLSEDVIARTYNIFAITFRYAVEILTWEKESELPADLEMVEKSDTYYCMLFNDEVHTYEQVIYTLQKAVNCTQKEAIGFATTVDRDGRRSVRYGDFQYCEQAKSVIVRNTSRQTKPLKVQVMHSSIVAHQNFGLKLLSWLGSIIGYSDGLRRILCQVGLQEGPDGENSSLVDRLMLSDSKLWKGARSVYHQLFMSSLLMDLKYKKLFAVRFAKNYQQLQRDFMEDDHERAVSVTALSVQFFTAPTLARMLITEENLMSIIIKTFMDHLRHRDAQGRFQFERYTALQAFKFRRVQSLILDLKYVLISKPTEWSDELRQKFLEGFDAFLELLKCMQGMDPITRQVGQHIEMEPEWEAAFTLQMKLTHVISMMQDWCASDEKVLIEAYKKCLAVLMQCHGGYTDGEQPITLSICGHSVETIRYCVSQEKVSIHLPVSRLLAGLHVLLSKSEVAYKFPELLPLSELSPPMLIEHPLRCLVLCAQVHAGMWRRNGFSLVNQIYYYHNVKCRREMFDKDVVMLQTGVSMMDPNHFLMIMLSRFELYQIFSTPDYGKRFSSEITHKDVVQQNNTLIEEMLYLIIMLVGERFSPGVGQVNATDEIKREIIHQLSIKPMAHSELVKSLPEDENKETGMESVIEAVAHFKKPGLTGRGMYELKPECAKEFNLYFYHFSRAEQSKAEEAQRKLKRQNREDTALPPPVLPPFCPLFASLVNILQSDVMLCIMGTILQWAVEHNGYAWSESMLQRVLHLIGMALQEEKQHLENVTEEHVVTFTFTQKISKPGEAPKNSPSILAMLETLQNAPYLEVHKDMIRWILKTFNAVKKMRESSPTSPVAETEGTIMEESSRDKDKAERKRKAEIARLRREKIMAQMSEMQRHFIDENKELFQQTLELDASTSAVLDHSPVASDMTLTALGPAQTQVPEQRQFVTCILCQEEQEVKVESRAMVLAAFVQRSTVLSKNRSKFIQDPEKYDPLFMHPDLSCGTHTSSCGHIMHAHCWQRYFDSVQAKEQRRQQRLRLHTSYDVENGEFLCPLCECLSNTVIPLLLPPRNIFNNRLNFSDQPNLTQWIRTISQQIKALQFLRKEESTPNNASTKNSENVDELQLPEGFRPDFRPKIPYSESIKEMLTTFGTATYKVGLKVHPNEEDPRVPIMCWGSCAYTIQSIERILSDEDKPLFGPLPCRLDDCLRSLTRFAAAHWTVASVSVVQGHFCKLFASLVPNDSHEELPCILDIDMFHLLVGLVLAFPALQCQDFSGISLGTGDLHIFHLVTMAHIIQILLTSCTEENGMDQENPPCEEESAVLALYKTLHQYTGSALKEIPSGWHLWRSVRAGIMPFLKCSALFFHYLNGVPSPPDIQVPGTSHFEHLCSYLSLPNNLICLFQENSEIMNSLIESWCRNSEVKRYLEGERDAIRYPRESNKLINLPEDYSSLINQASNFSCPKSGGDKSRAPTLCLVCGSLLCSQSYCCQTELEGEDVGACTAHTYSCGSGVGIFLRVRECQVLFLAGKTKGCFYSPPYLDDYGETDQGLRRGNPLHLCKERFKKIQKLWHQHSVTEEIGHAQEANQTLVGIDWQHL

SEQ ID NO: 94622 - protein, 1755 aa, Homo sapiens
  Payload ID: 18867
  Gene Name: ubiquitin protein ligase E3 component n-recognin 2
  Uniprot ID: Q8IWV8
  ENSP ID: ENSP00000361992
MASELEPEVQAIDRSLLECSAEEIAGKWLQATDLTREVYQHLAHYVPKIYCRGPNPFPQKEDMLAQHVLLGPMEWYLCGEDPAFGFPKLEQANKPSHLCGRVFKVGEPTYSCRDCAVDPTCVLCMECFLGSIHRDHRYRMTTSGGGGFCDCGDTEAWKEGPYCQKHELNTSEIEEEEDPLVHLSEDVIARTYNIFAITFRYAVEILTWEKESELPADLEMVEKSDTYYCMLFNDEVHTYEQVIYTLQKAVNCTQKEAIGFATTVDRDGRRSVRYGDFQYCEQAKSVIVRNTSRQTKPLKVQVMHSSIVAHQNFGLKLLSWLGSIIGYSDGLRRILCQVGLQEGPDGENSSLVDRLMLSDSKLWKGARSVYHQLFMSSLLMDLKYKKLFAVRFAKNYERLQSDYVTDDHDREFSVADLSVQIFTVPSLARMLITEENLMSIIIKTFMDHLRHRDAQGRFQFERYTALQAFKFRRVQSLILDLKYVLISKPTEWSDELRQKFLEGFDAFLELLKCMQGMDPITRQVGQHIEMEPEWEAAFTLQMKLTHVISMMQDWCASDEKVLIEAYKKCLAVLMQCHGGYTDGEQPITLSICGHSVETIRYCVSQEKVSIHLPVSRLLAGLHVLLSKSEVAYKFPELLPLSELSPPMLIEHPLRCLVLCAQVHAGMWRRNGFSLVNQIYYYHNVKCRREMFDKDVVMLQTGVSMMDPNHFLMIMLSRFELYQIFSTPDYGKRFSSEITHKDVVQQNNTLIEEMLYLIIMLVGERFSPGVGQVNATDEIKREIIHQLSIKPMAHSELVKSLPEDENKETGMESVIEAVAHFKKPGLTGRGMYELKPECAKEFNLYFYHFSRAEQSKAEEAQRKLKRQNREDTALPPPVLPPFCPLFASLVNILQSDVMLCIMGTILQWAVEHNGYAWSESMLQRVLHLIGMALQEEKQHLENVTEEHVVTFTFTQKISKPGEAPKNSPSILAMLETLQNAPYLEVHKDMIRWILKTFNAVKKMRESSPTSPVAETEGTIMEESSRDKDKAERKRKAEIARLRREKIMAQMSEMQRHFIDENKELFQQTLELDASTSAVLDHSPVASDMTLTALGPAQTQVPEQRQFVTCILCQEEQEVKVESRAMVLAAFVQRSTVLSKNRSKFIQDPEKYDPLFMHPDLSCGTHTSSCGHIMHAHCWQRYFDSVQAKEQRRQQRLRLHTSYDVENGEFLCPLCECLSNTVIPLLLPPRNIFNNRLNFSDQPNLTQWIRTISQQIKALQFLRKEESTPNNASTKNSENVDELQLPEGFRPDFRPKIPYSESIKEMLTTFGTATYKVGLKVHPNEEDPRVPIMCWGSCAYTIQSIERILSDEDKPLFGPLPCRLDDCLRSLTRFAAAHWTVASVSVVQGHFCKLFASLVPNDSHEELPCILDIDMFHLLVGLVLAFPALQCQDFSGISLGTGDLHIFHLVTMAHIIQILLTSCTEENGMDQENPPCEEESAVLALYKTLHQYTGSALKEIPSGWHLWRSVRAGIMPFLKCSALFFHYLNGVPSPPDIQVPGTSHFEHLCSYLSLPNNLICLFQENSEIMNSLIESWCRNSEVKRYLEGERDAIRYPRESNKLINLPEDYSSLINQASNFSCPKSGGDKSRAPTLCLVCGSLLCSQSYCCQTELEGEDVGACTAHTYSCGSGVGIFLRVRECQVLFLAGKTKGCFYSPPYLDDYGETDQGLRRGNPLHLCKERFKKIQKLWHQHSVTEEIGHAQEANQTLVGIDWQHL

SEQ ID NO: 94623 - protein, 439 aa, Homo sapiens
  Payload ID: 18867
  Gene Name: ubiquitin protein ligase E3 component n-recognin 2
  Uniprot ID: Q8IWV8
  ENSP ID: ENSP00000361994
MASELEPEVQAIDRSLLECSAEEIAGKWLQATDLTREVYQHLAHYVPKIYCRGPNPFPQKEDMLAQHVLLGPMEWYLCGEDPAFGFPKLEQANKPSHLCGRVFKVGEPTYSCRDCAVDPTCVLCMECFLGSIHRDHRYRMTTSGGGGFCDCGDTEAWKEGPYCQKHELNTSEIEEEEDPLVHLSEDVIARTYNIFAITFRYAVEILTWEKESELPADLEMVEKSDTYYCMLFNDEVHTYEQVIYTLQKAVNCTQKEAIGFATTVDRDGRRSVRYGDFQYCEQAKSVIVRNTSRQTKPLKVQVMHSSIVAHQNFGLKLLSWLGSIIGYSDGLRRILCQVGLQEGPDGENSSLVDRLMLSDSKLWKGARSVYHQLFMSSLLMDLKYKKLFAVRFAKNYERLQSDYVTDDHDREFSVADLSVQIFTVPSLFSISAGRSGSPL

SEQ ID NO: 94624 - protein, 1888 aa, Homo sapiens
  Payload ID: 18868
  Gene Name: ubiquitin protein ligase E3 component n-recognin 3 (putative)
  Uniprot ID: Q6ZT12
  ENSP ID: ENSP00000272793
MAAAAAAAVGGQQPSQPELPAPGLALDKAATAAHLKAALSRPDNRAGAEELQALLERVLSAERPLAAAAGGEDAAAAGGGGGPGAAEEEALEWCKCLLAGGGGYDEFCAAVRAYDPAALCGLVWTANFVAYRCRTCGISPCMSLCAECFHQGDHTGHDFNMFRSQAGGACDCGDSNVMRESGFCKRHQIKSSSNIPCVPKDLLMMSEFVLPRFIFCLIQYLREGYNEPAADGPSEKDLNKVLQLLEPQISFLEDLTKMGGAMRSVLTQVLTNQQNYKDLTSGLGENACVKKSHEKYLIALKSSGLTYPEDKLVYGVQEPSAGTSSLAVQGFIGATGTLGQVDSSDEDDQDGSQGLGKRKRVKLSSGTKDQSIMDVLKHKSFLEELLFWTIKYEFPQKMVTFLLNMLPDQEYKVAFTKTFVQHYAFIMKTLKKSHESDTMSNRIVHISVQLFSNEELARQVTEECQLLDIMVTVLLYMMESCLIKSELQDEENSLHVVVNCGEALLKNNTYWPLVSDFINILSHQSVAKRFLEDHGLLVTWMNFVSFFQGMNLNKRELNEHVEFESQTYYAAFAAELEACAQPMWGLLSHCKVRETQEYTRNVVRYCLEALQDWFDAINFVDEPAPNQVTFHLPLHRYYAMFLSKAVKCQELDLDSVLPDQEMLMKLMIHPLQIQASLAEIHSNMWVRNGLQIKGQAMTYVQSHFCNSMIDPDIYLLQVCASRLDPDYFISSVFERFKVVDLLTMASQHQNTVLDAEHERSMLEGALTFLVILLSLRLHLGMSDDEILRAEMVAQLCMNDRTHSSLLDLIPENPNPKSGIIPGSYSFESVLSAVADFKAPVFEPGGSMQQGMYTPKAEVWDQEFDPVMVILRTVYRRDVQSAMDRYTAFLKQSGKFPGNPWPPYKKRTSLHPSYKGLMRLLHCKTLHIVLFTLLYKILMDHQNLSEHVLCMVLYLIELGLENSAEEESDEEASVGGPERCHDSWFPGSNLVSNMRHFINYVRVRVPETAPEVKRDSPASTSSDNLGSLQNSGTAQVFSLVAERRKKFQEIINRSSSEANQVVRPKTSSKWSAPGSAPQLTTAILEIKESILSLLIKLHHKLSGKQNSYYPPWLDDIEILIQPEIPKYSHGDGITAVERILLKAASQSRMNKRIIEEICRKVTPPVPPKKVTAAEKKTLDKEERRQKARERQQKLLAEFASRQKSFMETAMDVDSPENDIPMEITTAEPQVSEAVYDCVICGQSGPSSEDRPTGLVVLLQASSVLGQCRDNVEPKKLPISEEEQIYPWDTCAAVHDVRLSLLQRYFKDSSCLLAVSIGWEGGVYVQTCGHTLHIDCHKSYMESLRNDQVLQGFSVDKGEFTCPLCRQFANSVLPCYPGSNVENNPWQRPSNKSIQDLIKEVEELQGRPGAFPSETNLSKEMESVMKDIKNTTQKKYRDYSKTPGSPDNDFLFMYSVARTNLELELIHRGGNLCSGGASTAGKRSCLNQLFHVLALHMRLYSIDSEYNPWRKLTQLEEMNPQLGYEEQQPEVPILYHDVTSLLLIQILMMPQPLRKDHFTCIVKVLFTLLYTQALAALSVKCSEEDRSAWKHAGALKKSTCDAEKSYEVLLSFVISELFKGKLYHEEGTQECAMVNPIAWSPESMEKCLQDFCLPFLRITSLLQHHLFGEDLPSCQEEEEFSVLASCLGLLPTFYQTEHPFISASCLDWPVPAFDIITQWCFEIKSFTERHAEQGKALLIQESKWKLPHLLQLPENYNTIFQYYHRKTCSVCTKVPKDPAVCLVCGTFVCLKGLCCKQQSYCECVLHSQNCGAGTGIFLLINASVIIIIRGHRFCLWGSVYLDAHGEEDRDLRRGKPLYICKERYKVLEQQWISHTFDHINKRWGPHYNGL

SEQ ID NO: 94625 - protein, 950 aa, Homo sapiens
  Payload ID: 18868
  Gene Name: ubiquitin protein ligase E3 component n-recognin 3 (putative)
  ENSP ID: ENSP00000376409
  MOD_RES (1)..(1): Any amino acid
XSEHVLCMVLYLIELGLENSAEEESDEEASVGGPERCHDSWFPGSNLVSNMRHFINYVRVRVPETAPEVKRDSPASTSSDNLGSLQNSGTAQVFSLVAERRKKFQEIINRSSSEANQVVRPKTSSKWSAPGSAPQLTTAILEIKESILSLLIKLHHKLSGKQNSYYPPWLDDIEILIQPEIPKYSHGDGITAVERILLKAASQSRMNKRIIEEICRKVTPPVPPKKVTAAEKKTLDKEERRQKARERQQKLLAEFASRQKSFMETAMDVDSPENDIPMEITTAEPQVSEAVYDCVICGQSGPSSEDRPTGLVVLLQASSVLGQCRDNVEPKKLPISEEEQIYPWDTCAAVHDVRLSLLQRYFKDSSCLLAVSIGWEGGVYVQTCGHTLHIDCHKSYMESLRNDQVLQGFSVDKGEFTCPLCRQFANSVLPCYPGSNVENNPWQRPSNKSIQDLIKEVEELQGRPGAFPVSISSETNLSKEMESVMKDIKNTTQKKYRDYSKTPGSPDNDFLFMYSVARTNLELELIHRGGNLCSGGASTAGKRSCLNQLFHVLALHMRLYSIDSEYNPWRKLTQLEEMNPQLGYEEQQPEVPILYHDVTSLLLIQILMMPQPLRKDHFTCIVKVLFTLLYTQALAALSVKCSEEDRSAWKHAGALKKSTCDAEKSYEVLLSFVISELFKGKLYHEEGTQECAMVNPIAWSPESMEKCLQDFCLPFLRITSLLQHHLFGEDLPSCQEEEEFSVLASCLGLLPTFYQTEHPFISASCLDWPVPAFDIITQWCFEIKSFTERHAEQGKALLIQESKWKLPHLLQLPENYNTIFQYYHRKTCSVCTKVPKDPAVCLVCGTFVCLKGLCCKQQSYCECVLHSQNCGAGTGIFLLINASVIIIIRGHRFCLWGSVYLDAHGEEDRDLRRGKPLYICKERYKVLEQQWISHTFDHINKRWGPHYNGL

SEQ ID NO: 94626 - protein, 588 aa, Homo sapiens
  Payload ID: 18868
  Gene Name: ubiquitin protein ligase E3 component n-recognin 3 (putative)
  ENSP ID: ENSP00000389097
LHIDCHKSYMESLRNDQVLQGFSVDKGEFTCPLCRQFANSVLPCYPGSNVENNPWQRPSNKSIQDLIKEVEELQGRPGAFPSETNLSKEMESVMKDIKNTTQKKYRDYSKTPGSPDNDFLFMYSVARTNLELELIHRGGNLCSGGASTAGKRSCLNFCFIIFPFTKSEIILCQYRKSHDKVYPKYQLFHVLALHMRLYSIDSEYNPWRKLTQLEEMNPQLGYEEQQPEVPILYHDVTSLLLIQILMMPQPLRKDHFTCIVKVLFTLLYTQALAALSVKCSEEDRSAWKHAGALKKSTCDAEKSYEVLLSFVISELFKGKLYHEEGTQECAMVNPIAWSPESMEKCLQDFCLPFLRITSLLQHHLFGEDLPSCQEEEEFSVLASCLGLLPTFYQTEHPFISASCLDWPVPAFDIITQWCFEIKSFTERHAEQGKALLIQESKWKLPHLLQLPENYNTIFQYYHRKTCSVCTKVPKDPAVCLVCGTFVCLKGLCCKQQSYCECVLHSQNCGAGTGIFLLINASVIIIIRGHRFCLWGSVYLDAHGEEDRDLRRGKPLYICKERYKVLEQQWISHTFDHINKRWGPHYNGL

SEQ ID NO: 94627 - protein, 1888 aa, Homo sapiens; identical to SEQ ID NO: 94624
  Payload ID: 18868
  Gene Name: ubiquitin protein ligase E3 component n-recognin 3 (putative)
  Uniprot ID: Q6ZT12
  ENSP ID: ENSP00000396068

SEQ ID NO: 94628 - protein, 77 aa, Homo sapiens
  Payload ID: 18868
  Gene Name: ubiquitin protein ligase E3 component n-recognin 3 (putative)
  ENSP ID: ENSP00000408436
MKDIKNTTQKKYRDYSKTPGSPDNDFLFMYSVARLGNRRFVKTKCIDLIYIPLMKEHMLVSARFLSTSMKSLSLLPC

SEQ ID NO: 94629 - protein, 384 aa, Homo sapiens
  Payload ID: 18868
  Gene Name: ubiquitin protein ligase E3 component n-recognin 3 (putative)
  ENSP ID: ENSP00000415982
  MOD_RES (1)..(1): Any amino acid
XPKAEVWDQEFDPVMVILRTVYRRDVQSAMDRYTAFLKQSGKFPGNPWPPYKKRTSLHPSYKGLMRLLHCKTLHIVLFTLLYKILMDHQNLSEHVLCMVLYLIELGLENSAEEESDEEASVGGPERCHDSWFPGSNLVSNMRHFINYVRVRVPETAPEVKRDSPASTSSDNLGSLQNSGTAQVFSLVAERRKKFQEIINRSSSEANQVVRPKTSSKWSAPGSAPQLTTAILEIKESILSLLIKLHHKLSGKQNSYYPPWLDDIEILIQPEIPKYSHGDGITAVERILLKAASQSRMNKRIIEEICRKVTPPVPPKKVTAAEKKTLDKEERRQKARERQQKLLAEFASRQKSFMETAMDVVRQNKNNFLRNQLSNVPRADWVVLP

SEQ ID NO: 94630 - protein, 212 aa, Homo sapiens
  Payload ID: 18869
  Gene Name: ubiquitin protein ligase E3 component n-recognin 4
  Uniprot ID: Q5T4S7
  ENSP ID: ENSP00000364366
MVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQVVPRCKGHLDKGLGLDQKTAS

SEQ ID NO: 94631 - protein, 890 aa, Homo sapiens
  Payload ID: 18869
  Gene Name: ubiquitin protein ligase E3 component n-recognin 4
  ENSP ID: ENSP00000364372
MLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEEMENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 94632 - protein, 258 aa, Homo sapiens
  Payload ID: 18869
  Gene Name: ubiquitin protein ligase E3 component n-recognin 4
  ENSP ID: ENSP00000364373
MGPGKKGRCREEGPGRGRRAWIIRGSGSSRQGWVGSVESSKRSANVTRQRQIEQILPALAAGSCFHPAFILSCRFSSRTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 94633 - protein, 5183 aa, Homo sapiens
  Payload ID: 18869
  Gene Name: ubiquitin protein ligase E3 component n-recognin 4
  Uniprot ID: Q5T4S7
  ENSP ID: ENSP00000364403
MATSGGEEAAAAAPAPGTPATGADTTPGWEVAVRPLLSASYSAFEMKELPQLVASVIESESEILHHEKQYEPFYSSFVALSTHYITTVCSLIPRNQLQSVAAACKVLIEFSLLRLENPDEACAVSQKHLILLIKGLCTGCSRLDRTEIITFTAMMKSAKLPQTVKTLSDVEDQKELASPVSPELRQKEVQMNFLNQLTSVFNPRTVASQPISTQTLVEGENDEQSSTDQASAIKTKNVFIAQNVASLQELGGSEKLLRVCLNLPYFLRYINRFQDAVLANSFFIMPATVADATAVRNGFHSLVIDVTMALDTLSLPVLEPLNPSRLQDVTVLSLSCLYAGVSVATCMAILHVGSAQQVRTGSTSSKEDDYESDAATIVQKCLEIYDMIGQAISSSRRAGGEHYQNFQLLGAWCLLNSLFLILNLSPTALADKGKEKDPLAALRVRDILSRTKEGVGSPKLGPGKGHQGFGVLSVILANHAIKLLTSLFQDLQVEALHKGWETDGPPAALSIMAQSTSIQRIQRLIDSVPLMNLLLTLLSTSYRKACVLQRQRKGSMSSDASASTDSNTYYEDDFSSTEEDSSQDDDSEPILGQWFEETISPSKEKAAPPPPPPPPPLESSPRVKSPSKQAPGEKGNILASRKDPELFLGLASNILNFITSSMLNSRNNFIRNYLSVSLSEHHMATLASIIKEVDKDGLKGSSDEEFAAALYHFNHSLVTSDLQSPNLQNTLLQQLGVAPFSEGPWPLYIHPQSLSVLSRLLLIWQHKASAQGDPDVPECLKVWDRFLSTMKQNALQGVVPSETEDLNVEHLQMLLLIFHNFTETGRRAILSLFVQIIQELSVNMDAQMRFVPLILARLLLIFDYLLHQYSKAPVYLFEQVQHNLLSPPFGWASGSQDSNSRRATTPLYHGFKEVEENWSKHFSSDAVPHPRFYCVLSPEASEDDLNRLDSVACDVLFSKLVKYDELYAALTALLAAGSQLDTVRRKENKNVTALEACALQYYFLILWRILGILPPSKTYINQLSMNSPEMSECDILHTLRWSSRLRISSYVNWIKDHLIKQGMKAEHASSLLELASTTKCSSVKYDVEIVEEYFARQISSFCSIDCTTILQLHEIPSLQSIYTLDAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEEMENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 94634 - protein, 984 aa, Homo sapiens
  Payload ID: 18869
  Gene Name: ubiquitin protein ligase E3 component n-recognin 4
  ENSP ID: ENSP00000395313
DFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETDCFFPRCACWSLGIVGILIGAPLETPSPEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKE

SEQ ID NO: 94635 - protein, 2058 aa, Homo sapiens
  Payload ID: 18869
  Gene Name: ubiquitin protein ligase E3 component n-recognin 4
  ENSP ID: ENSP00000404897
LVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLESSETESLTKLDRLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKK

SEQ ID NO: 94636 - protein, 2798 aa, Homo sapiens
  Payload ID: 18870
  Gene Name: ubiquitin protein ligase E3 component n-recognin 5
  Uniprot ID: O95071
  ENSP ID: ENSP00000220959
MTSIHFVVHPLPGTEDQLNDRLREVSEKLNKYNLNSHPPLNVLEQATIKQCVVGPNHAAFLLEDGRVCRIGFSVQPDRLELGKPDNNDGSKLNSNSGAGRTSRPGRTSDSPWFLSGSETLGRLAGNTLGSRWSSGVGGSGGGSSGRSSAGARDSRRQTRVIRTGRDRGSGLLGSQPQPVIPASVIPEELISQAQVVLQGKSRSVIIRELQRTNLDVNLAVNNLLSRDDEDGDDGDDTASESYLPGEDLMSLLDADIHSAHPSVIIDADAMFSEDISYFGYPSFRRSSLSRLGSSRVLLLPLERDSELLRERESVLRLRERRWLDGASFDNERGSTSKEGEPNLDKKNTPVQSPVSLGEDLQWWPDKDGTKFICIGALYSELLAVSSKGELYQWKWSESEPYRNAQNPSLHHPRATFLGLTNEKIVLLSANSIRATVATENNKVATWVDETLSSVASKLEHTAQTYSELQGERIVSLHCCALYTCAQLENSLYWWGVVPFSQRKKMLEKARAKNKKPKSSAGISSMPNITVGTQVCLRNNPLYHAGAVAFSISAGIPKVGVLMESVWNMNDSCRFQLRSPESLKNMEKASKTTEAKPESKQEPVKTEMGPPPSPASTCSDASSIASSASMPYKRRRSTPAPKEEEKVNEEQWSLREVVFVEDVKNVPVGKVLKVDGAYVAVKFPGTSSNTNCQNSSGPDADPSSLLQDCRLLRIDELQVVKTGGTPKVPDCFQRTPKKLCIPEKTEILAVNVDSKGVHAVLKTGNWVRYCIFDLATGKAEQENNFPTSSIAFLGQNERNVAIFTAGQESPIILRDGNGTIYPMAKDCMGGIRDPDWLDLPPISSLGMGVHSLINLPANSTIKKKAAVIIMAVEKQTLMQHILRCDYEACRQYLMNLEQAVVLEQNLQMLQTFISHRCDGNRNILHACVSVCFPTSNKETKEEEEAERSERNTFAERLSAVEAIANAISVVSSNGPGNRAGSSSSRSLRLREMMRRSLRAAGLGRHEAGASSSDHQDPVSPPIAPPSWVPDPPAMDPDGDIDFILAPAVGSLTTAATGTGQGPSTSTIPGPSTEPSVVESKDRKANAHFILKLLCDSVVLQPYLRELLSAKDARGMTPFMSAVSGRAYPAAITILETAQKIAKAEISSSEKEEDVFMGMVCPSGTNPDDSPLYVLCCNDTCSFTWTGAEHINQDIFECRTCGLLESLCCCTECARVCHKGHDCKLKRTSPTAYCDCWEKCKCKTLIAGQKSARLDLLYRLLTATNLVTLPNSRGEHLLLFLVQTVARQTVEHCQYRPPRIREDRNRKTASPEDSDMPDHDLEPPRFAQLALERVLQDWNALKSMIMFGSQENKDPLSASSRIGHLLPEEQVYLNQQSGTIRLDCFTHCLIVKCTADILLLDTLLGTLVKELQNKYTPGRREEAIAVTMRFLRSVARVFVILSVEMASSKKKNNFIPQPIGKCKRVFQALLPYAVEELCNVAESLIVPVRMGIARPTAPFTLASTSIDAMQGSEELFSVEPLPPRPSSDQSSSSSQSQSSYIIRNPQQRRISQSQPVRGRDEEQDDIVSADVEEVEVVEGVAGEEDHHDEQEEHGEENAEAEGQHDEHDEDGSDMELDLLAAAETESDSESNHSNQDNASGRRSVVTAATAGSEAGASSVPAFFSEDDSQSNDSSDSDSSSSQSDDIEQETFMLDEPLERTTNSSHANGAAQAPRSMQWAVRNTQHQRAASTAPSSTSTPAASSAGLIYIDPSNLRRSGTISTSAAAAAAALEASNASSYLTSASSLARAYSIVIRQISDLMGLIPKYNHLVYSQIPAAVKLTYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALSLMRSHNDEHSDVLPVLDVCSLKHVAYVFQALIYWIKAMNQQTTLDTPQLERKRTRELLELGIDNEDSEHENDDDTNQSATLNDKDDDSLPAETGQNHPFFRRSDSMTFLGCIPPNPFEVPLAEAIPLADQPHLLQPNARKEDLFGRPSQGLYSSSASSGKCLMEVTVDRNCLEVLPTKMSYAANLKNVMNMQNRQKKEGEEQPVLPEETESSKPGPSAHDLAAQLKSSLLAEIGLTESEGPPLTSFRPQCSFMGMVISHDMLLGRWRLSLELFGRVFMEDVGAEPGSILTELGGFEVKESKFRREMEKLRNQQSRDLSLEVDRDRDLLIQQTMRQLNNHFGRRCATTPMAVHRVKVTFKDEPGEGSGVARSFYTAIAQAFLSNEKLPNLECIQNANKGTHTSLMQRLRNRGERDREREREREMRRSSGLRAGSRRDRDRDFRRQLSIDTRPFRPASEGNPSDDPEPLPAHRQALGERLYPRVQAMQPAFASKITGMLLELSPAQLLLLLASEDSLRARVDEAMELIIAHGRENGADSILDLGLVDSSEKVQENRKRHGSSRSVVDMDLDDTDDGDDNAPLFYQPGKRGFYTPRPGKNTEARLNCFRNIGRILGLCLLQNELCPITLNRHVIKVLLGRKVNWHDFAFFDPVMYESLRQLILASQSSDADAVFSAMDLAFAIDLCKEEGGGQVELIPNGVNIPVTPQNVYEYVRKYAEHRMLVVAEQPLHAMRKGLLDVLPKNSLEDLTAEDFRLLVNGCGEVNVQMLISFTSFNDESGENAEKLLQFKRWFWSIVEKMSMTERQDLVYFWTSSPSLPASEEGFQPMPSITIRPPDDQHLPTANTCISRLYVPLYSSKQILKQKLLLAIKTKNFGFV
